United States Patent 6,812,339 (POLYMORPHISMS IN KNOWN GENES ASSOCIATED WITH HUMAN DISEASE, METHODS OF DETECTION AND USES THEREOF) - sequence listing, part 76

SEQ ID NO: 17110 - DNA, 70014 bp, Human
  misc_feature (1)...(70014): n = A,T,C or G
catcatttcttcattcacctcttcagcaaacattgttacctatagaagggtggtttttggcactgtggaaagagctagacctgtaaagatgaataagccagtttctgctgtctggactcagtctattcactcaactagtggtaatagctataatgaagaagattgaaagaaattgctctcttagctaaaacacaagaaggagcagagcttaaggaaggtgaggtaagtagaacctcacattctattttggcagtctttgcattggtcccacttttcctgggttggggaatactgtttcttctatcacgcactactgtcctctgttgttcccctctgtcactcctctcactctcttttttcctcctgcagcaaagggaaaaagtcaaagaggccatgagaggactaggcaaaggggaaacaggaagttgttcaggtaccttgtgtagtaggtctccttttcttggaccatgggggaaagcaaaggctggattctgatcgtctaagagctaaaagggaccacagaggccatccttactatccgtttacagctgaggacactgagggttaataacttaccaaggccatgcaattagtggcattggcagcactagaactcaggcttcttgacttccagagagttagaatggagcacttctaatcctttatgcagggtagggtagtagccagagatggaaaccctactactggcttcagccattattctgattatcttcttcactatcaagcactccttcatttccgatcctccaaacaattggacaatttattaatgtagtcaccccatagttctctgttcagtagggacttattttcaaatcttctctgtcatttcagttatccaccccataaggaacaaattatggtttctcgacatccttttgaaaacgtgcaacccaaactaaccgcacagcttcaaagatctgtttggtgaggtaaaatgatgtctttgtgttctgcttttcaatgcatcctaatttgacttttggttttgctcatttgttagtaaattttcaacactttacttacttttaccgtgtcagtaaagaccttgaggaatttacatagttgatctatttctataagggtgctctcctgaaccttgtcctgtgtgaaggcccgccttttttcttttttctctttgtttctctctttttttcatttgttagcttgtcagtaatgaccgggtggcggatacatgtcaagaaaactaatcaccttctaacaggattaagactagaattaatgcagatcttgtgcccttcctgttcccgctttggcagcccaaggtccaccactgctcagagactagctggagggcaacggcgtcccatagcatctcacactgtgttgggatcctaggtggtgacctttgtgagattcagtactgagtttctgggagacggcgctgcggttgtgatcggaattgttggccgacgcacctctggacgcccagtgaggcaaaagcatctcctgttttcaaggtgatgacactgggctggaatgccgcggggccaaccagtccgtcctgccagacaagtttctggtccagtgagcctccgacccgccgcgcgtgtcaagctgacaaggccggggaggcgtttgaagcagcagtgttgagcgctgttaacatttagcgggcgtctttgagtagctcctccagccctcgcagcggcccagggactagcctgcaagttctcaacgctcacttccagcccgcgctggccccgcctccgcctcccagctcctcagcctcctcccgccccaccgctcccaccttttctcaggcccccacctgccagcacgcagaggcgggggcggggtcgcgggccgggctcctgacgtcacctcacggggaggcggggctgtgggaaccgcagtgcagcgcagaggggcggggcctgcggcgcgagacctggtgcgggaggcccgggcagggagaagtgtgcggggccgggacaagccggctccgagtccggctccggggggcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagtaagtggagccgagagaggcggacgccgcgccctggctgggtcctggttggaagcgggacacttgagagcaagggtggggcccgtccagcgtcaggtgaggctgcacgctgccggtgcaccttcctccctgcctggcactgcttcctccttctccagagggggtcgggacccgggatcccagtggcggtgaggttcccaggatgaccgcggccgctgcccgggagaaatgggccactcaacccggcttacagtttagcttcatcctcttccggtcccttcttcaggatctggggccgacgctggaatcaggagggaacctgtcctcctaggggctgcagtgcagttagtagctgccacctcacctctcttttcagtagagggaacaaagttagtaaggactagagacgtgccaccgtcggctgtatcatttcatcggatcctgacgcgggaggcttggcttctcgcgctgccccatatgcacttacattttctccatcctttttcagtatgatagattttggaggttttagagtatcatgcacgtgacataatagtaatcttccagcttcttttgagtacacgacagacagtgcaattcttctgtctaccagtagatttcatataacccgacgttaattcatgaagacttttcacttccttttctatagattactcttctttcacatttaagaataagtagatgcgatattactatctgtttaaagctagaaaaggaattcgggcgtgtttggtaatatagtggtgcaagtaagaacttgtgaagaaatgcagttttatgaccttatggactggatggtttgggaaattggaccagagaatagattgttgtatcaaaccgtctgtttagaaaattccattttatttgagaaacccaaaacacgtaaactgtttctagaagcatactttggaagcaggcattgcagtttgaattacagaagtgaggtggattgcccaaggtcaagttcgtggctcttgaaactagaatctaagtttcctgattccttttcttctggtttatgtggttgctgagactggctggcagttctgatttggggaggattccacctgaaagttgatgttgatgagtttgatgtaacccaaattacaaagccctaataggaacatatcacatgatatcacgaaataaacgtaaacgtgattcttagtactaaaactttagaatcaatggaatcaatgtagtgacacttttccccttacccttgatagtaagtagaataaaatgagtctgtaataaaacataagtgtcaaggaattacccaaaatataacaatttccagctactgaaggttgaagttacaaaactaggaacagtgggctgagaatagtctttgtgaaaactgccttggaaactagacccaaaatagaattaattaggttgggatttgttttgttttgtttttagcactggtatagtttagcatcaaggaaataccagcttctctatgctgacttccttaactcgacaaagctaacaagcttttgttaagagaaaagatgttcaggaagccatgcataaaataccttcggaattaagttttttctttttttaacaccataatgtatttaaaatggaaactacttctgtagtgtgatttgactcattagaactgttgtctctagctatctgtgactaggttacctcgctgcatatttatttatttatcaatgcagtactgttggtttttattgacacatgtccagctggattttgttttctgaaagtagactttgctatatgtaacctgttttgtcaagatttcttagacaaggatgaacatattcaaaccatatctaaaatactgctctacttttagagtttatcatgaggaacttttgacttggcaagctgatagatattgaactctatccctgtctgtcctttcttatcagggtgtgtatttgaatacacctgtatttccaggtcaagggctattttaaaatcagtttgcacactggaggctggttaatatttggtcaattcaaactcattaagggccttccctgttcagttgcagtaaaggcaaaactcttggggaattagtgaaagaagtgaaggaggtacattatattctgctattataatacactcccatgcattgccattttgtagtcttttaataatggtgttattaacatgacactccctttgttccggactggtgacttatgctgagagaaggctctgtactccagataattagcaagtgaaaaaaatacttcttacctgcagaggaatgttcccaagtgttaaatgttggagtggtacttgaaaaatgacaagggacatcttcaaggaaccctgcaggagacatatatgagttagatttattggaagtctgtacaaggctcattgttagcatagagggcatgcttggcgtctacctggagactgtaggaaaagctctaaacagtggatgaggattgagctgggaatgaaaagattcctgggactcaccaggtttacaagggtttgggtagggtgttctaggcaaaggacgtgttgggttttttcttgaatcagcattctaggcacagggttgcagatacagaggaagagataatgaaggtcctgagagcaaaaggaggaggcattgcttagagcagtggtccccaaattttttggcaccagggatcagttttgtggaagacacttttttccacggatgggttggggggatggtttcaggatgattcaggtacattacatttattgtgcactttatttctattattattacattgtaatatataatgaaataattatacaactcaccataatataaaatccatgggagccctgagcttgttatcctgcaactatacagtcccacctgggggtgatgggagacagtgacagatcatcaggccttagattctcataaggaacatgcagcctagatccctcgcatgtgcagttcacaacagggttcaagctcctgtgaggatctaatgctgctgttgatctgacaggaggcagcgctcggtggtaatgcgagtgatggggtgtggctgtaaatacagaggaagcttcactcgcagaccactcacctgctctgcagccgggttcccaacaggcccagttcctaacaggccggtactggtctgtggcctgggggttggggacccctggcttagaggacatcatcagtagtacttaggaataagggctgagatagaacgtggagtttagcaaaagatctaagtagaagcaagtttaggttgaggaaattgagaggtgaaatgttggtagttattgttataaagtggcagtgaaaggaatacaggatggcaactagagagacaggaggattaatgaagatttttcttttcagaggaggggagatatatatttgtatgaaagtcaaatgagtaaagatgttgaagacaatgggtaggccctaggaaaaagaaagcaaacatggggtagagactatggattattgggatatccaaggaaagaaaagagggatgcatgtcttttccttaagaaaagaaagacggaatgaagagtggatacaggaacattttgaaaagcagaaaggagaagatcaaatgttggatgccttcagttagtaaagtaggaactcagaaccaatgagcttcaagggatcttagaaacaacttggtttaactcaattcatatatatttgtatttgtatatatttatatataatttggtatatatacaattaaattttaaacaataaatttgtattcagttgaatcttcactgagtttaataattctgtatagttttataatagttaccttttggtcatttcctatcacacttcccaaaaatgacagttcagatgtgttccagtcacgttcagtgttgtgtgactgtgtgttaggaatatccccatttaatagctgagaataagaaaagcaatgggagtgatttaggcctggggagtgccagaggtccaggatgtagggaattagagagtcagtgaagccaagattgaagtggatgaccacagattcaggtcggcagggaagtgggctggtgaagatctaatgggttgagtgggaatgagtattgaaacagaaagagctaagacatgacttatgtagagaccaagggagaacttcccctctgccctctgaagacttgccagaaaaaactgacaacaggtagattaatcggagaaatggcatacaagtttattaacgtgtggggtgggaggagggagacagagtgattacctgaaccccaagaggctcagaagcttatataccatcttgaggcaaaggtggtcctgtcatgtagatgaaacctcatagggaggagccctcagagagaatagatggtgaatatttctttcagacctttaaaagtgtcagactctcagttagtctttcctagatccagacaagagagaaccttcagagaaggccaggttgcatcaatgcagattttctctacagacgcaaatctacctcacaaaagacagctttgcagggctgtttgtttgcaggccctcttaacagccatctcaaaatatgtcaaagaagtataatttggggtgaaatattctgatttccttcacttgctagaccctgaagtgggagaaaagagggtgcacattgaggctgtggccagtcaaggggagcacacgtggaatagtgtgctttcaggtaagatccctgtgtgtttgtgcatggggctgctacttagggattttggtttgtgaagttgaggagaaaacaatccagagatcagttaacgtctctcctccatttgagatgtgtgcagcttctttcataaatacattattattttcaaataaacttttaattttggaacaactttgatttatgtaaccaccccacaggttcttctttcttgctgcccagatagaactggtttatcaacacgggagaattgcaatagagaaaaagagtttaatgcacacagagccggctaaacaggcggccagggttttattattactcacattaacctccctaaaaatttggaggctagactttttaaaagatagtttggtgtgcagggggttagagaatgggtgctgctgattggttggggaggcaattgcaggggtatggaaaatggtccttgtatgctgagtccatttctggatgggggggccacaggagttgctggtttgggaggagttatccagtcatcagaaatataaaaatctgaaagtggtctatcttttaaaaggccaatcttagcttctttaatagtgatattatgtgtagaagtaattggagaagttgcaaatcttgtgatctccagaccagtggctggtaattgtttacatgtaatcacaacaaaattcagtcccctctcataatcctaaacttgtgaccttttattagttttataaaggcagtttagtttagggaagagctgttatcatttaacctgtaaactaaattcttccaaagttagcttggttctcacttgggaatgaccatgggcagcttgaaggttaaaggcaagatagagttggttaggtcagattttttttcactgttatgattttctcactgttacagtttttgtaaaggtggttggttttatttacagaagcattacaaagatttctatgtacttttcaccgactttcccgtaaggtttgtatcttgcataaccgtggtacatcggtcaaaacttaagaaattaacatagctataatatcattttagactgtagatactattcagaaattcactggttgttccactatccatttactgccctgggatacaatccgagattcaacactgcatttagtctagtttattttgttattgtaaaagccttattgtgtttttgtaaattacttcttcattttggtacacttcactacaggttgtgctgatgtcacctgtaagtgtaatgaacattttctatagtttttcatctagatctaggccattaataaaatactaatgtttagatctagatttctggactaccatttgggctgatactccctaattgttgataaattatcagtcagtattaccacctaaataattttccatgattcagcttttatcatgcacagcatattcatttcatttaataacatttttttaaaatgctggcttccaaaatatcggcaacccagccaggtggtaagacagagctgggtttttagcttactgcagtgaggaacacttccacagagccttggtagtatttcagagggggagaggcaagttgtaacgtatttgagaattggaagtttggtttaaggcaggtcttttttgttttgttttgttttgagacggagtctcactctgttgcccaggctggagtgcagtggcgcgacctcggctcactgcaagctctgcctcccgggttcacgccattcttctgcctcagcctccgacgtagctgggactacaggcacccgccaccacgcctggctaatttttttgtatttttagtagagacggggtttcacagtgttagccaggacgatctcaatctcctgaccttgtgatctgcccgccttggcctcccaaagtgctgggattacaggcatgagccacctcacccagcctaaggcaggtctttcaatgtggggaattgattaggattgggtaagggtcacaatataacaatttggggttagtagataagccagataaggattttgaggcaaacattttcaaagagtcttaggactaaactgttcattgatgcttcctttcaaagagttgatgtgtcttttagaaattcttgtaaacatcatgaactcctagcaagagtttccaggaatactcaagttatactaataaaagagtgaatctaaaggcatggtaatgtaatagtaagctatgtgcgggttaggaatggtagttaacttgagatttctaaagaatatctgagggttaccatgtgaattttcacttagtgtttatgatctttaaacagttcattttcttattattttgagagatactaccatagaatgtcatcaactacatcaagctttggatgtgtaccacagtgggtttttttgatgctgtcatcctaaggaagaagctgaggcataacatagaatttaaggacaatacttgagccaaatttaaagactttacttgagccaaagtgagtacactgcctgggacatacttccaagttgcctgggggtgtgccttggttggcctttgttataagcaagtttttaaaggcaaaaaggaacagggaatgggctggtacaaagttgtttgacaggaattctcattgccttacagagataatattgatgaatgattggctattcagttttaaaatgtaaggtatgaggtacaatgtctagtatatggtattttatggctacatggtatcagtccagagccaacatagcaagtggctcgaagaggtaattgtttagctcaaacggtgagagacatgactgctgacacattttaaatgcctctcggggcctgataatttaatgagactcatattcttcaaaataaaagtttcttttcctttttaacacaaacaatattttgtttgtcaaaatatactggggaaaagtgggacaatttaatgtcctctggaaaagtatgaagaaaaattaagatatatacacatgtagtatgagtattctttatgtgtttatgaatttcatttttgtaaaatagactctcacatttcttcccagataacacagataaatacaggggtttggcatgtttgttttcctttaaccattttatatttggggatgtcttttccaaaaatacagattttatttcagtgtaaagaacataggtcatttaagaaattataaacatatttcttgaggcttggtttggttctgtgcattcagtaaatgcttgttgagtgcctattataagcaagacactgcttgaatgttactttttggtggcttttttatactctttgagaaaagaggtggtgtcaggatttgtttgttgctcaacaactgattgtagaatatattaatctcttgaattatggactttccctgcatggaataatgatataaactaattttttagtgcaaaataatttataatttgcaaaatacttgcttatacttaatatcaattttagtcttttaacaattatataggcaagggagataggtttagtttacatatgagaaaattggaatttgacagcctaaatgccctgctcagaatcatggtatttagagccaggatttaccttaaattttctaattaaaaaatgtaaaggagaaatcagatgtgtggtcctaaatgtataaaatcaatttaaaacattaagaaaatttttactgttactaccttgtgtgactttggactaatttggtctttttgaatctatgaaatgttggcagcggattagaaatttttagctgaaagcctgtcattgggtgatttcaggcgcctagatttaaaacagcacttcaagtgtttcatcgcttacttatgatcaatttcaagaaatcattagcctttatttcattttatagctgtttatactttatttggttgagaaatgtttcagaacttatttaatgagaatgacatcacattttgaaacaactctagaaatggagaggaagtaatttcattaatgaccaatttttttttttttttttttttttttttgaggcagagtctcactctgtcacccaggctggagtgcagtggcacgatcttgggtcactacaagcttcgcctcccccgctccccgtttcaagcaactctcccacctcagcctcccaagtagctgggattacaggcacgcagcacaaaagcctagctaatttttgtatttttagtagagatggggtttcaccatgttggccgggctggtcttgaactcctgacctcaagtaatccacctgtcttggcctcccaaagtgctgggattatgggcgtgagccactgtgcccagccaaccaattggtttttgatcatccctgagatacaccaagtttattatgtaagtatttacttattttcttatcctcaaaatgaggtgaaagatatttttcaggtcatgtcattgaatgtttgtttgcttaagactttctcagaactgtcaagattttaaacttttaaaatatgaaattgaaaggcacaggatgggagaaaaaagagtccagtccagagtggactcttatctatggaaatttatagctgctttttgcaaacaacgcagctaagaaagcagtgttgcttttctgcttcctggctatggttgtagttccctttatttgccggaacccatggccaactatttaagagctttctgcaaggctgatgtagccaatctgacttcatcacctgggtgacccaggtgggatcagacatcttgacagttaagttgtggctcactgctaccttccagtcccaagcaggtcatttcacaaacaatatggggctgtctgtgggtcaatgaatatttattaagcccatctggaagttcacattttatctcaatatataaaaatccagattcaggaaaccaaattagactcgtctttcaaggttgtgctttttattttttcatctacttactatgcttgtacttgaaccgtctcagagttgaggcttcgaacaattctatgggacactattcatgtagagttcaatgtagatagtgccccctggaattctgcttgtagtagtcccatttataataatgtatactgcttttaataaatatgaggttggtacaaaaaggtatacaaagtatacaagaagataaggatactagctagcgatctgggtgacttatcccctcagaggtattccttctttgtcttgataggtttacaacatatgtttgcatcctctgtcgcctttaataatgaatttcaaatgtatgattatttgagctcaaagcttgaggatggccactctggagcttagattcaagttgccctgagtatacactctgatcagcagcagttacaaggttttttttgttttttttttctcgtttagatagagtcttgctctgtcacccaagctggagtgcagtggcacaatcttggctcactgcaacctctgtctcccagattcaagcgattctcctgcctcagcctcctgagtagctggtattacaggcgctctccactacgcctgactaatttttgtattttcgtagagacggggtttcaccatgttggccaagctggtctcgaactcctgacctcaagtgatccacccacctcggcctcccaaagtgctgggattacaggcatgagccaccgtgctggcctacaagtgggtttttaaggaaaaaagaaaaggcagatcctaaattgtttaacaagaatttagattaaaataaactattgattggctacacattgttctttgcatcataaattccaggaagataaggggtgaggcagcgagtctgaaacaaaatgcctttaagtaattgctcccaggcacgggtgtgggggtgtgactgaagtcccatactctggggcctgataaattttacatacctcacatagctgggtcagctcagagctatttttcttttttcacctcaatcaatatattatttagtgtaggggagtgaaaacccttctaggtttcttggctgggctgcaaattaaattgacataagacaagagaaaaaccatttttctcttgtttaattacatatgtgcaaaacaaaacaggaaagaagggtcagatttttgaagtttatatagcaccctgagatactgaacggaacctattcagcttctaaggggtgctggccacgcaagttctgggagggtaaggggaggaaatgcatggtgaataaaggctgtcttgttatgcggatagtctctcaggtaatgaaagttgtctcagagcagctgtcttccttatacaaatactttactaatgtagatttcctttatagatatacattttttttttacaaaataactgcatttcagagctactaatgtgtctgcagtttctcagaattataatcttgaaatataccaaagaagtatattttggggtggcatattctagttctctatagtcatattttagggtaatatgtcctgagtctcaatattagttttaaagttttccctacttttttattgtaactttttaataatatcaaaatgttaaaaggttagtacaatgatcatcagcatacctaggacttaactgttattaagagattgctaaatttgctttatcttgccatatatacacagttggctctccatatctatgggtcattgctcactgcaggctcaacttcccaagctcaagtgatcctcccacctcagcctcccgagttcctgggaccacaggcatgcaccaccatgcccagctaatttttacattttttttgtagagatggggtctccctatgttgtccaggctggtctcaaactccttggctcaagcagtccttctgcctcgggctcccaaagtgctctcaaaggtgaagcacaggatatgaaaaccctcaaagcacatcatccaagaggtggccaaaatcagtctggtgatggtcagtttttaggaaaggggtgcattgtgaaactggcaagctgtcatatcaaagctgcaaagagggagagtccagtagcagcctcagatgactggctaaaggtgataaaagaaagggtactctgtttcttgttttctggagctggtttctgcttactccttaggaaagaattctggctaaaggttaataaggaaggggcatactgaggcatgtccaacctcctgtcctatcgtggctggaactcagtttccgaagtttctctggtgtccctttggccaagaaggggtttgttcagtcagctgggggggcttgggcttttatttttatttctcaattatttataatacctcatacaatgtaaattctacataaatagttgcatactgtagttgtacaatatagtatgctgtattgtttagagaataatgacaagaaaaaaatctatgtgtttagtacagatgcaaccacctttttttcccctttgaatatttttcatctgaggctggttaaattcacgaatatggaacccacaaatgtgagggggccaaccgtacttgtttctcactctaaatgaaggcaaggcagaaaagctggaggcattatttatcttagccctgaaaaagtgatgtacctgtgagaaccaatcattaataagatctcaggtaaaaaacaagtttgggatggcagtaataattcagattttgagtgaaactccttaattttctctgttcttttgtgtaattccatggagtttttttcttctagtgatctttattcttaatttggaatttaagacttacataaatgaaaccatacaaaatagtgtgatcttaatgtataatagaatgagatatcactggagaaagatcagaaggagccaaacatctaggaaagtcttaaaatgggccttaaaattaagtaagatttgaatattgtagatagcatcttaggaatggcaaaaaacagagcagcaatactgtagcctggaagacttggcccgattccatttggggatagagagatgacagtcataattctctcagcacatactcaccaagctcctggttgcaggaatggccatggtgggtgagactgctgggtgaacaggcaatcaaaacatgtcatacaaatgttggcatgcgaagagttgcacaaaatgggctgaggagctcccctagcttctgattgctgctaaaacaaatcactaaaaacttagtgtcttaaaataatataaacttaccttacagttctggagctcagaagtccaaaatgggtctccctaggctaaagtgaagatgtcccggtaggaccatgttccttctgcaggctgcaggggaaaatctgtttccttgccttttctagcttctagaggctaacagcatgccttggctggtggcctcttactccttgctcaaaaccagcatcactatacctctgcttctgtcatctcttctctgactctgatcctccagtcttccacttataaggacccttgtgattatattagactcacctgtataatccaggataagctcaccacgtcaagatcagttgattagcaaacttaatcctgcccacttccttaattctcccttgaattgtaccaacatcttcacatgttctgggattaagacgtgaatatcttggtggggggagtggggagggaagcattattttgcccttgacaggctccctgaagaagagttttctagaaattacatctaggctgataccttaaagataaataggcaccagtcaggcaaagccaggctcaaagaggaagagcgtaagttataaatagaagaataccgtagcacaatattgagaggctaagactcttcacactgtggggagcgcagaagctttagttctgcagagcctggagtggctgggtgggtgtggccaaagccctggctggagagtaagaggaggctgggtttataccctgtgatgaggaggtaggtggatgatgtaatcaggtttgccttttactcaggcattttatgttatgttgagacacatttggttttctcttatccaagcattgggatccaccacaaagtgtaactcctgattggattagtaaagtggtacactggaccaaccagtcacctccttccttcagtggggaatagaacagggctgcggagaaagatttggggacgagtctttccctttgcagttcaaattaaaaaaaaataaggaggctttatcaattatcattaattagtgtaggataggaccacagagctgatgaatgaggtaaccagatttctgtctataaaatacagtgttgtgggagcagtggctcacacctgtaatcccagcactttgggaggccaaggtgggaggattgcttgagtccaggagtttgagaccagcctgggcaacatagggagaccctgtccctacaaaaaataacaaaaaattagccaggtgtggtggccccacctgtagtcccagctgcttgagtggctgaggtgggaggatcgcttgagcctgggacggtgaggctgtagtgagtcatgatagtgcactgcactccaacctgggtgaccctgcctcaaaagaaacaaaacagtgttactaagtcccttgactattctctatcattgtagaggccttgagcttcctcactcttcgttcaccaaactgctgactcactaggaattaaatcagtttagtccttctccccagcacagatagaaagcagttccttctcttcacttccactcctgggagaaagagaaggaatccatgcctgtatgaaaaccatgaagaaggccgggtgcggtggctcatgcctgtaatcccagcactttgggaggccgaggtgggcagatcacgaggtcaggagatcgagaccatcctggctaaaacagtgaaaccccgtctctactaaaaatacaaaaaattagccgggcgtggtggcgggcgcctgtagtcccagctactcgggaggctgaggggagagaatggcgtgaacccgggaggcagagattgcagtgagccgagatcgtgccactgcactccagcctgggtgacagagcgagactccatctccaaaaaaaaaaaaaaagaaaaagaaaaagaaaaccatgaagaaacagacagaaaatgttgaaatcaggagcacagcctcatgttctttcaagtaaaactgtttagtttcaagatttttaaaaggctgcctcctttcaggtgtggagctctatgtctctgtgggtttcctttggcttaattgcaaatcttaatgctgaactgagctacagggatcagtgtccacatcaagggattcttgacggaagagctgaccctggttttctaactcactttttttctttttcttttttttttttaattttattattattatacttttagggtacatgtgcacaacgtgcaggtttgttacatatgtatactcactttttaaggggccagttgtaaaagagatgaaaagtatgagtgatttaatatattatcctttgttgcatttttaaccactgctttaccttcatttgtttagagacttccttttggagccatcatctatttttaaaattttgattcttattttaattaatttattttcaggtgggatcttgctatgttgcccagggtggtttctaacttcggggctcaagaggccctcctacctcagcttcctgaatagctggaaatagctgcttgccactgcgcccagctcttttttacttcaactgacataatagttgtatatgtttatggagtacagtgtcatattttgaaacctgtgtacagtgtgtaatgatggaatcatcctcttgatgaactatatcctttgttccctgagccccttgtccttgttcttgtcctttttgtcctcagtattgggaagcacctcagttctctttcctggactgctctttaagagtccccatgaactataaatgatactcactaaattgagtacacttaaagtgctatcttagctcaagatgttataatgaaaatactgtagcctaaacaacaggaattgatttcttataaatctggaggctggacattcaagataaacatgctggccaatttggttcctgctgggagccctttgcagacagataacttgctgtgtcctcccgtggtggagagattatttcttgtgcctctttataagggcaccaaacccatttgtgagtctccaccctaattacctaattgacttcattatcttacaaaggttacctccagataacattacattggaaaattgcacttcattgtataatttgttttttggcagggacagaaacattcattccatagcaaatataatttggcaaattttgacacacacacacatatatatatatatatatatatatatatatatatatatatatatatgcctatgaagccatcattataatcaagataatgagctagtctatcaccactaaaagtttgcccctttttgtagttcttccctcatccttagacacgtactaatctgctttctggcactatagatgagtttgcattttctggaattttatataaatggaataatataatacgtgtgtgtgtatatatatatatatgtattacatgtacattttgtctggcttcttttactcagcataattattttgagattcatccatgtatcaattgttcacttatttttatcacaagagaatattccactgtatgaaagtaacataatttgtccatttccctgttggctatttgagttgtccctagtttggagctattgcgagtaaagctaccatgaacatttgtgcacaagtctttgcttgtatctacacttcagtttatcttgggtaaatacctaggagtgaaatggctgggtcagttgttggttgtatatgtaatttttaaaaaaactgtgatactgttttccaaactggttgtactgttttacattctcaccggcagtgcgcaagcctttcagttcctccagattttctccaacatttggttgttcaattttaaaatttcacccattctgatagatgtatggtagaatcacattgtgattttgacttgcattgccttaatgactaataatgttgaacatattttcatatgtttatttaccatctgtgcattgcccctgaaatgtctgtccaaatattttgttcatttattgtttccttgtcgaattttgagagttctttatgtattccagattacaagtcctttgttagatatgtgatttgaaaatatgtttcgttctgtgacttgtcttctcattctcttagtatcttttgagaaaagaaaattctaattttgatgaagttatatttatcatttttttggaggataataattttgttatcatactaagaaatttttgcctaaccaaggtcccagagagtttatgtaagatttatagctttatataaatgtctgatctgttttgatttaatttttatctgtggtgtgaggtatggatcaaggttttttgttaaaattgtgccagtaccatgtatagaattacctttgcaactttgttgtcaatctgttgaccatatgtatgtaggtttatttatggactattcttttccattgatcattttgtctattttgtcaataccacattgtcttgattacagtagctttataagaactcttgaaaacaggtaatataagtccttcaactttattctctttccaaacttgtttggctcttctatgttctttgcattttcatagacattttagaaaaatttcttcaaaaaagccttctgggatgtttacagaagaaggtgatgctcagcaaggcttgcagcagtgaatgagaatggaaatggagggaggctgggcacggtggctcacacctgtaatcccagcactttgggaggccaaggcaggtggattgcttgagcccaggagttcaagaccagcctgggaaacatggtgatacaccatttctatgaaaaatgccaaaaaaaattagccaggtgcggtggtgcatgcctgtagtcccggctactcaggaggctgaggtgggaggatggcttgagcccaggagtctgaggttgccatgagccaagatcacgccactgcactccagcctaggtgacagagtaagaccctgtctcaaaaaaaaaaaaaaagagcaaaagaaaaagacatggagggaaagacaaatgacagacttggtgccgactgaatgttttggttaaaggaggcagatgtcaagtgttaaggtggtgcctaagtttctgacctgagtaattggttaactggattggcagtagtatcttctccaaagaaggaattacagaaggaggcagcattttgatgtggaagagagagaagtccattgcttctgttgaatttcaaatgatgccagtggaaaaccacctggagatggcatgttggaagctggagacataagtttacggggaatcatccgtgtatggggtccatgagatcacgtggtggtgggagaacacaggcccaagatagaaagttgaggatcattatctttaaattatgacctggagaagaagcagctacgaatttttaggttcttgtaaacattttaaatgccttcattcaggtacggtggctcacccctgtaatcccagcactttgggaggtcagggcgggcggatcacctgaggtcaggagttcgagactagcctggccaacatggtgaaaccccatctttactaaaaatacaaaaattagccgggcctggtggggcatacctgtaatcccagcaacacgggaggctgaggcaggagaatcgctggaacctgggaggcagaggctgcagtgagctgagattacaccactgcactccagcctgggtggccgagtgagactccatctcaaataaataaatacatacatgcatacatacatacatacgtacgtacatacataccttcattcaacatgcacagtgccgcatggctctatttgatcattaaaagtattatagtacttccttcttttccctgatctccattcacactcttattttccttttcaagtctagcatctttgcaacagagtctatacattaaatacagtaaaacaagggcccctgctactcattctcatagttgagtaacgttgctccaaaatgccactatttagaaattgtcttgtattctttaattactgaatgaaagactcctggtgcaatttaagtttttattttgtgtttctctaaagggtataaaatagaaatcagaagcttaaataatataaataaaagcaggacagccttgttgagggtgaggaggggagggttgcagcgcatcaccattactgcaaagtggactttgaagtggcttgcagagaactttaatattttgaggagcacaatttgaatgctagtctaatggttttagtattttataaataaggaaaccaaggcctgagtttccttcagattaagtgatttgctgtttgtctcactgctagttagagtagaggtggaattagagctagtaactcctgattcctagtctcatgctctttttgtaggatggtgatactgccctagagaaccacttccattagtcaccaaccccactacccctcacaccactcctgtcaatactctgggttattaaaggtgaaaagaaaatggcagggaaaagaaaaaaaaaactgatgtgtttcccttgttctagatgtccaagctctgtggcttaccagactgacggcaggtgccctgccattttctgaagggatgttctatctggttgtttattagttaccatctctctctatttaagcagcttcagggccaactgactctcggtgtcacagtgggaatttgacatttctatttctcatttgtaatttagggtacgttgacacatttaatttcgtaattgtgtacttaaaaagtgagtaaactaaagtttattagtgctttatgaaaactgaaaatactcccgaagactaacattatatttggtgagcctcctaatgaggaattagaagacttgattcaatcataatattatcttactgcttatttgaatttactaagtccttggcattatactaaatgcttcattttagggatgaagaaacagttcgaaggggtgatgacatttgccaatgttttggagctaataagggctgagtttggattgagaatcctcaacattctgaattgttgggtgcttttattcctaggattatttcaggcttgatatcctgctcaatgctctatttgtatttgcctccagggaatattctctttcctctatcccagttcaacaccctcactccagtttcctcctctgtaagccattctcccaaggtttctgtgtgttcaccactcataactgaaggttgccagggtaggatggaaagggtagggcctgaggcgggagaggttgtagaagaggaaagaacatggcagtggagacttacagcagaatgaacaactttaaaactgagcattagatgacatttctgttttgaaaattgcattgatcaccctatccctggaaattctgcagtgaccacctttgttgaaaggcctagagctccctgccatctccaacatactcacgcagctcctgtacatgcactcagaagtcggtttgtgttttaaataacttctttaaaaatctcatcaccaaatgctgttgatcatagtttacctaccagtaaaatagagatgaggtccatttgacctgcttcaattgggattctctcttgaggatctaataaaaatgatggaagttgaaatgtttacaaatatatatgaaatgctacgctcgtgtaagatattactcttactgttgatgctttaattgaaatcaaatttaaaaagggactcaacagctgatcagaatctacatggaactaacaccgtgatctcccagttaagtggcaaaacatctgattttaggggtatatttctgatttagaaaatatgggagcttcttttgtgtcttttgtttaaagttatcctttgtattattagtagtagattttagcgaagatagtcaaactttcctaacaaagaagtatagcagtgctaagattttcaagataaatagtagtttctttgtttcagattatgtcactgagatttgacacactgagcaataaatgaatgtattggccagcctgtgcttttttaaacgtgattttgcaaagtaatttgtctttttaattttaggaaacagatattgatgacagatatggagatttggattccagaacagattctgatattccggaaattccaccatcctcagatagaacccctgagattctcaaaaaagctctatctggtttatcttcaaggtatgattggatgaagatgagtatatcttagtgcacaagataggctttgaggttatccttgtccatgtaataaatttggctttttgtaagttttccagccatggtattaggtggtcaaaaaggccacctaatatccgaggtatagttctatgtatttaatgtgtatccacccttaaaaccttgtgaagtataagaaaaccaaggctgagaggttaattgttgaaggctacagagctagtaagatatagacctgggattcttgccttgggctgtcagattctgaagcctgtgatctatttaccacgtcacattgctttttctggtattagaacacctaataaaactccatagtctctgttccctatttttcaaatgccagacagaaataggtatttttttcttttttcttttctttctttcattttttaaataagatggggttttaccacattgcccaggttggtcttaaactcctgggctcaagcagtctgcccactttgacctcccaaagtgctgggattacaggcgtgaaacatggcaccaggccagtattttcttttcttttaactgagtttaagattattgtctaaaactccacaatccattaccattttatatttgtgcaacatttaaaaatgtgtgatgaccacaaaatttcagctaattatattacccttcattgtatactttagtaatatgaattataaaatttataaaagcaaagtaaacctaagcttttgtccagattaatgtatgaaatgttacatattggtgtagaaagaacaatgtttccccaactttttgacactatgacacagtaagaaatacattgtataccacattccaagacacacaaatgtatattttaactgctgcaaaaatgttatgaaacaattcttcccattactgtgtaataccctctgatttcttttgtatttgatgctgttctatgttattgaacaaaaaatgctacatgtaacttattcaatggattttactacccttgggtcatagcctgcgatctgaaaaccactagtttagtcgtatctagtaaatgtaatatgaatttttctttttttttttactttgtaagggataaccatattagaatatattggttaaaagcaacattttcatattttttaaccaatagaacatatctttgatctgctatgaaaagcatgattattttaatagttcttgttcccagttgttttcatgacctaattcccagatataactttgcattaaaatctcatcaagtctatctcagacctgaaattttgtgtagtcgatgttctgtaagaatgatgccagatttgtgtgtgtcattcataataagatcttccttaatcatgaagttgtttttttctgatataaagtaacaatagcaaatactagcagctaatatttatttagcatttactatgtactagtattgtttcaggcactttatatgtattgactaatattctcatggcagccttgtaacacaggtatataaatgtggaaacgtaggcagatattatatatcaagggtcatgtagctagtaagttatggacccacattctgaacctaggtactgtggcttcaatgcctgtattcttatctatgctatttatgagtgaattggttttagaaaatgaacaatagataatatagtggtttcaatcttctcgagaaacttttctacaaagattacatgaatgttttacatgtaatctgttttatacatttttatcctgtttttagtctaatattgaaaacagactgtcttgcaaagacttagaatttgtagatacataggattaaaaatagtaattacataagaaatgtacattacttgcagaaaaaaaaatcctgtaatcctcctaccaagacattaatatttagaatacttcagtgtttaccctttgaggcttttttcttgtgcagtgtgtgtgtgtgtgtgtgtgtgtgtatgtgtgtgtatgtatggatgtgtgtaaagcaaaaatgagattgtactgttttctaccttactgttttaattttcattccatggtattattaggaacaacatttcatgcaggatcctaaatatatttcagaaacatttttaatgtctgtatattttgctgcatggctatggtctagtttatccaactgaccacctattgctgggcatttagtatattactaaatgttcacaattaaaaatacctctacattaaacatttttctttgtagtaactttattttaacatccattaattatttccttaggataaagtcctaaaagggaaatcccttggtcaagttttatgcccttcccttactttttttttaaaacagggtttcactctgttgcctagactggagtgcagtggtgcagtctcaactcaccacaacctctacctctcaggctcaagcaatcctcccacctcagccacccaggtaactgggactacaggcatgagccaacatgcctggctaatttttgtattttttatagagacaggattttgccttggcttgtggtcctttatttacctctgactagatttgcgacctagcccagttttctaatccatccattaatccacaaacagttatatctgtacaactacatggggccttttagccatagcatttttgactctacactcatttttagttctgcctcatgctcatgctctcatgagaagtttatgtctacatagtttgttaaacaatagagggaaataaagttgaatgaatgcaatttgactaccttatgaagaaactcataagctggaaaaaaatgtatgttgttggtatgttggtattttagatcctgtgtgtagaaatgacatgataaaaggaatatttgaaaagagtatttgttggaagtatttaaactatattggagagtggttgaaagcaaggaatgtaatcttttttttttttaagagacagtatcttgctctgccacccaggctggagtgcagtggcacaatcatggctcactgcagccttgacctcctgggctcaagtgttcctcccacctcagcccccaacatgccccgcctcctctccccccactccccccgcccctcagtatcggggaccacaggtgagtaccaccacgcgcagctaagttttgcatgttttgtagagctgggtttttaccgtgttgcccaggctggtctcaaactcctgggctgaagcaattctataccttatgaaggcagctaatatttctgttctaagaagggaatgagggctggacatggtggctcacacctgaaatcccagcactttgggaggccaaggcaggaggatcacttgagcccaggagttagagaccagcctgggcaagatagtaagaccctgtctctatttttttttaaaaaaaaggagtgaggacttgtgcttagaatacactgcatatatgttactagactttaagttgaatcaaaatctcttgtaacataatttaaatgctaccagttgaattaataaaaatcagaaaagtcctaaagaaaaacagcgacaattctaaatatagaagtcatcatttgtatataggagcattcagaaattctggatttttcatacagagctgccaacagtttatatgacatggtaacacaaggagtgattatttgtatggcacaatggggatgaagtgtgaggcttgtggcggtggtggggtgcggtcgggcatgccaggcccttacagcgagggttgagggagaccagttctcagcatggcaaggaccagctggtgtaccagcaggaaagctctgctctgaggagcaaagaaaggcccaaggataaagaaatactttgttttttggagacggagtctcgctcagtcgcccaggctggagtgcagtggcgcgatcttggctcactgaaagctccgcctcccgggttcacgccattctcctgcctcagcctcccaagtagctgggactacaggcgcccaccactatgcccggctaattgttttgtatttttagtagagacggggtttcaccgtgttagccaggatggtctcgatctcctgacctcgtgatctgcccacctcggcctcccaaagtgctgagattacaggcgtgagccaccacgcccggccaaggaaatacttttactaaaggctttgtccctaatcaaagaaagcagtcaatacactttgaacaacagaagtgtccttccatctgtctttatcctcagtggctgacctcttaggtaactggcacctcactccttcatttcactgaaatcactgttctttccagttttagttcggtattatctttcattacttattctcattggcagtccatgctgtctatatcatattcttaaaatcatgactgtattcatctgccatcctaattgggcatcatctcttttgagggcttttgtacctggctcgttcttcccctccatgtggtccctggtgggatgcctgactttcacatccaccctgaccacctaacgtcctaacctcacggtttattccccactcacatttaacaaaaattattttctttctggccgggcgtggtggctcacacctgtaatcccagcactttgggaggccgaggcaagcagatcattaggtcaggagatcgagaccatcttggctaacacagtgaaaccccgtctctactaaaaatacaaaacaattagccgggtgtggtggcgggcacctgtggtcccagctactcgggaggctgaggcaggagaatggcgtgaacccaggaggtggagctttcagtgagccgagatcacgccactgcactccagcctggggtgcgacagagcgagactccgtctcaaaaaaaaaaaaaaaaaaaagaaaagaaaaattattttctttcttggctaacataactttaaaagttaatttatctcccagtgtgtgaatgaatgctgtttgttttttgtttttgttgtttgttatataaagtgaagtagtagaatcttatagttaaggaaaattcataaatctggcaaatcaatactgaaaccacacaaaaaaccttaagaacacgttaaatactaactttacattttctttgtaggtggaaaaactggtggatacgtggaattctcactctaactatgatctcgttgtttttcctgatcatctatatgggatccttcatgctgatgcttcttgtaagtttttgacttttccctgagtgtctcttgctttgtttttcaacatttatataggattgaagtaatttgagcatatcataaaaaagaagctaattcaacactcagtcacagaatatttagttcctttaagtgtcttttatttcatgatatgatctaacttaatcttttctgtttgcaaaatgactattcagtgtgttcattcagcagagaccaagtttgtataacaggtacatatctatgtgtctgacattgtgccaagcatattttatcaaagatatgacatgagcctgggcaaaaaaacacaagcctgagacctcgtctctacagaaagttttaaaaaataagcttggagtagtggttcacgcctatagtcccagctactggggaggctgaggtgggggatcacttgagcctgggaggttgatgctgctgtgagctgtggttgtgctactgcactgcagcctgggcaacacagaccatctcaaaaaaaaaaaatgacagaaatacacacacatataacatcaacatatgactattagctagatccctgatttcaaggaactcagtgtaataggaaaaacatacaagtaaccatatgaataaatagcatgataaataagcgagataagttctatgatagaacatgttaggagtgcatggtagaaaagcacctaatccagtctgagggagggatgaggaggggcttccagaagagacagtgccgaagccgagtcctgaatactggacagaggaaggaattccaaagtggagacatcatgagcggggcatggaggtagtgagaggatgcggtccattggaagatctgcaagttgcacatgtagagggtgtctatatagggcactggagaggcaaggaaaaaccattctgggagttttggattttggtgtgtgtgggaagctcagtaagtcaggaagccaaacaagtatttaaacccttcattcattcgtgtaacaaacggttccaagatgcctgctatatgccaggcattacgttagttctagggatgatacagtggtactgagaaaaatgtacctgtctctgccctcatggagcatactatctgcactttaaagagctgattatgtatttacagtgagatgccacctgatgacattttggtcagtgatagacaactatacgacagaggtcctataagattataatggagccaaaaaattcctgttgcctcatgattttattccagttgccaacggtattcagtaaagtaacatgttgtacaaatttatagcctaggaccaataggctataccatatagactagatgtataagaggccataccatctaggttttgtaagtatactctatgatgttggcacaacaacgaaattgcctaacgatgcatttctcagaacatacccccttgttaagcaacacatgactatatataattacaaactacaataagcatttgagaaaaagaataatactaagagagcaaagacggagctgggagactttccagaggcacagtgccaagcacgtgggctgcaatctgaaggttgagtgggaatcaacaaggtaaaggatggagtcttggggaggaccatcacaggcagaggatttctgtgggcaaaagcccagatatttaaagcatgaaacatttgaagcccacaagtgttggaaccgaggagaaatgcatttgttcaatgcattcatcaagcacttaggcagtgctgagcatggtttgacagcacacagtgagagcctgccctccggggtgccctgtggccttctttattggtattatcattgttattactttttctcattccttttcagttaatccaggttcttcttatgtactcatctccttcatctctgatttctcttgcccacttagaaatgtgtttatccattttgccaatctccctccatattcaattctattcatagctcataagcttatgagctatatgatatggttttccttttattttataaaagaataagttttgatgtgaaattagacatgatgaaaaaaaattccatcagctcttgaagccacttaaagtggcttttataagcacctcaaagcctctttcacttctctttttgtcctctcattaatttttcacttccttggggaaatcaagtaatgaaaatgaataagaagttaatttctttttctgctaatttgctaagatcttaaagtgctttttctcacaaaggaaaaatggataataaataggatagacttaatgtgagggcagaggaagcggagcttgaaagccaagtgggcaggcgtgggaaattgtctgcatttgattccaggaagaggcccccagctcccagtcttctgtcgctgaatgtgccaagggctaaaatgatcaccattggccctgggacttgggcatttaagaagcaagtgtgtgcagagcacttttcaatgctaggtggtgagtgggcaggcttgaggaagaagggaccaagtgagagcaaggagttccacaagtctttgtgggtgaagggacctttgagtatgattttgggcctttgctcacggtgcttcctcggtggcagaaaaaggtgctttttccttgagcacagggctgaaaaataattagagatcagattctggagggccttgctatgtggagaagtttgggttttatttgggaagcagtaaggagaagtattttgggagaatttatttggaattaagaattaagaagaatttatttgggaaaggtaaggagtaagaagaaaatgttgatctaagatatcagaaaccaccagtatcctagatacagtgacttcggcaggtttggtgggttcccctgtgatttacatttttctccaaactgaactgttgagtataataactagggcaagaatttgtggataaaaactattttctaaccactctttaagacaaaattcaagacagttttaaagacatgcatgcatacatttggattctgattttttaagagaaccataagtgtgcctacggtacttgagtttttttgtttatttttttctactatgaaaggaaaatatgatcttattactagttatttgcttcaattggtgagtttaattaaagaagaaaataagagtattaaagatctggccaggtgcggtggctgacgcctgtaatctcagcaccttgggaggccgaggcaggtagatcatttgaggtcagtttgagaccagcctggccaaaatggtgaaacctcgtctcttttaaaaatacaaaaattagccgggtggtagaggcgtgtgcctgtaatctgagctacttgggaggctgaggcaggagaatcgcttgatcctgggaggtggaggttgcagtgagctgagatcacaccacggcactccagtctgggtgacagagtgagatcctgtctcaaaaaaaaaaaaaaaaaaagaatattaaagatctaagtaaagtaggtttgaactgttattggttatttaagtttattacatacacatacatgcatagatatatatatatatattatgtttttatgatatttgtgttaagagaatatggatgattcacacatatagttggtactcaattgatattactttatgtgttttaaaaccttgtttctattcctattcttaactagatcatttatattttgagaaggacatgttgtatctagcttgcagttgccttataatgtcagcactcaaaaatgactaattcaatatagttttattaaaaacttctaggaggtcgggcacagtggctcacgcctgtaatctcagcactttgggagggtaaggcgggcagattgcttgaggtcagaagttcaagaccagcctggccaacatggtgaaaccctgtctctactcaaaatacaaaaaattagctggatgtggtggcgcacacctgtagtcctagctactcaggtggctgaggcaagagaatcacttgaacccaagaggcagaggtttcagtgagccgagatcgcgccactgcactccagcctgggcgacagagtgagactttgtctcaaaaaacaaacaaacaaaacttctaggaaattacaggtactattttaatatggaatgcatacccatgttccttaaaaggccttctatttgtagtttttaaattgtattcacagcttagaatcatactttctaagtgatggagttactaaagcatgttttgatttaaaggcagatgtgaacatatagaagatattgaaagaggttttttccccccctgccttcttggaaactgttgtcattaacttttaattcgtgctatgtagtttacttttaaatagtgtgtttactttttcctattatgagagttgtatacgtgtgatcaaattactttggaaaatagataattaaaaataatcattccaaccctattgttaaccaccaaaatgcagttagtagtgttacattttatttcatcactttttgcttaatttatatgtttttaaaactgtggtcataataataatgtgactaacattgtgcatcctgctttttaagctaaatatcacatcaaaaattttgtggccaggtgcggtggcacacacctgtagtctcagctattcgagaggctgaggcaggaggatcacttgagccctgaaattccagtctgagtccagcctggataatatggcacaaccctatctctaaaaaaaccaaacttttaaaaaaaagttttgtgttgttctgtggtctttataatcattagctttactagattgtctgcttgatggaatgtagttcatcatggagttattcacttacagtgaatgaatatctgaattcattcagtgcatcatttaaagttattcaaatcattgtgttatttgtagacattcaggttatgttcttttttttattgtgaataacactatcatgaacatattagaacataaatatgctctaactttatatgtgggagtattttcttagaaaaaatttgcaaagtgaaaatagacacttatttgaataacccataggtactcaatatagttcatactcaaaatgaccagatctgaacttctagtccatacctcggccatccagagtaaatctgttgtcaaagttaaataacaatacacagacaaatctctatgcaaagcattttatttgggaatgtatatatattttttaaaaaaacaaaattgcacttcagagcatatacccagaccagggtggtctttgatatgtctaaagaataaagagaaggttgggagttttattaaagagagaaatgctacatattgttttgaaagaaagcccattagcactagtgcacttttggggagttggcaggctctgactggtgagtgacagtggtggcaggtaaaattagtcttagagtcatggcacattgttgtttcagcagccaccaagtaaaactggtctgacggtatggccagctgtttcagaagctgggctttggataattcgtggagcaggtgctgtgtgccctgagtgctttttccgcttggcccctcaactctgatcttagttgaatatgacagttgacccaatttgtataattctttcatattgtctactttcccaagccttccttggtgttattttgtgttcccttttctcccttagcccctcaatttcctcacgcaccatgtctagtcagttctaccccctatacttctctcctgtcttcttctctactccgctaccacttcacctggatagtgaagtggcatcttgcctcctgactgccttgactcttgtcaccgccccagcccactgtttccaccttattctcccaaactctcatgtccagtcatgttgcttcaactcctcggtgcactgcttcctgctgtttcctaggattccaggaccaggctcatctctctctccttcttacccccacctttgtcttccagcaactccaccctcctagtagttcccttaatacgccccattccctctacaggtggtgactctgcagatcctcctcctctggctctgccgttgcccaccccctccccctgccacaggtgtgtctgcctctacacacgtccatttgcctatttcacatgggttgtagtcgtgtttcctccctgagagactgtacctctctgtgaacagatgccctatgttatttctataagtcctcagtaactagtaaagagtagacacttaaatactgacttgtttttaaggttcttgaaacattaattgggccaacagagtcctatgagtgtacattgctaccagtgttgatggtgtggagtattaatttctgtgtaatcctccagtcctggaagatacacatatagttgaaggatttcaacactactatttggaaccttttgttttctgttttcctagaagttccatattaattgtccttgcaagctatagttgatgatcatataaatataatgcgtgttattaaaaatacttttgttctctcctctcagtaaaagaaatacaatttatagtgccagtggatgtaccctagcaaatatgttcatagaaattacatcagtatgatattttaaaagccctttggatctgactaactttgctttaccgttttatcttaatactaaacattgtctccgttctgtatttttgttagaaatgacttgatattatatacaaaggttatttgaagaaggacacttagatttcctcctgtctttataacacatttatgacttttgcctacaagtactgtttatggtttgacgtacttttctttatcatgtggctggaaagacacatttactttttaaagtatgtgattggacacgtaatcagtataatgggaaaaaataacttaaaaataccctgaatggtaggttttggaaaactaacttgtggaaatcttaaaaagaaatcccggaatatatcctctgacagagtttggtaagctttttctgttaaaggaccagatagtaatattttaggctttaaggagctgcatatgtttcagtcacataatattttatttttaaataactctttaaaaaatataaaaatccattcttagctcaaggacagtataaaaacaagcccttggggtgtgttctctagacgctgaaaagctagtctgctgtattcacaaagatttttacctcttaattcatgataataagtgttcaacttgccatttgctctttgagtcttggaatcgacaggtcaagcaccgggtgtgatgctacatcttgagaaattaccttcacccaggttgctgaatgcagcagtttgaaggactacaaaatagaacatcaaaaagggatttataaatctaaacccgtttaataggtgtgcaatcaggacactgtgtaaacagaaatgcataaactcagttgactggccaaagtggctgcaaatgtggaaggttgcttatactttgctaaggtagcccagcttagattgagcagccagtagctggctatgggagagttgacacaactgggaggatgaaaaggccattccagggtgactggctagaaagtgttctaactatttgtcctgacagtatctttattatttgcaggtataacaatgcatggttacaaataaatatgtgcaagcaaactttcatatatgattttcttagggtatctcaagaaacataatggacaggttggacaaaaagattctccatcttgacaaggacaatctcaagaatgaagtagtaatgagggataaatcctagtcaactgcggccaaccagactatatccctcaaactttaaactccattgccattccccaccccaggaaggatcttccaagcctttttgagtaaaacattattttgcctacccctttgagttatcacttgattttagagacatggaatattgcattttttactgacatttagcataattaaacattggtagattaagattttttaaatacatatgacaaactgctttattgaatgattaagcacaaatgtaaacattgagaaatgtatgttaatgttttctcttggtttcaggttctgggcatccaagtgaaatgcttccatgaaattatcactataggttatagagtctatcattcttatgatctaccatggtttagaacactaagttggtaagtaagcttgaaactatttcagatatgaaaagttaatttctgaagtttgtaaaggaagcgtcttgatcagtcagtatccactcaatttaccctatagattgattctagagaaagataaataaaaataatgtaattgaattttgaaaagatcacctttgtctttcctactccaatacaacttttttcagatctcatattttagtctttgtagagatatctaatatgtgaatatatacaccattcttgtcctttttttaataaaaaactaaacattgtattggaaacatttttgtatcctttacaataataattttagcaaaatatttacatataatcttttccttcattttccttcatttcctctcagttgacatgataacatacaacatattgtatatatacaaatgcacataaagttagtaacaaaatcaccataatgatattaacatttaaaattttatatcttttaaaacttttcatatataaatcattgctctcagaaccttgactaggaaacatgataacattatagttcatatttaacccaagtggccatcctttttaatatagttgataaatatcaaccagggagtcagtgtctttttaaaacagatggggtttagaatagtcaaaaagaagtgtcttgatttcggtgatagctgatttttccttctagcaggtttcttcacgagtggcaaagtatacaggaaatgttagatagataaagtaattggagaataattaaatgtaaaaccatgcagtattgattctaagtattattaagaagagaagataaataaggatgggctccagtgattgtagaaggtgtcaaacaagaggtaaaagataaactggtatttgaaatgaagacaagttttggataaagaagagttttctagttggggatgtagcacccatcagtttctagatgtgggacagatgtacttatactaccgttgatgagacattcctggcccttctgagcagatggtattgattagcggacagtgggtaaatagttggattggtagaccaggttaggccttgattgccttacagaggaagcatccctgctcatctggagtccactaggagcattagaagaggggagataccagtgtgtgcagggcagtggggagacaggttgaattacctcttctttctttccctcctaatcttcctgaggacaggtggggatttgtcttaggacttctactattaaaaagcattagagctgtgagtagttacgagttaattttcattatgaacttaatccctcaatatatacacccacacattatacatacatacaaagtattaaaatcatacacacacacaaacatacacacattatacatacacacaaagtattaaatttatacacacacacacacacacacacacacacacacacacacacacactgctcccgcctcccaagggtgagggattgtgtgtgtgtagtattttctacattgtttcctaattatctctggcattagattttcagctaaataaaggtatgaactatgtttggtaaatttttgctaatcaataaatttgaaattaagtttaaaacaggaaaatagcattttggtaaaatatatcttgaattggtcttctgaactttgttttgatctttgtgtcatcagaatgtagaaaataattttgttgagtttgaggggaaggaaagcttcaaatatagaaaagctaattgtttttaaattataggtactttctattgtgtgtaaactactttttctatggagagactgtagctgattattttgctacatttgttcaaagagaagaacaacttcagttcctcattcgctaccatagatttatatcatttgccctctatctggcaggtaagttaaggaatattctgtattgatatatagttaacatattttccatgtttatttttatttctgttattttaattagtaattttttggttaaattttattccagcctctctttttcattgtttctcgtgtataaagctatttctttcatcatgttcttaaatagcaattactcccttatagtgggtttaaaaagtgcttgttaagaatcactccaggccgggtgcggtggctcactcctgtaatcccagcactttggaaggctgaggcaggtggaacatctgaagtcgggagtttgagaccagcctgaccaacatgaagaaagtccgtctctactaaaaatacagaattagacgggcatagtggcacatgcctataatttcagctactcaggaggctgaggcaggagaatcgcttgaacctgggaggcagaggttgccgtgagctgagatcacgccattgcactccagcctgggcaaaactcttatctaaaaaaaaaaaaaaaaaagaaagaatcactccatatgtttgaaaattttctttgcaaattgtagtaaaaaaacttttaagtaaataaaaattattaaccaaatttaatttatgaaaaaactttcacatatatattgctttatttgtccctaggaaatagagctttttcatgtagaactaatcagggtaattagttgttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttagacatagtttataatatatgcaactgtttatagtatgctatgccacatgtttttgtaatttttaaattaaaaattagattcttaagataaagttagaatttacagatatcttttctatgaaattttacagatcataaaaacccctaagcaattgatttttttaaatgtgctttttaaaagccagattgctcatttgaattctggacctaccaattactggttgagtaaacagtgagatatttgggctgggcgtggtggctcatgcctgtaatcccagcactttgggaggccaaggtgcacggatcacctgagtttgggagttcgagaccagcctgaccaacatggagaaaccccgtctctactaaaaatacagaattagccgggcatggtggtgcatgcttgtaatcccagctacttaggaggttgaggcgggagaatcgcttgaacccgggaggcggaggttgcggtgagccgagatcacaccattgcactccagcctgggcaacaagagggaacctccatctcaaaaagcaaacaaacaaacaaaaatgagatatttaattaatttctctgtgcttcagtttctttgtaaagcacttagaatagtacctggcactacttaaattttttttattgttattttcactttaaaagaaggacatgaagtttgtttgtgagttttcaccttagctgttactagttattgttttagctcctaggagtttcccaataaatgaatttttctcctggtacaatcttagaaactgggtaattcttttccatttctctttaaaaatatacagagtatgtggggaagcatgtccagtcctgtagaagtatgctatttcattaaatagttatgatgttcttcttggtgcccctcagctccttcagttcctaggccttctaattctaaaaagccagaaagtgaaatacaatctgaaatggtaatgggaattttcagagaacttgtttttatgtaatgaggaggaatacattttcgaataattttccaccttttacattcaggttttttgttactttttaaaattttaaatttcattttattttcccagagattaggtctccccatgtggcccaggctggtctcgaactcctgggctcaagggatccttccgccttggcctcccaaagtgctgggattacaggcacaagccactgcacccagcctttcattcaggtttattgttcagttcagctttccaaatttgttccttcatttaaaaaaacttttcactgctatatctatagaaagtacattcctagaaataggtattgaaaaatttctactcttttactggtactcatatgatggtagttggtccattttaaattctgaccagttggaaggattatgatcatggagagattatgattgttatcagctaagaagaccatactaaaattttggagagtaaaacacttgactctgattctgtgtttatcaaagcacatttgtgcattttcttggtattctttgtagaaactttgagtattttctctcatttaccaaaccagtaagcttgatttattttgttaaaggtaaggtagattctggaatggattctttttttattatgggagagaagaatgtagtaccttctcagtttatatttaaggtaacaagacttctggcattttgagttttgatgataataccaacagtcaaagagtctatggtatcttctgttattgaacccaacacttttgtttcatgtgattattcttgtaattatttaaaacaactgcgggccaggtgcggtggctcacacctgtaatcccagcactttgggaggctgaggcaggtggatcccttgaggtcaggagtttgagaccagcctggccaacatggcgaaacccgatctctactaaaaatacaaaaaaaaattagccgggtgcggtggcaggtgcctgtaatcccagctatctgggaggctgaggcaagagaatcgctgtaacctgggaggcagaagctgcagtgagctgaaatcatgccgctgcactccagcctgggcgacagagcgagactccatctcaaaataataataataataataaaagaacaattgtggttaattaaaacataaatcatttctatcattaatatctgcacattagttttcaaactgaatttcaaaagaattatgatgtaaacagcaaccctgcaccccaccgctttgagagtttttccttttctgtaagtaataggcctgtttcttagtttactttaggcattatctattcacttcctgttataacctactttacttcttcatattcagtttttttatagtaatagttagcattaagtaggtacctaaaatatcacttcctgtagagccaaatagtatctatgattacatttccttcttttacaactttttgtttttcccgaacttgaggaactgcctcaccttctctttcccatatttgctaatttcagtgtagaaatccttaatttttcctttaggtttgacccatgtctgttggtagtattttcagatgtttacacaagtcagatagtatatcaattgccttttttcatggagacttctgtgccagagacctctgcattcctgttcctgtgtgagctggctgcatatgggcccactgctgagctgtcctcatgatttgagccggtttcttccatcccagtcttccatctcttagttaacaccctcactttgctgaagcatggcctgctgtagtttcttatgaaatgatgtgtagaaggtagttgtcttatgtttgtgcatttctaaagatatctttagtctattcttacagctgattgctttggctagggctcacacttattgttggacttttacttaataatccaggtcagaagcctaggcctcagtcttgccttccaccgggccctttctccttagtttctgtagaaaatacgtttaggcacctgtaatttctcaggcctactaacagttttctatctgttttctagcttccaaattttgtagacatgtttcttcttttctccttcacatttcttcagttttctctgttcttgtggggcttccccttaatttattttaatgttattttgcagggataccaggatggaatacaaactatcatttaaaaacaaaaagccttaactagttttatttttcccttggcttagaacaatttgttatttttgctcacagtcctgcggattggcgggcttaacttagccgttctaaccccaggcctctcacgtggttgccatgagacagaggcgggtgctcatgtcttgagtgggctggacatcaaagatggctccttttcatgactgcagttcgtgccgcttgctgacttgggcactgacctgtggcccctccatgtggcttggatgggacaggcagcccgggttctgaatggggagcatgccaggagccaggtgtttcaagaggcctaaactagttttttttgctgggcgcagtggctcacacctataatcccagcactttgagaggccgaggcaggcggatcacaaggtcaggaaatcgagaccatcctggctaacacggtggaaccccgtctctactaaaaatacaaaaaaaaattagctgggcgtggtggtgggcgcctatagtcccagctacttgggaggctgaggcgggagaatggcatgaacctgggtggcggaacttgcagtgagccaagatcctgccactgcactccagcctgggagacagagcaagactctgtctcaaaaaaaaaaaaacaaacaaaaaaaaaaaaactagtttttttttttaaatgaaaatatatgcccatgataaaaatttagactagaaaggagtattccatgaaatcctcctccacctcagtgccttacttacgatatctggaggcttactactgttattccagaaattgtctgagtattcaagcttttatgtttatatcccccctccctttttcttatgcaagtaagagtatctcttctgtaccatttttccacttcatatattaatagcttatagatggatttatattggcacatctacatctatcattgtatccatatctgcagttacatctatattgatatacagcaatagctgagaggtagaatgtcagcatataaggtgattactgttttcccctttggttttgctataatttatgcttgagaataacatctcaattgagtgtggaccgatagtgtagttcattttctttgttgtttctttttatatattttgtctttcatagcctcctaaccagcccctttttagtaattctttgttccatatatgactttttggactctacttctataaaatacaatcaatgttgtgtcttttttttttgaaacacagtctcactccattgcccaggctggagtgcagtggcgcgatctcggctcatggcaacctctgcctcctgggttcaggtgattctcatgcctcagcctcccaagtagctgggactacaggcatgcgctactgtgcctggctaatttttgtatttttagtagagatggagtttcactatgttgctcaggctggtgtctaactcctgagatcaagtgatcctcctgccttgatctccaaaagtgctgggattatgggcatgagccaccatgtctggcctggtatttcttcatttttctaaccgtatacttatttctgccatagacatgttttaccatttcttattttacactcttagaatcacagaaacttactgaaagtcatcaaagtcattcttagagcaaacatttcagtgttttccaaaagctagatactgtgaatgatgttgaggatataaagggagatgaagtgattgtgtgctttccagggtcttgaaattggtaagatgtgagtcttctagttcattgctgaaatgtgaacaagtcctgtcaggagcatgaagaagaggaaggaaggccatggaaggcctttgagaagagatgacaggtttcatgaaaaggaaagagcaagcaggcagttgccaggtatcgtatagtagaaaagtccattccaggcggaggaacagctgtgcaggcatgagaatgagaaaggattgcatgttttgggttcatggaggcattgaagatagggaaggtaggtaggagccacatcttaagaaaatctgtatgtcatgggaaaggtttggactttatatctgggaaaacattggaggattttaagctaagaaatgatataaccagatttgtaattaaatgaagtaggttgggagacatgatcaggcagactagataggaagttactactgtaatccacactaaatgtagtaatgacctaaactcttctggtttgtagttaatactaaatgagtaataagttagaaaataggccgggcgcggtggctcatgcctgtaatcctagcactttgggaggctgaggtgggtggatcacgtgaggtcaagagttcaagaccagcctgaccaaaatggagaaaccccatctctactaaaaatacaaaattagccgggcgtggtggtgcatgcctgtaatcccagctactcgggaggctgacgcaggggaatcccttgaacccaggaggtggaggttgcggtgagccgagatcatgccattccactccagcctgggcaacaagagcgaaactccatttcaaaaaaaacaaacaaacaaacaaaaaaaacatagaaaataaaaataccacaggctgatcgtagaacccaactgctattttatgacagtctatgaaaagttgtttatatatcacaagttattggcttaaaatgcacttctttgttgcaataattgcatattcacatgcagttgtaagaaataatagatctttttacactttgctcagttatcaccaatgatagtattttgcaaaattatagtacatcacaccaggatattgacatcattacagtcacacaaatgtactttttgtttgttattttgagacaggatctcactattttcccaggctggtcttgaattcctggactcaacttacccttctgcctcagactccttggtagctgggattacaggcgtgtattaccacgcccagctctacagatatactttaaaaatgcaacctcatagtaagctaggagctactcagttaaatgatgtaacttccagtataaaacaggcatagaatactatatgtctattatcattttaagcgttgcctaaaaatggctcggttagaccaaaagcacccatggtgtacctctcttgtttatttaattcccagagcgcagtgcaggcctggcattgagggtccgactatgtatttgttggataaacgattaagaggctgagaacatgcacatccacacacagtgcttcttaatgatattttcttagtatcagtgttttgtttgctgagtcttgaggccttagtggctactcttgaagtgcttagcaacatttgtgagcttagtctagcaaatggagttagactttgaaacaggactatggaaatagaaagtatgctaacattgagatatttgtacctttctttcaaattatgttgtagaaatctttggaatccaagtctttctgttaaacaatattccaagtgccctgtgaaaattttagttctattacagtggtcaaatgacttcagaaaatgtatgtcttaccagatttaaaaagcagagacagttcaaattacttcattgacattgaattttatttaaataaaatgtaggtatctccaattctgaccccctcatggaggtccatgaaattaaatgacttgtttaatattatacaaaatgtctcactgactaggacctagaagtcatattgacatttagataattttgttgcaaaatgagtttgactgatagcagagaaaatcagggagactaaaaataataaaacaaacgttttctctagagtctagatatatattaaaaagaactcatcaacttggtgatttggaattggggctctttagaaaccagagcagtcatgcaattatatggttagcagtgatgtgtaaacagacttaaggtgtttgacccttaatatcatcaccttacatttctttatccaactatagtgatgtgcatattatatttaataaattattttttgcttgtatttgtgcatgcatagctattttgatttctttaaagttcttatggagataatatgacttgaatataatgctttgagtccaagaaaattgatggacatataaaactaagttatagccaaaattaatgcataattaagatgttttccccaaacatcctgagtatcttttatatcagaggatattaatgaaatctttagaaaagtgtcacaaataattcacaaaggactgtatctccaaaactacttaaaatttctgaattaaagactgctaaacactatacacatgctagtattggttctaaaccttagactaaccattcagattaatagaaaactttttaaaatgttaactaatatgatgattggtttgtatggtaatctccacgatgcatattcatttaaaactttttcagaacaactcagttatagcctggtgtctgaataaaggcacacaatgcagtgtgattttgaatttatttaatttgatgctagaaagttttgatggtttaggcaagtataatgaagaatataaccaagcggaagaatgggggatgagtcagaagctttagtattcaatcttgggcccatcctactgtctgctttttgaattaagggctatatgtgtttactaaattttgactaatcatcaatggtaaattttaaaaacaactttattttttctttgtttttggtgtcttcaacaagagcaagagctcctgaatggcagtgcctatcttattcatttttgcatcttgtttctggcatatcgaaggtgcttgataaatatttttttatctatttttctgaaattccctctgtctcatctattgggcttttcggtgtcttgtgttttttcctttacttttcctgacccccttaaaaatcttcatcctcttcttcttcctttttaaagaaatttttaaagagatggtgacttgctttgtggtccaggctggagtatagtagcttgatcatagctcactgcagcctcaaactcctgggctcaagtgatcctccagcctcagcctttcaagtagctgggactgcaggtgtgtgctgtcctgctcagctaatttttacttttatttcatagagacaggatcctgctgtgttgcacaggctggtcttgaactcatggcctcaagcagtcctccttccttggcctcccaaggtgttgggattacaggcatgggacactgcacctggattctcttgttatttttgaatacacctctctttagtttgttgggtaactggttctgcttaatgactggagaactctttgatgctgggcaacgagatgtacgtatctttgtattgagaacaccaggcacaatactatgtagataaatgatgataagtataacttttatataaagaactatatattaggaggccttttcagtacttttatttatactactacaacacattctgtgattttaatttagaaatagttatacaagcattctttgttaatcagggaaaaaacctatggatccaattgtacaaaaagtgaccgtttccacagatttattaacatataaatgtatttttaagtatttaaacataaaatgttaatatatccatatagttgtgaatgagaaagattaagttcatatgtttctcttttacaatgtttttctttaaaaaataatacacagttggccctcctatatccatgggttttgcatctctggagtcaaccaactgtggattgaaaatactctgaaaaaaaaaaaaaaaccacaatggatggttgtgtctttattgaacatgtataggcttgtttcttgtcattatcccctgaaaaatacagtctaacaattatttatatagaatttacattgtattaggaattataagtaatctagaaatgatttaagatacacaggaggatgtaagtaggttatatgcaaatactataccattttatataagggacttgagcatccatggatttttgtcctttggggatcctgcaaccaatcacccagggatactgagagatgactatatttagcctcagctatgctaggaaaacactttatacctcccccttcctctaagtcagagaactgtattatcttactgtatctaggagtcagacaattgtatcccataggtgaaattggattatgtaaacgtgagttgccaaggttgtcctggataaaatgtccattaggaaaatgttaaatgattctactggtaattgtgtttgaagaaatgtaagtaagggtgaatggtgttatcatttcaagaaagagaaaatcatgtattttggagtagtatttgtgagtagataattcatagttaatgatattgagaagttcccaaggctgtgctgggagagtcaaggggtctgtttggacagaaaacatggtttctgtcttgtgtctctgctttgccccttacccattggctttgaaccgagtccagtccacgtttgcctttaaccacggatcagtggcacaaaaacagcatagaaattatgttattacttgagcttcaagataagtctacctgctgtagaagaaaaactcaaaagcaggaatttttaaaggaatctttcatacaattggtaattttgatgccattaatttcatgttttagtatctctctctctctcattctttctctctttcctttctctcaataaagtgacataatggctttcatttgtgcctccactcagaaaatgtgtccctattgcttgtgcaggccagttagttggattacctcatagatgacaaataggaggtgagataggattggggtcagtattcattctcttcattttgtcatggtcctttatgctttggcatttcaaattgatcaccaaaagtagcgaaaggcagctgctgtttgattctttgcttggtgagagtagtaatacccttgtttactctactggtagaattgccttgataagtataacttggatgtacaaagtctagtatttatacagaaattgatcaactgaaaattcaatttctctcttggagaactcactctttaaagatactgcagaggctgggtacagtggctcacacctgtaatcttgatactttggaagaccaaggtgggaggatcgcttgaggccaggagttcaaggctgcagtgagctgtgattgtgccactgcattccaggctgagccatagagcgacacttgactcaaaaaagaaaaaaaaaggatgttgcagaatagaatgcatacatagccatttatctgaaattaaatttggtttatatattttcaatatccacctctgtaaaataaacctatctttagacgtttactggtatttttggcaagaagtgattcatattgcctcccattattttagtatatgattactagatttcacttaattggttagaatttaataaattatcattgtaataaatttgtaaaatgtaaacataaatacatatactgtttgtaaatctttacattattaagagtattacattttactataattattgtatgcttttgagaaattgcaaattgttcttaacctgaattttgctgatctcagttcatggaaccacgtgactcttaagggtcaataggattttagtgtttattttctagccctgtgatcctcagtaaattattaaagccctttgtgcatttttcctcatctgtaaaatggagctaaaaatgagtacctatattataggaattttgaaaggattaaatcagttggtaataaaggatcatcattaaagataaaatgcttagataagagcctagaaagagtaagcattcaatagactttagctgttataatagttattattaatttttctattatgtagagattgaaaacattctgtacatacacttgatgcattgttatagcaaataaatactatttaatttaaatttaagatctgttttccatgcccacatattagcaggggactaattaattgaattaatgcagaggatgtttattgaatttgtgccatggaatgtattaggcactttggagagtacaagattgtttccctcaagaaacttactttaaatgcttaatgtaagatagtaggagagatggcatctgagtaagtagctaaaatatgcctagctgtgatacagcaaattggtttatttgggctcaaggaatcttaaccctttgtaccaaattgtacaacgagcacatgttttttgttcttgaacaggtttctgcatgtttgtactgagtttggtgaagaaacattatcgtctgcagttttatatggtgtgtattaactattattccttagtcattatctgtgataaaaacccttaacttttttttttctgtagtgagaagatacagtcgaatctgctagctgttgttttgcatgaatgtgagggatacttggatttcagatgaccattagatataaactattaaagttgagaagtttgtgaggattttaaaattttaactgttttcaaagtttactaaaaactttttctttgaatattttcaaatggtgtaaaattaaagtttttgggttccttaaatttgtagaaatttgaagaattttcttagtctcctggacagttactatgtctgagaaacatctaccatattgttctatgaaagtaactatgtttacttgcacttggcgtgcgcataaagcagcagagcatgtattatcttggtggttatggttagtcatagaattgtgtaattctttttggcataagatattttgttcaatgtaccaaagcctgtcttaagaaatgtatcactttacatatgaactttttttattttcttaaactgtagctagtacaactgtacaatgcaatgtagtattcagatctgtaaattcatgtgatagtgaggcttattttggacttggaatatattttctgttctttatgcttagcttttctccattaagacattctgctgaacataattgctgggaaattgttgtgtttcttgtatttctaatttaagggaatctgagcatgaagagtaaaattcttagtgaattttatatagaaacaagacaagtaaaaatagtagaatatccagtgaaaatgtaaatggcatctattggaaaaaatttaattaatgcatttttaagcaatcagagtaaaagagaattggatctttcaagcagataaaaatagaataaaatagagcaaccaatataatatggttgcttaaatgggaaacaggtttattaagaataaatcaaaaggccaagcgccgatggctcatgcctgtaatcgcaacactttgggaggccaaggcaggcggataccttgagcccaggagtttgagaccagtctgggcaacctggcaataccccatttctacaaagaatatgaaaattaaccgggcgtggtggcacacacctgtagtcccagctactggggaggctgaggcaggaggatcacttgaacctgggaggtcaaggctgcagtgagctgtgatcacaccactgcactccagcctgggtgacagagtgagaccctatctcaagggtgggggtccagggagaataaatcaaaatcttaagaatttttaaaagtaattttatgaatttcaatcaaaatcataagactcgtacatggaaaccatattgattatattaaaagtggccatctctcaggctagatagaattggcaaaacacaaaggtctttaaaaatttgaaattgaatactgtcattgaacagacctgtcacgatcacccttcaagtatgaaagatagagtttaagggcaattgaaccctgctggtttgaatcatttgaagttggaaataactctttatgggaaaaagttaccgtaataaactctgaaagaaaaggaattttttagcattttgttaataactgcagaatgcagccagagtaaaatgttcccctttaaatgttgttaaaccagcaacagaaatctctcatcatcacttaaatctaatgattcaagataatggtttattttttatatgttttaaaagttagtactatataattagaattctatttatatataaattaaggttactttgttaaatgttttcattattttaaggttccagtaggcaacaaaacaaacataatttactaacagtgtttttattttatatgactctaacttgtacattttgaccaaaagtcatggtagaaatttgggtttcaaatcgctgttgcttcttcagctgcactgatcagttgtgttcactaatttttgtattgttgggctattaacagttcgcatggactcatgtcactttactgataactgtcactcagtcacaccttgtcatccaaaatctgtttgaaggcatgatatggtaaggcaacagaattatgctgctttataagtatgtcatagcacttttatagttctttaacgttggatagtgtcttacagatttctactaaaatgtactgtttgttgttcttatattccattaaactatcttactgagttttgcttactctttgacaactaaagacaaaatgcttcattaacaactggataccattcttattcaagttccaaatataggaagttcccataaaagacccaaaaaattaattacattttcaggtgttaataaatcctagtgtaacttttcacaaaagacagactttaaatataatatttattaagatattatttacatagaatgcaaaaaaatataaaactttgcctactagtaactactgtgaagaaatgcatgtttttctaggtgaaagttgggtaggttttctactttgctcctgtgtaggagtgggtttccagattgtagaagttaattgctctatggcagtggcttgcatattcagaaagcatttttgttaggtaaaaattataaaacttattacttaaaaattagttggaatggagaaaaagcttaagattaaaaaaaaatctgactgtatttttcccccactcatttaaaactcattaattaaaatcttttacagttgatgggttttgtcaagataaattgtattcccttgacagctttatgtctttttaccaagggtgtggttgtgtctttgtgtgtgtgtgtctctgtgtgtatgtgcgtgtgtaaagtaattggaatcattttaagattgtctttcatgtattgtacagacttttcattgatggggcagttactgaagtaagtaggttctgtacattcagtagggtttactgaaatcataagctaagatagaattaaaattaataattgagaatatgtattaagagcttgatataaatttatcagattatgttctgtctaaagaaatgactcattttcatattaaaaggctggttttcttaagattagctttcagtctgccttttattttttattgtaacatgttcctcataaaactaaaatgaaaacatccataactgtagaaatcaataatttaatattttcctagcatgctagtttatttttagattttgctctgtttaaattggtaagtgggcaaatttggttgatatttatcatttctactgttttggcaagtgttatgttctgggtaggctgcagtgcaatccaaagggttattctgatggttcattatgaatcataacctttccgaatatctgccacttactcaggtgaacttttttctgctgacttttttttttttttttaaaaacaggttccttgttccaatatcaagtgttatctgcaatgacataactgcttacctttttggatttttttttgggagaactccattaattaaggtaatggaaaaattttataagcaagccactatgtaaccttaaagattagccactggagaacatttccaacaactgtgctgttgtgcattttttatttttgaggtgctttgattttccttagctgcatggtgcagaagcagcaaaccatatttctcagtacttccatctgggttcttcatcagctcttctgttggctcctcaggaagggcatgactccatcagtctgcctgcctgcctgcctgcctgcctgcctgcctgcctgcctgcctgcctgccttccttccttccttccttccttccttccttccttccttccttccttccttccttccttccttccctccttccctccctccctccctccctcccttttcatcttcattttatctttatgtggtttcttttctttcctttttttttttgaagatggggtcttgctttgccacccaggctggagtacagtggtgctaccatggctcactgcagcttccacctcccaggctctagcaatcttcccacctcagcctcccgagtagctggggcttcaggtgcatgccaccacacccggctaatttttgtatttttggtagagacagagtcttgccatgttgttcaggcttgtcccaaactcctaggctcaagcagtctgcccatttcagcctcccaaagtactgggattaaaggcgtgagccaccgcccctgggctctgtggttttttctctcggccattggtgcagttcttctttatcctcctttccagcaagcctatacacaagccttttccttgactctcctctcccttcaacctgtcgccttacctgtcccctcctttaccaaactttctcaaagaagagattatataatacaccttcacatcctcatatccatttgtgtgacttttcatatccaaactcataccaaaagaagattttggggccctacaataaaatactaataaaatacaagtaataatgaaagggaaaggaaaatacacatgagtagaccatgttgttttgctatagaattggttctatttatgggcaatggtaaagaaggaaatgaactaaattacatagttctcatttgggagaagaaataaactaattcttcatggaaatcaaatcattttctagaactgatttcttctaaaagagctcttctttatttttgtttagtttttattcgtttttggagacaaagtctcgccctgtcacccagtctgtagtgcagtggcgcaatctgggttcactgcaacctccgcctcctgggttcaagtgattctcctgcctcagcctcccaagtatctgggattacaggcggctgccaccatgcctggttaattttagtatttttagtagagacagggtttcaccatgttggccaggctggtctagaactcctgacctcgaatgatctacctacctcggcctctgaaagtgctgggattacaggcgtgagccaccacacccggcctaaaagagcttttcatgttggagtttcagataagattcacacatttcacattattgggcaaagtttttaataatgttctcacagacatattattacctggctgttttgatattgttatatgaatgcagttttggaaggactgagacaattgttcagatataaagccttctgtttgttcagagtggtatgagggtagtttagtattaccagaggaatttgtggactgcctgttcttccaaaaacctctgtaaactcttcccctcttggggaggagctcacagagagcacctgctgaaagcatcagcacacagagagtgttgggctgagctgtataaggatactggtaagcaagctgtatatttttaaaacgtttctaaagctgctccagagtttctaaagcttgaatacatgatttacgtattcaagagttctacccagactgagaagttttcggcttgggaagctgtattagttcattctcacactgctataaagaaatgccagagctttaattggcttatggttctgcaagctgtacaggaagcatggctggggaggcctcaggaaacttatgatcttggcggaaggggaagcaggcacatcttatatggtcagagcaggaggaagagggagagtgaggaggtgccacagacttttcaacaaccagatatcatgagaactcatgggacagcaatagggggatggtgcttaaccattagaaaccccctccctgacccagtcacttcccaccaggccccacctccgacactgaggattacaagtggacgtgacatttgggtggagacacagatccaaaccatatcagaagccttcaaaaaggctgttatagctgtggaagaatattagcaactgattttgaacacagccttctagtgaatttatcaggctggattaattgtataatatacttagataattgaacagttaacccctaaatcgatatgatatgcatcaatttaatttgataagctatctttacaataatcagcaggcacttttgaatttgagtctgctcctacttcatggcagtgatagtgaattaccctaggagaaggtgtgtctgtcccttctctgtggcagaattgttatcagatttgtcaagaaaccatttctgccaactgttttggtttggggctttatgaatatcaggacaagaagtctatgaagagctcctataggttaacccataacccattttaatacttcagagactttattctgatatttggtttctgtccctcattaatgacctgatgaccaaatcctcccacacatcacagtctttatctcccctgagcaacaactttcactttttgctcctgaatcttttcctcctgccccaacaccactaacttctagatttttttccagatttctttccatgaatggtccattgactgggcagcaatagcctgaatccaacacaaacaatatctcttctttgaagtgcagcatgttcctttcttcttggaaatggacatagattgtgaaaaaagagaggatatgtcaatacttgagcaaatacagtatctggggctctggagtattttgccatatcagaaggaagtctgtgtgtatatagcatattaggaatatgtgaaaattatatgtgctaaaatgtccatgttttgttgtactgattctatttttggccaatagcaggtcaatactgactgtgtgtacttggaatgaatacgtctcattcttattccaagaacttacaccaactattatcaggttttatattagcataagagtcatgggacagttattttagtatagagtttatactcttttgagagacagaacaaatttagaccatttaacatgaacaaacacatattcacagcatttcaaatatttgagggcctactatgtgtttaaatattattagagagattttcactagtaaatcaagatcagagaaaaggaaaaagggttttgaactattccaataagagaaaaagtaaggagagatgtacaagttattgaggaaatagtttatatatatatatatatatatattgtgagttttgtgagtgcagtaaagctttttaattttatttgcccttttttagttgtctcctaaaaagacttgggaaggattcattggtggtttcttttccacagttgtgtttggattcattgtgagtattactaagatttttattttgtatacatttcgaaatatgataccaagcttactggtctaattttaaacctagaaaaattaaaccacaaaatgctaataatatatttattgaaacctactgaaaagaaccagttctgtacctcagcagcccttatcctggctacatatagaatcacctgagaagcttaaacaaaatctatgtctcagccttatcccaggccagttaacacccccaggtaattctaatggccatccatgctgtcttgctgacttgctgacttactgttgtgctgttgtgtttggtagtttctaacagctattctgccttaggcggggcacaagtactgggacaggtggtggccttgtgtaatagcagaggatgcaaatactattgaaaagctctgccttcttaaacacatggtggccacttggctcagtgggtggttactgttgtgggcccaacttgcagaaacagtctaactataaactattaatgtttgcttttagcatgttaaatagctatttttcatgttttacaaattagtttacagttataggatttagatttttattaaaaggtgtctagtgagaatgagagtatagtaccatagctggatataagataaatgtacaaaaaagtactgtcaggaagctttacttttcctagtttctgacagttgtggttacattctgtatccaaatctagagtacctagtaacaacatgaagcctggagagagtgaatatacaaataaatggaaatatgccatgatcctggaaaccaccagaattcctctatttaatttataaatttagttcatttgcaatgaaaattttaataaaatgtgataaaattattccagtgtttttgtggtagaatattgatgagataataatggacagatagaagaatgcaaaaggatccaatctcatccaatgtttttacattacaaagcgagaataattaaacattatgaagctaaatagtgtaagaatttgttattatcaaagactaacttgaaaataccacaggaatagccatatcattggaagaaaagtaggagctaccccataagcatgtaatgcatgacaaaataatgaggaaggaaattccacatctatatgaaattatatatatataatatatataataatatgtaatatatataatatatattttatatatataaaataaactggttgtttggaagcaaaatcagtttatattcattcctagtgtcttgaatttctattactcattctcgagcagaataatagggtgaatggctgcaagaaaaggagaataagctgttgtctagcaatttaaatttataacaggatatcttattttatgtatcttatttccaaggctgtggacagctagttttaaaaattgcaatggtgtggccagggaaagaataatttagtcaaagttttctgggttggctaagaacaatggtgtttttaacctgtactattttgtactattttattgtaattttgaattactggttaattattaactgatgaaattaatagaagcttgtgtgcagtatacttcagttctttattctcctgtaccgtataattgtgattatgcagagattacaatcttattgatttcaaaaaaactttttttttctaaaggtcttttaagtcttttactaggataattatgaccatttaactttgaaaatacatagcaaaatattaagacaaagaaattctggcattctatctctggcctttctgatgtataacttaaaagatatatgtttagtcaatgtgttatgaacttttgctttgttttttgttttgttttgttttgtttttaatatcaggctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggtacagtaaaagttcaagataaacatggttagagatcttccactctgaagattaagcttcctttattatttatttatttatttaattaatttattgttgttttgagacagagtttccctctgttgcccaggctggagtgtagtggcgtaatctcaacttactgcaacctttgctcaagtgattcttaggcctcagcctcctgagtagctgggattacaggcgctcgccaccacatctcgctaaattttgtattttaagtagagacgggtgttgctatgttggccaatctggtctcaaactcctggtctcaagtgatccgcctgcttcggcttcccaaggtgctgggattacaagcatgagccattgtgcctggcctgaagattaattaagctttctttaaaagtgggattcagatttgtacaagaaactgatttctgtagaatttttaattctttgatataccagtggttttagtgttagcttaaatcaaatggatgagaacgggttacaaatcaaatggatcaaatggtttagaatgtgtttctcatatcactgacatcagttgacacaatttaaaacttaaaattcaccagtttaccgagtccttgatttttagaggacatttattatggacagaaagttgctgcttctacaaatcagttttccttccaaatacagtgccttccttgaaaggtatcttggaggccttacactagaggatgttgacatgccctccagtggaaccctcctgatctgtgtcatcaggtctggtgagtggctggttaaagtgaggaatcaaataatagcatgtatgtctgtatctttgtgtgcacacatgtacagctttgtatctgaatcattttacataaaatccataatttttgaggagtagcttaacaaattatttctctctgagtgctcagtacatggtttccaagaactttttcaatgtccaagccatctgttacctgctataaaactttttatactgctagtgtttgattaggagcaaggctatttattgctttgagaacaggtcaaaaaatggatgtctcagccgggcacattggcttatgcctgtaatcccaacactttgggaggccaaggcaggtggatcacctgatgccaggagttccagaccagcctgaccaaaaggtgaaacccatgtctactaaacataaaaaattagccagtcgtggtggcatacacctgtaattccagctactttgggaagctgaggcaggagaatcacttgaacctgggaggcggaggttgcggtgagccgagattgcaccattgcactctagcctgggcaacaagagtgaaactctgcctcaaaaaaaaaaaaaaaaaattggtgcctcagacatctttcttcaaccaaaatgggtgcattttgcactgtctataaattgtagtttcagattatttaaaaaggagcaagaactacaaatttgcaaaataatttgactacaaaattcttctcagcctttatgattgtctccccaaatctttagtgattgtctcactgatgctcattttgataataatctttaagcaacttatttttgtgtttttccacagcattcatcttaattttagagaaaagtccaacttttcccttattttatcatataaaattaaggtgaaataaaatacaatattaaattatataattacagcaacaaagcattactagtttaaaaaaatttggaaaataacacagctgattctttgtaagaagtaaagttcctagacaacctggaaggtagactaccacgctgcaagatttcagtgtgccagttgcctgtcattattcttacagagagaagggaaattgctggctaagtagaggatggtacagaaggcttaaatagacttttcttccttgatccttaaagtttgaaaaattaacaaaaatgtggtgcgtgctttgacttactatttacacaatggttcttagatcaggtggtatgctcaaatacaatttcagtgaaattagcccctctcctccccttctttctcctctttaggaaagagtgagcttgtaccctttccagatccacagcattgcactgtcaacctttgcatctttaattggcccatttggaggcttctttgctagtggattcaaaagagccttcaaaatcaaggtgtgtgtttagattctttgttatattattagagaatataattagagaatgtaacctagttggaatttggtccgctcatgatctacattaagcccctaggccacaacttttatatcctatttgtttcgaccccacagaaatgctgccacgttgatctgaatgtattctttctttttaggtttgtcataccatgttaatacattttaagtgtcatgtcagcttcctttatagacatggcatgtgtcctttagtgttggaatagacccagaatcttggtctttcaagtgctcacccaagaatccagccgtgaatcatctaaagtttagtgttttactacagtctcacttgaagggacatgcagaagaacctttggctatgtaactgtccattctgctaagtcaggtgtcatcacactctttctgtaaagggcaaacaatacatttattaggatgtgcagaccatatattctatcaaagcttctcaaccctgaaccctgctgttacagtgagaaagccccccgtggacaatatgtcaatgaatgggcatggctggatttaataaaactttatttataaaaataggttgtggcctggatctgatctgtgggacatacttttctgacccctgttccagagacctaaaattatccctgtgtattaggttagatcatcataaagtgacatgttatctcagcaatttcatctcagcttccctcacatggctgaggcaccatctggggttagaaagtggctatggaagttggggtggtcagggaaagcctttctgaggaggtggcacttaagtagagatttgagaaaagaactcctccagagaaaactaagaagagagttccagagtgtacagaggagtggaagaggttaattagcctgttagaaggtgagcaagaacagtgtggctgtggttgagagtaggagatgagaccgcagagtttggtgggaccagatcacacgcggcctacggggtcagggaataagtgaactcagcgagcatttgccagtgggaagctactatgtaaggtgcaatgcagtatacaaaaatatacaagatgttgttcctgttctaaagatgctcaccacctactagggcagacaatacacttccccagagaactacagcaacagctgtgcaggataagtatcttgcgaaggctgtaatagcagagtggcattgagttactgtggctcttttatgctttgactagtaaggaagagaaagagagaaatgggttggcaaaaattaaccaaagactttttcagtaattattttaaaaagaaaaatgttatatttagaatggtattttctttaatggtctccaatccaagattttttgttaaatggtgagttttttttgcatgttggaaaccaaacagctattgctgttgtagtttagatatttttagggtgcctgagtgaactagaagagcagttagtcatgtccatttcctgggcacccagacatgtgaatctacctgtaaagggtcagtttgcagaggcttactaccattccctcagtgtggccatttaatggactaatgtgtcccatatgggctcactgtaattttattttttactctaacacttaaaaaaagaagaagaaatgtttatcatagtagtaaaatgtttatttcagagtaagaactattaggataaacaagttagaaccagttgtacatcttttagcagcactaaaatagctccccaaacagcttgtggttaaaaagaaagctaggctgtaacaaaattagattagtaatagctaagataatttttatttagaaaaagttttattaacgaaaaaaagtaagtgctagatttaattaacgtttgatgaatgaatgctgtgggtcaattcagaaatcattctaaaagaagcatgtatttggaagatgtggttttaatctgctggatgtgttctaataagtttttatttagtgaaaaaaatccaatagtaatgtattttcgttagagtgagtccatgacgccaaagagacacagataggaattttatagcaggtgattttttgaaaatttgctaatatatttgtttgtttctaaaggattttgcaaataccattcctggacatggtgggataatggacagatttgattgtcagtatttgatggcaacttttgtacatgtgtacatcacaagttttataaggtacttttacacttgagacattttttagatgatttctttgagttctcatttccatcaacattagtttgagtaagttaactttttccgtcaatggtaatctacaatattaaagtgaatggtggcccctggaattagagtcttgagcaagatggttaacttgtaattgttttacctacatttgaacaacttaaaaaaagatagtatttgtcatggtcctggaccacattgaagacccaattaatgtggatggtataggatttgaaacttgaggagatttgatttctcaactgtgggcattgcaatgatcatgaatactaagagttaaaaagggagataacgaaatgcatccagtctaccaattattacttgagtgcctgccatattgtagaatgttctagggacaaatatggcagagaacaaaacaaaccaaatctctgcccccatagctacttgtttggaagttgaagaaagaatgatgagaaagagacaataaacaaataaatatagtttgttagatggttgtaagtgtcacacagaaaaataaagcaggccgaggggatcatgcctgtgtgtgtaggggctggctggtggatgggtggatgaatattgccattttagaaagggtggtttattcttgttattaaaccttaatgttttggatctgccttgaaataccagtgtgagtgtgaaggcttaacatcaactgcatgttaactttattttctgtggtctctactgggggcccagaaggcagaatgcttattaatagtacctgagctgtagaaaacatggatttccttcatagtacttggaaggaaattcatatttagcaatccctaaatacacattttaaatatgtaccacagtagtgtgagaatttttatattaactatttttgagagacagtcctgatagcgagtttatcaatttcattaatcttttcaaaaatatcaactccaggctttgttaattttctctactgtaaattttttacctcattgatttctcctctcatctttcatttctctgccttttttaaatgttcaatatgctgttctttttttaattctggagataagcttagattattgatttttagccttcttatctaatttatccattgaagactattaagtatcactttatcctcttcctgcaagttgtgatatttgtattttcattatttacatgttttctgatttccagtattatatcttctttaacacatgggttatttagaagcatattcattagttttcaaacaaatggagattttttcactttcctcccttaattccactgtggtcggaaaacatactctatgatttgagtattttataatttttgagatctattctgtggtacagcatgttatctattctagtacatgctccatgggcaaaggtgtattctgtagttttgggttgtagttttgtctgtgtcagttaggtgaggtttaattaaatcttctgtactgatttttgtttatttgtttttgtgtttgtttggtccgcttgttctatcagttactaagagagctttgttaaagtctctcattgtgattgtaaatgtatttttttatttgtagttctaccaatttttggtttatatattttgaggttgtattaggtatgtacaaatttaggattgtcatatctctccattgaattgatccttttgtcattatataatgtctgtctttactgcttgccttaaagcgtactgtgttgaatattagaatagcaatatcagctttcttttggtcagtgtttgcatgttatttctttgtctctccttttatttttaacattcccttttccttatatttaatgtgtttcttttttctagtaagcatatagctgatttttttccctgttttatttataagacagttgataatctttatccttttaatgggactatttaacttatttgcatattatttattgatctatttgggtattagtaattagtggttaaatccttaaaactttgttttcagaatatggcagctttttagggcattaactcatatgctttctttaaaaaaaaaatgctgtcctctcagtagggaggtgtcatgctgagccatgttgtccaccatttgaaagcagctatttagactgttagaagacactgagagtgccaggatgcagctagctgggagcacctgctgacacaattttgcatttagctgaacttgctaaagcagccttccttttctctgttggtctctacttggggtttatgctgtgaagttgctgactcttttaaagaaatgaaataaggcgaacagtgtcctgacctgagtgtgaaagttttttggcagatgagttgagccacgtgcatgaagatgacccttggtgggatggctcatctgggctcttgtgcaatttgttaagtcaaagattttcagagtaaatagttcctctgctcatcctcattgtggtaacactaaatagcaaacatttctttgttgctgggatttctactttctataattcaatgtgaacaatctttactgtaaggcatacattatttacccacataaatgtctttcttagaattctatgccatctctatacatgacttgtatgttgctttttcccattggattttaaagcagatctgcttttattttgttttttatattggagttcacctaggactgtctttgaacaaagtccacggcacctgtatcactggtaaggggcttcagtgctaggctcaggacttttgtgttctgactctgaatattcataactccctggagatatttttcaacaaaatacctttcatcatctgaagtttcttggaagttaaaaatttcaattatattttcatgccctctttttggtttgtcctatgttcaccaggctcctttccttacagaatagtttttgtgtctcattcaatctcaagatttgccatttatccccacctttaactttggttgccctttcaagagcttttgtagaacttagatctgcaccccttcaattgacttacattgctcttgtgttttgtgtttgtgcattctttctccctctctgctgtaacccttgacactaacattgcacattaaagtgagctattatcaagagctattttaattctgtaaagattcctactctacacttaaaggaatggtttgttttaaattggaggtatgtgcttcacttatccctattaaaataacacgaacttgtcttctttgccttttatcattaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccactgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttc

SEQ ID NO: 17111 - DNA, 8620 bp, Human
gaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctgatggtttgagagactctgggggcgtgggttggggactgagggatatgttgtggggtggtggtggggagagctgggagttgagctgaagttttatggacagcagaccagtgaagttaggggagggatgcagggtgactaacagtgtgtgtgcacaggcaatagagttcactcggtgtggtcaaagccgagaaggggacccctcaccacccccctgccaaggtttggaaggtcccagctgtgggatctcagccagcccacttacccctcccacctctctccaaccttgcctctggcaggatcttgaaccgaggctggaattgaaggtcatatctgttcctggttggggtctggaatggagtttgggtgtcctgggagtaagtcggagggaaaagaataaggctgagttgcagggaggaagtatttaggcgagagtgggatggggaggagggctggcactcagtgctgacgttgacagtccaggccctgtcctgccacccacttccagatcattggcttcaaaccacagggatggattaatcctttcctgtgcgtggtaggatcagggagggcaatgtggagggagacccgctgtttgcagcagcatgagaatataggcattctcgaatccaccgtctctgccataaaggtccctggatgagatctgttatcagtcaggaatcaagctccttcagagaaggacaggggacctcagaagagatgagtgggggtcagtggctggagtgggagtgaggcaaatggtgggaaggtgaccatagttttggagacaaaattccacatatatgatctgacaaatgaaattgagattattttccccccagaaaatataaggcatgatattgcttccccttaggtaggttcaaggccagtggctccagggtgcagtggtgggttgaggttagacttcaaggccatgtctgggtgactcagggatcttttaggaagaggtgcatggaggtcaggtgcagaggctggagggctttgtcccactgacctcctcttgagggtcctctttcctctcatcacatggggcttttctctcaggtttcagaggagtggggcaggtgactcagatgttcccgcagggtttgaatacagagacttgggaggaatttcagttcaggagaaagtctgctgccttccgctgccctctccatccaccctccctgggagcgccctccctggggcctccacccaggtcacgctctccttcagagatgcctactgcatagcaaccaatccctgctgcctctccaatcttgccagctgggggtggggtggagtggggagcagtggggaggccccccaggctggggtgggactgcagcagtgataggtactacaccctgagcccaggtctgttcttggactggtggtagaagtatgttgttctactgtggtagaacgatgtctgagtgtctcctgggatacaggaaactctccctggcccctacttcctccttgactgcagcctgaacctgaacccccctccccaatccacaacctctaccccagtgctgggccttagcccttcgctggacaccttccctattcctgattctcagtcctccatgccaagagtctccgacgagcctttcctgtgaagagcagtgaggcctagaagaaatcgttcatttaaaagccctttaaaaacctctgggcccatattagctcatgaccttgaccatatccttcgcagaaaatatcttcctccactgatccccatctcaagggctgtcttctctactcctggagtgggtggcaggatgggtgggaggggcccgatgtggagagcttcctaggacacggggagatggtgccctgtgtttgtcccacacttctgaggttttctttccaggacagcctggtttcccttcttcggcttattgttccatcagatttcagattttgagttctgatttttggtcagaagagtaaagtttctgggattggggacgtgtgtgctatgggaactcagtgtgtccccagcccttgtttgtaaacaaggaaggtgagattggcagaaggggtttctccccagctccatcccgggaggctctgacgtgggcatcctcaagtccccaacaacttctcatgggccctttctctcccctggattcctagggacagagatcagggaaataaaggcagaaggcagtgagagggaggctatgcctgctgcttggattctctgggctcactcccacagtggtaagtccttccttcctatgtctctgttcatctgatatctggtgggtcacgctggatgatgagggtgacaagtggtggtgacctccaccaaggaggcctggccccacaagcgggcatgcgctcagggagaagagggcagagcctttggaatttcttgagaaatggctctggggtggaggtgggggtctggactagccaggatgctcctgcaggtgcacagagtcccttgccttcaactgtggtcccagctgagtctccttgaggtgggagaggctgaggtttttgtggtgggagaggaatgatgggtctggttcaagaatggcagggagggctttgggctggaggtgaagactctccacagatttaacctgcagccttcaagttccgtgggtgttgcctccttcctccctgagggggaagtggtttttgagtctgagtcacttgagctccatctgtctcttcccttggctgagggtggctgtgctattggaatccaggcccttattcaagcgtagcctctggatccaggttttggaatgatcctggagatttcaagaggccccctgccctccctgcccgctgacccgtctctgtgtgcactgctctgggccagagtctggagaccagctgggccagctcagctcacctccctgctgctccttgttgagaccccatcacccagttccagcccagccccctctcagccctggactctctctttgccctgtccccgactttaataatgggacactcctcgatatcaggtgattcaggcactgggggaaaggctggtgaactgcctgtggaaaaccagttcctaagctggaagaagcagagagaaaatcgtgacccttgatctgctccaccatctgccaccagggccttttgaggaggtcgtcttctcatctttctgcctcaggcctacttttcaacaactccccagcaggagagtctgtggtctcctttggggtcttgctgttctccttgtaccagcagctccagagtttgttgtgggtctcattgtaacctgtactgatatagatgggcgctcttgttagtggatttcagtctcatcctgggttccagtctcttgttctttgagggaggggcctcagaggtaggctagtgctgctggtggtgacttcctgaggaatgggatcttcccctctccctctacagagctgcacactgtgatggagactcctctggagaaggccctgaccactatggtgaccacgtttcacaaatattcggggagagagggtagcaaactgaccctgagtaggaaggaactcaaggagctgatcaagaaagagctgtgtcttggggaggtaggtgattgttccctcatcctccaccccaaagtctgagtactccctctgggggacacatacctaccctcaggatcctccagcctaagccaggggcagggtggccaagggctacagacagagacaaaggaagatggtggggatttcgggccagcaaaactctagccctctgtgaaggagaatgggtcagggtctcactgagaaggaggaagggctgagtctggagggtttagagaaggagattgaggagccttcgatggtggggccaggctctcccagcagtggcagaacctgtgctaggggtcatgggtggtgaagggatgcagggtgtccaggtccagctgtgtacaactcaagtgtagggactctgcctgattcttctctgtgtgcacagcatggccagggctctctgatggtgctggcactcaaactgaaaggttaacttgtaaacatagggtagtgaggagacagaactggttctcaccagatggaggtggtgggagggaggtgactgacagaggggaaggcccatgaggttattataatacaatatccccgaggataataaataaataaatatatatatatatatatatatatatatattttttttttttttttttttttttgagagagtctcgctctgtcacccaggctggaatgcagtgacatgatcttggctcactgcaacctccgcctctcaggttcaagcgattctcctgcctcagcctcttcagtagctgggattacaggcacgcaccatcacgcccagctaatttttgtatttttagtagagatgggggtttcaccatgttggtcaggctggtctcgaacacctgacctcgtgatccatctgcctcggactcccaaagtgttgggattacaggcgtgagccactgcgcctggccaaggataaatatttttgagacagagtctcactctgtcacccaggttagagtgcagtggtgcgatcatggctcactgtagccttgaactttcaggctcaagtgatcctcttacctcagcctcctgagaagctaggactacaagcaaataccaccacgcttagataatttttaaaattttttgtagagatggggtctcactattttacccaggctgttcttgaactcctggcctcaaatgatcctatcgcctcagcctcccaaagtgctgaaattacaggcatgagccactgtgcctagtcttattatttttatagttaaaaaaaatcaatgctcaaatacatcaaataacttgcctaaggacaatccgctagtgggaggctgagctggagttctgggccaggcctgtgaatcatcctccctgtttcctttaaaatttagcctgggtgcctctccatctatcacaccttgagccctggtaggccctcccagaaagaaggtccacagtgtgccacatgggcaggggacagaagcaggtatgggcgtccccaggcctgatctctggccttctgccaggctgcctgcatcctggaggttaatgagggcagagggaggggccacaggtccagcagggattaattacagaaggagagacgcccagaggagggcctggcaataacaggagcccaggctggggactaggatcacgtgacagacaagcagtttccgcctttgtaagtcccaatgtctcctgtgaaaacctgtagctgacggcaatgatgaggagacatcaggatctgcttgtctatattttcttcctgttccacccaaaggaccctgactccatcgtcctaatggagccaggctgggacatcaggggactgaacaacagtgcacaaccaggctccaggcaggcctcttgcacagctctcctagcaggggagggatgcagtggcttcacagccccagtgcactgctctcattgagagacattttgtccggggttattctcacctagtccttagaatggggagagagtcactcagagacttggataatgctcaatgccacataatcagcaaggtgttctttttttttttttgagaaggagtttcattcttgttgcccaggctggagtgcaatggcatgatcttacttactgcaacctccgcttctcaagttcaagcgattctcctgcctcagccttccaaatagctgggattacagggatgtaccaccatgcctggctaattttgtattttcagtagagacagggtttcaccatgttggtcaggctggtctcgaactcctgatgtcaggtgatccacccgcctcggcctcccaaagtgctaggattacaggtgtgagccaccacacctgacccagcaagctgtttttatcaggtgttggtataaaacctagatgattgtttctttggctgggggacagtattgcagggaaggcaggctaggctagcattcctgctgtcatttatttccattcaggagtcaggtccctgaccccctacctcatgccaggcccttccctaggtgtgggcagtgggcagactctgggggtcgagatgctgacagtgtcattgactcagctggggctcaccctgaagtttcggggtggggatgacaccatgcagtggtgcgagggcagggctgggagcggggtctgagctgtctctccacctgggtccacaaaagatgaaggagagcagcatcgatgacttgatgaagagcctggacaagaacagcgaccaggagatcgacttcaaggagtactcggtgttcctgaccatgctgtgcatggcctacaacgacttctttctagaggacaacaagtgaccagggctgccctccaccctcaccctccaccctttgctgctgacctcggctgctcctctcacagaccctctttggccccctgccctcctctccctcccagatggacccttccatgggaggaaataaagtttccatcgcaggtgctgggagtctggttttgaagctgtcttgtctaccttggcctggggagaggggagcacaggaagggtctctccttgagtgggttgagacagcttctgcctctgggggttagggtcctgggctcccactgcattcctctccttctttggtgtggacgtcattggttttgtcatggcttagttttgcctgcctggaaaatggggaagttaggccaggcgggaactctgcaaggatgcagaggaagttaagagggaaagttgctttgagaggaggacactgggaggggttgggagtggctcctgagggcggtgataggcaggcaggcctgacttgtccacagctcaccggaggccaccttggcagcacctgtaggaagggcatgtctggcctccacaccagccccctccctcttcaccatttccccttcaatagcaccactctcatcatctatgggggacagtgctttcttctctccctgcctcctccatcaaaatcttttctcaggggagggtctgaaaaggccttcactcccccgtaaataacgaatggtgcttacagggctgggctcccacgtgcatgcacattaacaccaaaggtgctgtagtgaatggaatttggggcactgaggggaaggagtggaggtgttggtaggaacttgttgctggtgggggatgggcgccgtagatatcctttacaccactggctactccccctatctcctctggggtgaccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccggtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattgtgtgtggcctgagactgggtggttccaaaggaggcggggctagtgcaggcagcattattggggtgtgtgggtgagaagtccttgctcccatggcactgactaggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcggtgagtggcctcctccccaggaccccttttcccacccttgtcctttggaagcagga

SEQ ID NO: 17112 - DNA, 7639 bp, Human
gccttgcaaaggtgaagaaggtggtgaccacggtctcaatggactcctctagctctgtcagtggttctgctgccattaggaccctgaggccaaagctgatgtcctcaaggggctagctgacctttgtcagggctgacctgtggaagagagaaggagcagagagggagagtcagggagccccaagatgcaggaatggttcagaaggtccctgccttggtgttatcacatcagtctcagcctggagggggcatatggggaaagagggagaggacaggggttgagcttggggcagcagaccaggcaacggcatctcagttttggtgggggcaggagattcagctccagaaaccccctcttctgtaggtctcacaatccgggatcctttttaaatgtctgtggcttagggacccctctgtggtgatccctcgatctggagacccctctacttgagaggaggtcttcagttgaaggtccttcttggagtccttcaagtctggtggcccctctgtggcgtgtctgtctcaagaatcccttcttgtctcacccagactcacaggtcataaggttgtttgtctccaaagcttgtttatgttgggccctggtctccggccactcgcatccgcccacacacactctaaccgctcctcccagcagagaagcacagggtctggcaaatgtcccctgtggtcagagctggctccgtctgaacagacccattttctctgccccgctccacccttacctctcctcagcggcagcagggcagagtgctgaacccaggaccccacagatcctccccgctcctgtctcccggtgacaagggtcctggaacggggcgtctctgactccctgctccaggacgggtttagtacaggcactcacaaccccctggggtgcggcgggtggggctggaagaggcattctcttttctgtccaccccgtcacacactcctgcacgcgctgttgctcgatcatccaaagctccttcctgaattcctgtctgagctggctctgggggagggacctgggagcccaggaagaaaaaatgatctccagcctccctccagggtcagccatgagactcacccggcaaggagatggggtagagtgagctggagcctcagggctgaggtttataagcagcggggaaggaggagagagctgcttccaagcccggaggtgtcaaatttccgtggtcgattctgaagaccagagacagcccaatcaggccgcttgccctgagccctcaggtctggacccgggctccctgccagccacacgagcgcccccacttggtcagggagaggagctgcctggacagatctcgttcggcaggggtcccagggtcctagtcctctcaatactgggggctgctgccaccatacccatgtctaatcaggagtgtgtatgctgaggggggaagagggaggcaaccaatcaagggagctcaacactgagaggcccaatctgagacacacacagaggccccttggaatgagatcccacaaaggatgctacagaccaagatccctcagagaaccccaggctgaggccccacacacagagggggatccaggttgagacccccagagaagagtcctggattgaaatccctctgtgggttctcagactcccaagactaagtttctcactgagggtcctctcagtgaggccccatggaggagccacagactaagaccccctcagcagaattccccccttaccgggctcaaccagcacagccagccacaggtactgcaaggcccagcttggggtaagacatccagtgtccctcccaggacctccttcccacctctttcccctgcaccatccactgctgcctggagagaaaggaacggggcaagcaaggctgggaaagagacaagggccgcctgttccagcccaggagacagagggcgcctctgtctgctcctggccccttgccccacagggtgttcgtctgtgaaggggtggagtcggtgggggggtcagcgggggagggactgttgaagacaggtctccacacacagctccagcagccacatttgcaaccttggccatctgtccagaacctgctcccacctcaggcccaggccaaccgtgagtaccctgccccactgggctagtccctggcctgccagcttcagggagaggggtcttcagaagggctccaagaggctggggaccatagcactgtggagcactgaggatctgggaggagtcagtcagggtgagggcagtttgggatttgggggagacagggtttggaaggtggtgatgagagacaaatgaactgaaggtcggagagagagctggcagctcagcaaaggaggaagccagtggggaacccaccatgagcttcctgaccgcctggccctcccacagggagccctcaagtccctgccaaggccccctctgtctcccaggtgttgggaagggtcccagccctcccctgcctcgcctcctgtggggtaagaagagagcagatacaacagctgtttctgcccccacctctcctgccagccttagtctctgccacccccaccctgccttgccaagagctcaggtcccgggggagtctgggggtggcagggcaaagctcccatgatatggggaagcagagatgtagggtgctgtgccccttcccaactcgacctccacaggacctcccctttctcctcctcccatttttggcccagacctcttgactcctctttccccccattcttacctctttgtttccccatctcccctgcccccaagtcctctcagaactgccaccacgtaaaatcccaggctgctttagggctccaggtgacctccagctgcccctctggcatggagcaggtaatcaagctaccagcacccctccctcaagcaccccttatcccctcatcagccacagcttgggttccatctcccccatgtctctgtgacaactgcttctcaggtccggagttcagatgacactcacaagggccccattgaagaactgggatgtcattcgatcaggggccattgtccagccccctaggcctggggaaggatggggacatctgatccgagacacctgagctgccccctctggggttgtggaaggccagactgtcccagggccaagggaaagaggccccccggcttggcagtcttctctctcaacagaccactcctttctcctttcttctcctactctctcccagccccttgaactcaaaggaccgcatgctttcagccctttctctcccccaacacacagcagccccattccccttgctcccactatccccgaatcaaccaggagtgagcagttgcagggacaacgcctgcaggtctcctctcccactccctgggaactctggctccaaggaaaaggctcagacattcctctctccccttctgccacccaccagatggaagggataattttgcagaggcaatgggagcatatcccaaagaagccaaaatgacatgttcaggagagaacagagttgaaggaccaaaaggggcccccagctgctgacaggaaactcagagtcagtgagacctccctcccccagaaggcttaggccacccactggggctgccatcccctctaccaggctgaccgagggtaccagactgactccttgctaggggtgggcagcagaaggaaggctgtagtggacaccccagcccaccaccctcaacagcagagcttggctatgctagacaggcaaggtccagggtaaaaatagagccagaggaagcatggcccagtcctgtgaccacccctgcctgccccaccctcctcaatccctgcctgggcagccactgcagacatctaccacaggcctctggagccagcccagctccaactgctctctctccatgccccaaccctgattccctctggctggggtacagactgagggacacagagaacaggcctgcacttaggtctcttggggtttccctcacattgtaaaatctcagggaaagatcaattgcagtagggctctaatcccacagctatttgagctgtcagccagggccagtcctgagggttcccctcacctagaccccaggtactccgggcctggtcctcagctcacttccatgatgggggtgggtaggtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgtgagcatagagtggtggagtgggagtggagtgggtgaaggttgggggaatggggtggacacccccttgctatctccccaccccacctccagctcagcctagcctctttctttcctttcccaggcttctctcctgggtttttccaggctcccctactcctcctgggtcaagtcaaaatgccctggtttattgatcacctgttaagtgttaggccctgtgtagattcatcaataataagacacacagacttagaagggaaagattgacacttaaaagtaaaccatgaactccaggaaatacacagagccttaacagatgtaccagaaagggttatgagagattattaacctgattgaagtcagatggctttcctgaagaggtggcacttgaaccatggatttccattggaagattatctgggtaaatgcagacattttaggaggaggtaactgaatgaacaaaagcatgggagaaagaagaatgtggagcatgtcagtagtttcattcaactggcatgaaggatgtagaaaactaggctgctaaggctaaccagggccccaaagtaaagaagcctcaggatacggtagaaagtgcaccggttttgaggttttattggactgggttcaaattccagccctgctactttctagctgtgggactttgggcatatttatttaaccaccgattaccaatttgtttcttctctagaatggaaataatgaaacatacctcacattatttgtattagaattaaattagacagtgcttgtaaagctcctagtgtagtgcttgctttattataggcactgaacatacggtaactggtgtcattattattcattctgccaggtgaaagagcttatgctgtaggcaacagaagccctcaagacttttgaggaggcctagaagagtcccataattcaatgcagttcctctcgctcatctttgcctcctgctcctcaaccacccccttacctctgactcagtgctgtacccttccctatacacctccctcttcctctcctcccaccacaggcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccttgaccaccccacccccacccccaccaagggcgcaagagtagcggtccaagcctgcaactcatctttcattaaaggcttctctctcaccagccatccgatgtctgtctcctctgggatctggaagtgggtggagacgtgaagactgttcactctcaactccccttatttggggaagtgtcttatttagaaagaggtcaaggtgcattacatcttcctacttgaggaatgctcaaggtccagaaatgtgggggttcaaggttccagttggaagtcgaggagacatcagcttctcaactataaaaccagaggaagaaataatcttttttttttttttttttttttggagacacagtctggctctgtcacccaggctggagggcagtggcacgatctcggctcactgcaacctccgcctcccaggttcaagcgattcacctgcctcagcctcccgagcagctgggactacaggcgcctgccaccacgcccggctaattttttgtatttttagtacagacggggtttcaccatgttggccaggatggtctcgatctcctgacctcgtgatccccccgcctcggcctcccaaagtgctgagattacaggcatgagccaccgcgctaggccgaaagaatcttctttcaatcaacgaacatttacttaagtggtactatgtgtaaacactgtaggaactgaggctccagcattaagcaaaataaccacgatccttaccctcacatgggtaaggatgctgggccattacttacacacagacacacacaaacacatacacacacgcacacgcccaagtgccaggaaggaaaatgaaagggtcttgacgtgccagtggagcagaggaagggttgcagatgtgtcattctctcattcctcaaacatatgtacactgtattgtgcacatagtcattagaaaaatcccttattgaggccgggcacagtggctcacgactgtagtcccagcactttgggagacagaggcgggcagatcacttgaggtcaggagttggagaccagcctggtgaaaccccatctctactaaaaatacaaaaattagcggggcatggtggtacgcgcctgtaattccagctactcaggaggctgaggcaggagaatcgcttgaacctgggaggcggaggttgcagtgagccgagatggtaccactgcactccagtctgggtgacacagcgagactccatctgcaaaaagaaaaaaaaaagaaagagagaaaaatcccttattgagcaggaaacatagcttatgcccataatcctaggagtcgggaggctgaggtgagaggatcacctgagcccagtaggtcaaggctgcagtgatccgtgattcattgcgccactgactccagcctggacaacagagccagaccccgtctcaaaataacaacaacaaatcagagagagaaaagagaaatccctatgtaggtctgcaacaaaataaacacggatggcaggtgtggggggaggacatggaaacgcaatcgaggacgcaaaggtgccccaccccaagaaggagtaaacagtatctaggccaagttggggaggggaggaagtgaggaggaaaacatggacgggcggtggtgttggccggtgcaggatgggagaggaatttgctcctaatactggcctcctgggccttggctggagcatttacggcacttcacaactctcagactgggcgagtggccatgaggggaaaaccagtgcaaattccccaggcccaattgtccggaagaagacgaggcaagtccgcgtaaagatttttagacggtgtaccttggctagggaacggaggggcgagggaattcgggacccaaatcccctctaaggcccacattaataactaccccaagaggttgcagcgcaaccactactggaacgtgaagtccccggcacgccccaacaacaggaccattggccacgcccctaggggcgggacactgcatggaaagccccgccttcgccctaaggctccgcctctgacctctgcgcaggcgtagctcaaatctttcccgccctctagtcgtgcgcggatctgacgcctgacgtaattgcgtagacgc

SEQ ID NO: 17113 - DNA, 8199 bp, Human
attttaatttaattttattttatttttactttaagttctggcatacatgtgcagaatgtggtttgttacataggtatacatgtgccatggtggtttgctgcacctatcaacccatcatctaggttttaagccccgcatgcatcaggtattagtcctaatgctctccctccccttgcccccatccttctccccgcaactgcccacaggccctggtatgtggtgttcccttccctgtgtccatatgttctcattgttcaactcccacttatgagtgagaacataccgcctggctttaagggacagccatggggatgcactgcagtttctgagcagggaaggccctgtggaggcccttagttaaaaggaaagaatggctgtgaaaatcgatgcattgcgctcccttgtccctcaccctcagtgtgaagggtttttattccgagttctacttgaagtaggcctcgatgggaagacaagtagcatgaggggttcaagtactgaggggagcaagggacactcggtggctgtgccaaggtgtagaagaggacactgggggccccaaggcctgacttcatgtacactgctcaggctggcccccaagtcacacggtgaccgctaggaagggaccagcctgttctcagtctgatcctcctgccatgtcattatccaaagctcctcctggcagggcctgtttggggtctctgtgccagtgctttccctgccaggctgggctggggcttccacctactgctctgggactgctgctgccctggccctgggggaggagggtgtgccgctgagtcactgcctgggcatctgggcctggaacctcgggtgagtcacttagggctgaggtagaggggctgggggaggggaagaagctactcgacagctggagcagggaggggagctggggccacaggaagggcggtgccctgatgcccagacgggccgggatagacaaagggccaaggaggaaggggccctgggagggggcagccctcccttgggctgggctctgaatggccacagtgtttgcctttctccgggtctggggaggacatgtgtgtggggggcagtgagagagggctgtggctgagggctgtgcttcaggcctggattctggcttgggaagctgtccagctggtgttttcagccttgggtagggatgtacccctacccacccacccagccctcaagctggagaagaggaggccaaagttttcctgttcagcctttaactactcgggacttccttatgctccccacagactgtggcccagcccaactgcggctgtgtgtagagcaaccccatttctcactgcttccccatccttccagacaccttcctacacagagggaccttcccaggtatttctaagcacacttagttacctcattacctcattaagaggtattctggtgctggccattaaaagtcactccacttcatccatgccctgaagtcagtcctgtccttctcctcctgatgtcccccagctgcctcctctggcccccagcttcctaagggtggccccaggttgcttctctctcacacacacaggcgcatgtatgtacacgagcactggaccatgaagtctcagcgtgtgctcacagcctctcacacaggagtgggctgtgactcacaggcatgtcatgagaatgaggcctggcaccagtctccaggccccagagcaggggttgcctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctggtgagtacctctgtcctgctgagggcagggtggggaggatccccgtgggtctctgtctttgtctccacagttctctcattccagcttccctggtgggatcaacctgggcctctctgggccttcccccttggaagaactctctgtgaagtgctgaagtgttgactgaagggttttttttttttttttttttttttgagatggagtctcgctctgtcgcccaggctggagtacagtggtgtgatctcagctcactgcaaactccccctcccaggttcacgccattctcctgcctcagcctcccgagtagctgggactgcaggcgcccaccaccatgcccggctaatttttttgtatttttagtagagatggggtttcaccatgttagccaggatggtctcgatctcctgatctcgtgatccacccatctcggcctcccaaagtgctgggattacaggagtaagccaccgcgcccggccgactgaagggtttttctccaggttcctctgtgaggtctcagtgcaggggttgctctgaggccctcccctggatatctcagtctaggggcccttctttgggggtctaggcctaggagcaggaggtgtgcatgtgggcgttgctgcaaaaagaatcctgagatttttttttttttttttttttttttgcaaagtcctggattctagcaggactaaggtgcaagaggcaggggtctcaagactctgcctgggtcatggccccaagcagcaaagctctgccccctgcctcggtgaaggcagggctggcatgatgggcccagggcatgccctgcctctggcatagctcctctggcctcaccctgaaacctgcctaacctttccaggctggtctgagtattctcagaggccttgccgctgaggtctgtcccatcctgatcccaaggcaatgaacatttcatatctttaattctaattccaacaggatccttcctggtggagagaatgttaagttgcccccaccctatccatgcccctgtctgcctagaggctcaggggccttcagggtgaggggagacacattccccaccctctgggagctcctagtctgagagaggaaacactcctgcccaagggagcttccagttagatggcagagagagatgcctctggcttcaggagtcccgagtctaaggagggaaacgactccttcagggagcttcctgctcctaggctgtagccatggctcctgccagactgcacaggagcccccatctgccagccggtgcatgtggccctgctccccagagcctgcgcagatgccatcaaaatgggactctggtcaccctgtcatttcccttctggcagacactaaaatggggagccctgccctcaggggggtgtcccaagtgccatcagaggaggcttggtgactcccagacacaagggaagctttagcgtctgccctcagggtgagatggaggtatcgcctccggcctcagggaaccacagtctgagggggagatgcagcccctgccttcccattcagagaggggttttgtgaggtggcttgggggcatagggcagaagtggatcctacaggctgagctaaggccccaagagcctcagcagtgtacccatcacctggcacctctgcagccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggtgagtggcacaggcctgtgggggaggtcctggtgtgagtgtgggggtgcaggttaaatctctcccccagttccgggtgcctgtcgatgcaggtgccagggtggggcccagccccctccccactttagcttcatggctccactggagtggaaatgaggcccgagtgggagtgcttaattaatggctgtttcctgcagcattccagagaaccatgtgctgtgagggccttccgagtccatctgtttaatcctgtcattggagacttgagaaaccagagcccagaagggaaaagtgattgtcccaagatcacacagcactggcacgttctctctctctcttttcttttcttttttttttttttgagatggagtttccctcttgttgcccaggctggagtgcaatggcacgatctcggctcactgcaacctctgcctccaggggtcaagcaattctcctgtctcagcctcctgagtagctgggactacaggcgcatcccactacgcccagctaatttttgtatttttagtagagacagggtttcaccatattggccaggctggtctcgaactcctgacctcgtgatctacctgcctcggcttcccaagtgatttttgtatttttagtagagacggggtttcatcatattggtcaggctggtctcgaactcctgacctcaggtgatctgccctcctcggcctctgaaagtgctgggcttacaggcgtgagccaccgtgcccggactccttttttttttttttttttttgtggtggggggacaagatctcactctgtcacccaggctggatcatagctcactgtaatctcgaactcctgggctcaagcaatcctcccaagtagttggaactacaggagtattgtcaccatgcctggccaatttttatttttgtagagatggagtcttgctatgttgtccaggctgggcttgaactcctgggttcaagcaatcctcccacctcggcctcccaaagtattggaattacagatgtgaggcactgtgcttgacctctttccatttttatatgccaaactaagaaagtatgtagggatagaaaagcccagctaagatatatagtctgggacattttgtggagaaatgcatcgaccttcaatttgtccctcaccctccctatactgactcattggtgattcccaaagttaggtgtcaggctttgaacacatgaggcaggtccttctttcctttttttaattttgtttttgtggctggttaaatttttctaattatttcggctagtattaaaaaagtgtttttcagctgggtgcagtggcctatgcctgtaatccccacagtgtgggaggctaaggcaggaggatctcttaagcccaggagttcgaccagcctgggcaacatagcaagactccatctctacaaaaataaaaataaaaattggccaggcatggtggcatacgcttgtagtcccagctacttgggtggattgcttgagcccaggagttcaaggttacagtgagctataatacagcctgggtgacaaagtgagatcactctggttgccaagaccagcctaggcaacatagcgaggccttgtctctactaaaaataaacaattagctgggtgtggtggcatgagcctgtggtcccagctacttgggaggctgaggtgggaggattgctggagcccaggaggttgaggctgcagtgagttgtgattgtgccactgcactccagcctgggcaacagagcaagaccttgtcttaaaaaataaaaagtgttcttttctgaatctacctggctggtgttggggagcagcaaccttcggtttcctcatcagcagaatggggtgatgatacctacctcgctgggctcctgtgggattcgagctgatgcatgctcagaggagcatccagtgtcctccctgtgtccaggaggagggcacactggagatgctcaccaatgagtatctgtctctctccttactcactgggccctcttggtagctcccagggcctcctgcccaccttatacccagctgcccagtggggagggagagctgggaaccaacctgaatgtgtgagggtctgggtgtttggtggagctggggttggggctggcttggtgatgagtgtatttcctgtcactttcaggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataatattttaattgctcagtgatgttccataacccggctggctcagctggagtgctgggagatgagggcctcctggatcctgctcccttctgggctctgactctcctggaaatctctccaaggccagagctatgctttaggtctcaattttggaatttcaaacaccagcaaaaaattggaaatcgagataggttgctgacttttattttgtcaaataaagatattaaaaaaggcaaataccatccaccatcactatcatttcataaaaagataaaatttcaattccaataaaggaggaaaggtataatttcagaataaaggacagaccttaacattcaatactgcaagtaatgagttgtaccaggatctactcaagagatatgaattagtctaatcgaccccgcaaagctttatttaaaagattccttgttagaccgagcacggtggctcacacctgtaattccagcacgttgggaggccaaggcaggcagatcccttgaggccaggagttcgagaccagcctggtcaacatggtgaaaccccgtctctaccaaaaaatacaaaaaatttagctgggtgtggtggtacatgcctgtattcccagctactcgggaggctgacgctggagaattgcttgaacctgggagatggaggttatagtgagctgagattgggccactggactccagcctgggcaacagagcaagactgtgtctcaaaaaaaaaaaaaaaaaaaaaaaaaaagaatacaggccataggcagtgctgtggtttgaatgtgttccccaaagttcatgtgttggaaactttatctccaaagcaatagtaattaacaggtgattaggccatgagggctctgctgtaatgaatggattcgtgctgttatcacaggagcgggttccttatagaaggatgaatttgtccccccaccttttatttctctccctctctttgctcttccaccaggagatgatgcagcaagaaggccttctccaggtgttaccccctccagcttagacttcctggcctccagaatggtgagccaataaatatctgttttgttttgaataccagtctgtggtattctgttgtagcaatacaaaatggaccaagacaggcagtacacctgttttcagaaaacaagtgtattgtattctatacaacacattctatattatattgtacattcttttttttttgagacagggtctcgctctgttgcccaggctggagtgaagtggcatcataatctctgctcactgcaacttccgcctcccgggttcaagtgattctcctatctcagcctcctgagtagctgggattacaggcatgtgccactacgcccagctaattttgtatttttagtagagacgggtttctccatgctggtcaggctggtcttgaactcctaacctcaggtgatctgcccgcctcgggttctaaagtgctgggattacagatgtgagccatcatgcccggccgagagcaaaaatttattatctcttatggttctgcaggtagactgggtttagttgatggttctcacgtggggtcttccatgtaggtggaaatcggagctagagtaatctgaatgtttgaacaaactcaacttctacggtagcttgcttaacatgcgtggcaactgatatcgaatgtgagctgggacctcagctagaactgccagccggagtgcttaccatggcctctcgatgtggcttgagcttcttagagcatggcagtagggtcctgagaggacaaatcccaaagtgagcattgcatgaggcctacgtggaagctggtaggcttaagatttattaattttaattttaattaaattaattaatttatttttgagacagggtttcattctgtcacccaggcccgggtgcagtggtgcaataatggctcactgcagcctccacctcccagggtcaagcaattctcctgcctcagcctcccaagtggctgggactacaggtacacgccaccatacctggttaa

SEQ ID NO: 17114 - DNA, 24018 bp, Human
cggctctgcctagctggctccttctcaggcatcagggcctggatccactgtggctcttccaagcctctgcacttggagtgcctcagccccgtggttgaggagtgccccaaccctgtgaccctctagcaagcatcctaggaattccgtccctccccagcactgatatgaccatcgtgctgtgacacgtgtcatctccgccagagttgcagatcctccaggggaggggtctgctgcctggctcccacagccagggcctggaacagtgcctgacacacagcaggcacccactaaatatttgatgcatggctgaagaggacaggcaggctggctgctggctgggcatggcctgcttctgaggctggtggtcaaggacacagtgtgcatggatctgccccctcctcccacttcctgagagtggagccagtgtctccctccacctaccgccccctgctgaggacacagctcacacctttaacgggaaatgtccccatcactggggacagcagggagctgatgggagagcaggtgtccaggacatccagagaaatgtttcctcacactggaacccttttctattcccttctaaacaaaaagaatcctcgaagactctcaagtgaccatatagtgtcttttcttataatgtcacttcgacaggcacaaaatgtaaaaccaggcataaactactagtgcttgcagttcttacgcaggcatgaagccaaaaccagtttacaaattaaccaccaagaaaaccggtagagcacagatgatgacgatagagctgttttgtccaatgtgagcgctactggccacccagggccatgtgaatttaaattacgatgaaacacaatgaaaaatttggttccttgtggccacatttccagtacccagtagtcatctgtgccagggggttatccaggtacagaacattcccatcgttgcagaaggttctatcagctagcactgggttggacgacacttgccaagacgagctggctagaggatggttctccggacctggtcccacgtggttcccaggtaagcccccgcccaggatgcagccccgttgtccatcagttttcttggagagggcatgggaaaccttcgtcagtgtgtcatctcctgcaaaggccttcgctccttcctctggggagaaagcacccttcactctctgaatcattagcccaaagcagtaagtgcagcaggcctggccccacaccttccggaagagccacggtgtgaggctggcatccctggggcacgacacaaccaggatgtagacgaaatagatgcaatatctggaggttctcctataggtgtctctggcctcctggacacttcacactgttctgggagctgccctctcaggccccagtgaccttttcagatgcagactcccacagcatgggtcagcaattctccccttccgtgagacagggattggttacctgtactaggaccttgaggccaacactgactagggggcctcatgcctgcccaggttccagccccggagagcaatgtgagcaaagcttgctgtctttgcaaagccaaccactgtggcatcaactccttcaggaagccctcccggattgtccaaggtgctcacctcctttggggagccctcccagattgtccaaggtgcttgagggagggaggaatgggttgttctcccggcaccggggctgcactcctgggcagacgctgcatgcctgtcctcaggcgcggccctgctgccacccccttgggggctcggagcgcgacagcagcttggggacgcctcccgcgcccagcacggtgcacctgggccctgaggtcctggccgaaacgcgccaagttgggggtaggtgcagcgaccccatacccctcggctgcgcgccctggcggcaggaggcggggccgggggcggggcgtgagctggccggggcggggcctatggaggggcgggaccgcggcgccctataagtactgcggagcgaggcgcgcgcccggccagagagcgagcgcgcaacggcggcgacggcggcgaccccaccgcgcatcctgccaggcctccggcgcccagggcgcacggcgcgcccccgtgccggcggcccctgcgcccatttcttggcgcccccgcccggtcggcccgccaggcccctttgccggccaccagccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctgggtaagggctgcgccgggggccggggcgggagggggcaggcacacactccacgttgggcaggtcccgcggcagcgtgctaggccccgcgggcgcagcgcgggccgcgaagttgtggggccacctgtgggctccaggagcggggtggggggtcgcccggggccaccgcgccccccgacattggggctgagggctgcgagccgagtttcggggcctctgtgctcgggggcccacctctgcggccgggccggggcttctgggggccgccgggcagttcccgctgtggtggtgatgggtgcggtggtcgcgggtcgggacccgagtacccggccgcccctcagctaaggaggggcctgcgcgggtccctggccgcggattccggactgctgcttcgcggggacgaggggggggctcgcgggcgggactcctggcgccccgcccccatgagctcatcaagagccgccgcccctggatggtggggcgggggcgcacactttgccggaggttgggggcgatccgcctcactctttccccagcccagctcactctccaatctgcggtcaccacccgagaccttcctgggggtcgcgcctaaaaggagcgcagactcccgccgggatggcccagaagctggggtgcgcgcaccctggccgtccctgcctgggagccgatctccctctcctcacccagacacgttccagcggaggcctcctcccagaagggctctggaggcctcgcaggagtggggatcccgcggttctgagttggcacaaggaagagagtggcaccaggggcctggagtggatggcagggtctgggagtggggccgctgctttgcaagaggggcccccacgctgggcatctttgggtgccagcgtgggtggaggagggtcttttgctgagaatggctttctcctgaccgcagtctttgctgctgggaagtgactgatgggctatcgccttttgtttccattctcctgtcggtgttagaattggggagggggtggaaatcccttcttggcctggaaggactggagtgggtgtccatggccgcggcctccccgtggccacgcccctgggcatagactgcaagcccctccccgtgccccccaggctgtcacccccttctcgtggaagactcggctgatgtcccagtggaccgagtgtttctcaagttgaggcagggagggcaaactttttaaatggcccctggagccagtgtgtgggaccagagacatctgtttcccatctggacggctgaggatcccagtgcggatgattatttggagggggaaggacggaggctgaactgaactcttagctgggagatgagtggggcagtcacatcccaccttccccaagccgggctgttctgcacagcctgcttgggacgctggtgggagtcactgtggccttcggcactgccctggcagtgggggcagctaggccatttgggaggggctcgccttccccaggcccggccctgggacctcagcggttgcttagtggtggcctgcttcagcccaggcatgtgggagaggcaccagacacaggatgtccctctgccagcccctgaagccccgtcccctgacgaggcgagtgtggacctgggggtgggggctgagggagactgtggacctgggggtgggggctgagggaaggtgtggacctgggggcaggggccgagggagggtgtaggcctgggggtagtaggggctgagggagagtgtggacctgggagtaggggctgagggagggtgtaggcctgggggtgggggctgagggagagtgtggacctgggggtaggggctgagggagtgtggacctgggggtgggggctgagggagggtgtggacctgggggcaggggctgagggagagtgtggacctaggggcagaggctgaaggggagtcacgggaggggacttctccggaggtggatttttgctctctggacggtgtgtcagcactgggtgagcccctcctgcctgcccaggctgagaggtctccctggcagccccctgggagtgtcgccagggcgggcctggaagtttcccaggcagctggggtggagacctgacacatcccaagggtgcttgttattaaggctcaaggaaatgtctctgaggcctcaccgctcctctccccagggcctgctccctgcaaagcattgagaactgagtccgtccacagtcactgtggacccacccatccactggggctcagtggtagccagcaatgccaggctgggtgaggtggggttggtgggcaccaccctggtggacccccctccaccctggtgccgcagggtgtgtggctgagagcacagtgccatgggcttgggcctccttggtggagtccccaacacactgctctggtcctgggcctcggccttccccgtctgcagtgggggcccacagtgagcctacctcctggtggtgttggtggatttgctgacatgcctgagtgttgacagggggcttggtgcaggaagggctcagggcgtgggtgttggccaggggtccaaagggacctctgcctcagagagcccagcccagacaggcaggatgtgcagtggggaaggggctgcgggaaccctgcagggtccagaaggacacagtgcagtcctgtgggctctggggaggctggtggggaggaggttgacaatggatatctgggtggggcacttgttagaagttccattttagagaggaaagaggccttgcctgtgggagaaggcagctggggtagcctgacctctttcccaggaaggagcccacacacacacgcacaggcactcacacacacgaatgtgcacacacgcacactcccaccttcacacacactcacactcttgctgtctcccttcccaagccaaggtgcgagggggaaggtctgggcagcatgcacctgcgccctgaccgctttgggggccagtgagaactgggctccctgggtgcgtggcgggcccaagcagggaggacattgcagatgccctggccaagcagcgtggaaatcctgtcccttgggtgggtctcggagcctccatcagaggcggctggcacctgagacccacctgctgccaggagcagggcaggagagtttgtgtcccgggacagggaactggcctgtgggagccttgccttcctcatctgtgtaatggatataagagtcttctcctcgggggctggccagggagtccagaagaggtgtcaccagtccccgcagggagaagagcggtgtcccccgcctgggactggctgctcccccaagctaatgcagctggtagccacctcccagtggcagggcagccaaacccggccgggaaagagactgattagaagcctcgctcacgggtatttctcgcttccagacagcacatgactgtcatttggcacgtctttcgccgtccttccgggagaggggctgcaaccctggcaggcgctgtgggggagggggctaggacatcctgtgcctggtttcaccaagtgggtgtgtggactttccctggctcccccaggctgtctggctgcacagctttggggaaacggccactgggtcaagcgggccgagaagaggaagtctgtggtttgtctctgctacagactggccccagtgaggctgtccagcagtgcagggcacagagcaaaagcagggaggtatgggcctacttccccggtcgcccctgtggctggctgtggctctgccgggtgctgacaagtcactcgccctccctgcggtcaccagggtgcatgcccgaaagccctccattctttcctgggtttgagggtccttctcctgcacccaccccagcgcccagttcagctcaactttcagaaatctggttcacccccaatccctttctcataactgcttccaagcccagacaaggagacagaccccagaagatccctacccctatttccgcacctgaaatcgcaccacgggaagagctttgctcatagagtcaataaggcttagagtccaggcgcctgtgcgagggagcaggtcatcacccttgtacccaccgtggttttagacaggaccctgaggttggggtggggctggggctggagaggagccaggtgccctgccccttgcttgggccccgtgtccctgtgatccaggctgggcgtgctatgggtgctgggtgatattccagccctgcaggtgtccgccttgttcccagcacccctctgggcaagaagaaccaggctctcccagaaatgggcttcagtgatctccacttccaagtcgtccccacctgccttgtaggacacagtggtacctggtatgctgggcagccttccaggaacctctggacttactcagtgtcccccagccctacacaccattctttgtgtttctgggcccaaactaagccccccaacctgggctgcagagcaagtgctgaatcatgagagacccttgagggtcctccaggtaggcccccagtgctggaggagtcccctcaggcagggggccacgcccaagggtgtggaaggtcagctggcagccggatctcacttttggggctgtaggcttcctgcactggccgccaatgccatggccgtgggatggccaggataaggcatctgccccccacccccaccccccgcacaaggtctttgagggctgcgggctcaaggagttggcggtagggctgggggaccaggggcacagagcttgtaagcgcctctctccaggatgtgggtggcccagcaggggagctttgagagtccaggtgtgagattccaaatgctaggggcctgagaggagggagccaccagcttggccagagcctggtggatcacgcccccaccacgccttgcccttctctctggtcatgtgctctcccaccacgtttggaaagttactgcttccctcttcctcagcccctcgggctcccagttatggaagtggcgtgattcagagaaggtaaaggatgggagggagagggctgggtgatgggggaccccgcagggcgccctgtgctgttacatggagctccaggatcagggcaggtgggcagcctggggtcctcacttctctccccagccaggccaggtccctcacagccctgccaggagcatgatatccgctgcggtgcagaactaatctcaaagctcaaacccaggtaacagtgtaggtaaaacagatgacagggcatgagactcaccccaggacaggcgaaggacccaggccgatgggggcccagaacagtcctgatcctggagctccttcccgagtgggaccccaggggtttccgaggggcttagagtagggcttagaggcttagagtagggctagggacttcctggcttccctgcctcgggaacagctggtcctggaaggggcttggtcctcggggcactggtgcccaccacccctgatgcctgggagacaccagcatcctctgagcatgtgtgcgtcctcctggtcccgagggaagtgactcctcacatcccccagctggcggggccagagggccagcatcctcgcctgacacctatttttagatgctgagacaggcggcttcctcggggccaggggccctgtttgagtggagcttccgcttcctggcctaggagagaattcctgctcctcttccctccatgctgccttttcgcccctggaggccacaacggggtcagaggggcagctgctcaccacctaggagggcctgagagggccctacgtcacccagggaggagtctggccccgtccccaacctccacacccaggcctggcactgccccttattggtgggcagagagtgaggggttggcctgcagggacccaggctggaggggccgttcacctccggcccccagcgtcccttcctggaagcaccttggtgagcccctcccctccttcacccagtatctccaggggtacttcctcctttccttcctgcctcagggcctcactgtcctcctggggagggtgtctcaggccccagcacctcccagtggctgagccgaatgggcacttcccggtgtgtttcccatatgtgcagtccctaggtgtcggtgagcaggcacagagcccgcagcgtggccctgcctggtggaccccctccccaagagcatcaagggagggcctggactagagacacacagatgcccagcctgtacgtaaaggcgggtgagctgatgtaccatcgtcctcgtcccccactggggtgcctgggcaggacttggggtgaccacttggcccgtctgggtgggggtaagatatgggtggggcgaccagatccctgccctttcctgcagctgtgggggtgtgtgtgctggcctggagagctcccacccgaagttctggctcctggctgtccggggcctgcgggggcagcgagcagctggcatgggtaggggagctgacctaggcctgcccgggcagcgcctgctgccttttgctccctttcagctgcttcttggaaacagcggacaggctgggcaggaacccagtgtgcttggcagccccccttttaaagtcgattctgttatttattaattcccaggaaggagaaagaaagaaacaatccttcatagagtacaaacactgcttttagtagccttgcaaggagccctccaggaaccccacaggttacctgggctccatcctgagagccaccctccatccccaatccccagcagagcatcttgtggggtggggcggcttgtggggcggggcgccttgggaggcggggtgtctcgggaagcggggcgtctcgggaggtggggtggcttgtggggtggggcatttcctggggtggggcgtctcgtggggtgggacagcttggggggtggggcatctcgggaggcggggcgtcttgtggggtagggcggcttgtggggtggggcatcttgtggggtagggcggcttgtggggtggggcatcttgtggggtgggacggcttgtggggtggggcatctcgtggggtggggcatctctggggcccggccacttgggaggcggggcatcctgggggcggggcatctcagagggcgcctccggaggctggagtatcttgggaggtgggagcaggtggcagagaggcttcccacaggtgagctttgagcagggaggtgcctgtatggatggctctgtggggagaggggtgacaggagttccagattccggcacttatgaaacctcacagtgatggagagccgagtgctgctgtgcaggctaagttgtgtgcatgtcagcttctgcacttttatttccttgtttgtagacaaggcagagagaagctgagatgggcctgaggtcgccttggtgaaaggcactcagcagccagggccttgggctgccctccctcatcaccgtgaaagcgggactctcttttaactgacatcgggctccatagttactccagtcctaactttgatggatcctaaaagtgcacttctaaggacgcggcttcggtgtttcccatgccgctgcttgcccctgggaagcgttggctctgcctcggaagaagttagcgccaagatggcagcctggggtctttggggcccagaagaaacactggccccggggagttcagtcatcagggacttaggatgtgggggcttttcaaacagctttatttagacgtgattgacacacagtaaatacagatgtttaagggtacaacttggtaagttttgacaaatttatacccccgtgaaaccatcaccaactccccaggtgcccctggggcccttgggatctctgcttcctgcccctcctccccgtcccagggcaaccacgggccgtcgctgtgggtgcacacagcatgcatttcttcaacaagcggactcagaaggcacttgcacatcgttgctgttctgcctctttgcttcagcatgattacccagaggcgcacccgtgccgtggcctgcccgtcgtctatgcacccgtgctgtggcgtgcccgtcgtctgtgtggcatgcctgtctgtgcacccgtgctgtggcgtgcccgtcgtctgtgtggcatgcctgtctgtgcacccgtgccgtggcgtgcccgtcgtctgtgcacccgtgctgtggtgtgcccttcgtctgttccttttattgccgggcagggttgcacccacatgtgcaagccagcgacggaccccaggttcacccgttcaccggtcagtgggcatatgggttgtttcagtttggggcatttacaagaaacgttgctagaacatttgtgtacaagtcttgtgtgaacctaagttcatttctcttgggtaaatacctgtgcgtggagcagctgggtcatgtggtgaatgtgggtttcactgcttaagcagcagttttacataactgccaaactgttattcaaggtggctggaccgttttacagcccccgttgtatgcgtcccagttgcctcccccagcagcatgtggtgtggttggtctttttcgtggcagccagtccactgggtgcgctcggcatgtggctgcagcttgacctgggtttcctggtccctggcaaggtggagcatctcttcatgtgcttttttgctgtgtgtggatcttgcggggaagggtctgttcctgttttttgcccatctttcaaagattgggttgccagttttcttgctgttgagtttggaaagctctgcatacgttcagggcacaggtcctttaccaggctctgccccaggtctttcggagagcaggtgtctttcgcattcctgactctggggaacctctagccctgccacatggggtttgttatggggcaggggcacctgtgcctttcccaccacggggcttggggatttggtgctgccattgccctccctcgtaggtggccctaggggggtccctccgcctccgtttcctcatccagaaaccggcagtgaccatcaccaccattgttgtcacctagctccagctcaaggtccctgctgaaggtcggagagcttggcatggccccgtttgtccatgctagggctgggaagaccaaggctcaggtgaggcctctgcccagtgcctggcactccttcttgccccatttttccacccagggtggctcccgactacttctggtagcctcggggacagttgaggtggacaggctggcgtcacccccatttccggctgtccctcccaccccctcctggcccagctgttctgccctattaaaagtcacatgggccctcgggtccttcctggtgttggcccaggctctttcaggccctgcaggccaggaccagccttccctgcaaccctcggcagaggcctggggccggggcttgtctaggggcagcctccccatacggccctggagtctgaacagaagccccttcccagagcacagcaagaagctgcaacgtggcctgaagtcccaccattagcaggtttggggtttaggctgagctttgccatcactacctttctgttaggacggtatgcccattagatgggatcatcccctcagcgcccaggctagaggaggggtggtccctgcccagccagggagggctgggggtggatgggcctctacagagcagcttccgagccaggcacggttccatgatcagctctgttttatagagggggacactgaggaaccgggagcctggggaccttccagtggccccacagctcctgtggctgagtcagggtttgtcaccaggcctctgtggggatgaggctcccccatccacctgccccactctgtcctggaacagctctcaaaacggtctctggaccacagtttcaaaacaaaataagcaatgttttcaaaggccctggaggaagccagagttaccacggcaactctcggcctcgccacctcctcccgccaggctgcatctggagccagctcaggagggcagcagggtgaggacagccaggctctctggggccaccccccagcccccacccttcctgcctctcctgcactgtccacggccctccctgtgctcccacgggtataatgggcacagaagaaccaggagctgtctgcccctgcaggattctggaagccaggggcccctggcctccctggggccttgtcatgtgaggggcacacgtggggtcccagctgccacatggcttccagcgctgcccgcaggtgtatgttgggcccttggtgactctaatgcaccttccactcggcacagaagagcttcagtctggggcctgggcgggggaagtaggctgccatcctcgctaaaccaaagtgtgaaaattgagttgaaactcccataggagggcaggaggcacagctcctcagaagaaggtctgagaaaccacagcccaggttgttgtgtcgggtgtgtggagaaggtgctctggcagtcctgctacagggggaccatcaacagcccctttggggtgagagccccatggctgctggcaccagcagcccctatgaggcttattttatttttgagacagggtcttgctctgtcaccgaggctggagtgcagtggcacaatcataactcactgtagcctcaacctcctgagctcaagcgatcctcctgcctcagcctccaaaggtgctgggattacaggcgcttgctaccacgcccagccccctctggccttattgtttgccaggcccagctcaggtcccggaggaggggagacaggagtgtgagggaaagggggaagaggtatagagcccccagctcctccacccacccgaaccctcaccgaggccctagaccctagaccggcctgaccggggggtcctcaggccggggacttgggtgcaggccatggtgctggggcctgaagctcacgctctgctgagcacagccccctgcccaaccccaccctggggccctgcttccctggccagggccattggaacaggagtggggctgtccaggtggtgttcttgggtccagccctcagtttctcttctgcagttgaccggcagccctgcatctgtggtggggtcggcgcctggtgctggtgaggcaaggcctcagctgctgggacaggacctgcctggcacccagctggtggcagagccaagcattccgactcagctctgggagcagctgccttctgggctggcattctccgccaggggggttgtgccctcgtggccccccccgggtgcctcctcacctggctgatttcatctcctgtccccctgcctcctcctccaggaagcccccagggcctggccctccttgagagtggcatggaggaggaagaagactcgcccaggcccatgggagttggatggtggccgcacttgtggggccctgaccccataggcttcttcagcacgccctggcctgggtgatccctgcctgagggctgtgcacggctcatctgccagaccagattttaggggattcttgtactgtcctcctggagcagcagggggtaaagcctgacccacccagactgtccagcaacaagggcctcctgctgtgggccagggaccctggaactgaccaattgtgtcctagggacgcagagtccccaggctgctagagggctgtggggccctgtttcatgcctgaagcaggaagaaaccccaggagaggtctgaaggggacccagcccccaccctgtctagcagggaggagcctctgcaagaggccgaggggtgctgaagtggaggaggatagaggcagcaggactcagggtcactggtcatttatggggatcacacggctgcagtgtgccctgcatggtgctaggcaccagggacagcagaggacaagcctgtgtcctctcccaccaccagagggctgggcactgcccctagggagagagggggccttggtgtgtgcagaggggggcctggggcacgtgcctggcctggtcagatgatcagagtgggctgggctgggcctggtctggggcccagtctcaagggcagaccccacctggctagagttgattgtgtgcacaccggatgacccggcgttgaaggcctctcctctctgtgagcctcatccccacctgccagactcccagcacagcctgcttcctgccccagctgctgagcgacagcgctgggccggcttcttagcgccccttcccccagcccatcttggaaaccacagcagtgtccttcctcccaagtcccttcccagggctgacatcccacagcagggatgtatcccacaaaccccgcaggccctggtgcctacagcttggcctggtaacatcaaatcctaccctctcctcctggcagcaaagatggggtgcccccaccccagagttctcagcacccccagacagaagcagtcccccagcgacctcagaactcttggggcgctgccacacccttgcaggagggggcagtgttcctgggatgctcaggtcctggtatcacctctggccagatacggaaggtgaaactacagggcatccaattcaccttgaacttcagataaacaccagattatttttttgtatgtcccgtgcaatatttgggacacacttaccctaaagaagtattctgttttcatctgagaggcagatttaaccggcgtcccgtgtcttcctggcagtcctgccctggagtcacactccacaggtgcagggcagggccaggctccaagtagatggcggccaaagcacccgccccatgctcctgactcccggggctcttcagggcattgcgaaaaccagcagcagagctgacacctggtccctgctcgggagccagcaaggcaggaggctgcttaggccttgcgtgtggggtgggcgcactccctgctgcagtgctcttcgtacatgtgacactgttcccgctctttcccagctggctggaggcgtgatcctgggtgtggccctgtggctccgccatgacccgcagaccaccaacctcctgtatctggagctgggagacaagcccgcgcccaacaccttctatgtaggtgagtgcacatgtggccgcagacgcattcagggagggcttctaggaggaggcaggtcctagccttttggatggggacatggagggtgaaagacagtcgggcatggcgtgtccgggcagggaggcggccctggaaagggctctgggcacaagggttgagatggaggtgggcctgtggcctgctggcccttctggtctgagccagggcagggggtggcagctaggcctgggcagggactgtgtggagaccttgcttattttaagtgtggggttatttcgggggaggctccctgagaagggtggggctggatgcctgggccacacagagcagccgaggcagctggcgctgtggagcccgggagggagggagggatggagctcaagggatggaacccagtgaggggtggagacggggcaggggaggggtggagaggggtggagacgccccagaggcggtgtgactcagctgcccctgcaggcagctgcaccttgctgccttattaggctgcgtgtgggggactgggctgccctccctgcccccaggagcaggagcaggagtgatggaggaggaggaggggaggggcaaggccaggaggaggaggagggccatctcactgtgcagagagcagcacccttcctcctggtgcccctggcagggctggtgctggtggggctctgggagcatttgttgagatgcttctggccttgaaaggaggcccctgggatggctctgttgccctcacaggctgaggggtgggtgaggtgggcagcctgtgtgtccccagtcctcagggcttccctcagccggcaggtgcccccaggcctggagctgcagggccaggccccctgccagttacggaggctgcttggcttggttgctgaaccagggccccaggaggccgaaatagccccacacctgcgccgtcccacctctttgtccagtcaccccagggccaggtgagggccctggccacacagcgtgcccgttccttcttccccatgccccgctcatgggtcagagggccggtgctggggtccagatggtgtcaacagggatggtccctgtcctccccagagacagaagcctgtggcccacggagggtttctgggcccagccgatcctagggagggtcccatggccctgcccataggttcctggcctctctcggggccgtggtgccctcacaggtggtgtcaggaaggacgggaaaggctgcttgtcccaggggctcatgtggagaccaccccctgcacgcagctggggcgctcctgcctgtgtcctcagaagcactcggcttagctttgcccatgtgcctgggctgtgggtggcagagcccggccagcatcctccgatctccaagggtgcatctctactggaggcccctcctgggcctcttgctccccgcttcccagatcattaggatatttggggtccagaagggcctcccagccatcctgggccttgtcctccggggccaccagtccagccagtgacaaccacagcatccccggcctggaacgaggctgcccccagcacgttcctcgtactcctgtccagggacaggaggggctgcccctgccaccgagtccccttctccaggacctggggcctgtgggtgtgaggcaggtgttcttggaaggggtcactctccaggcacccggcggccaaggcttgtggctggagcagctcccgctgtggggtcggcgtcgggccccgtgtggccggagaggagctgaagggtcacttagcttcgggctggggcgaggacaggggacaccccagagaggtatgccaggcctccttcctgcgccccactctcggcagaagcagaggtcacaggctgtgctgaggccccatggtgctgcccccatgatgccagggtgaggctggcgttggaagcaggtgtctgacctgcatggtgtcaccgtggccacatcagagctccagccccagagccgcccaccctcggtccttggctgtggtttccctgggctggaggagcctgccgttgtgttggccacacgaccacaggacctgccacccccgacgtgggctctgcctgggcccccactggacagggaccccttggagctcctctggccaccaagtcctcgcccattccagaatcggccttctggagcctcttgctgtccctgatgcgggctgggccttgccaagggctttttttcctgcgccgggaacagggtggatttgctgggctcactcccctcagagacgctgcgggtgcggtgggttaggcccaagggcgttaagagaggaggctggggtggggctggggcctggcagggggtctggcagccctgggcctcccacctcctgtcaggaccaaaaaaggcaacgcgcctctcctgacctgtaccccggagtgaacccaaccttgcaacccaggagtgtcagggcctgaggggagggagacctggctcctgggtgccgtgcccgtaaggaggtggccacctgcagggcattcctggcagaggcttcatctggccaggtaggaggctgggtggccgagccccaaatctgggtgtgttctctgcctggcggtgggtcctgccccaggcaccttctcctctgggctggctgggcagggacaatgggcctggctgcgaggagggggcctgggctgccttctgcattgcctcggtgacgggagatggcccctgcctgctgagggataggggagtgggcaggcagtgagagacactgacagctgtcccgcgggtacagggccctgtctgggtggccaggcccatgtctcgggcccacagtgcgccccccacccttggacggcgccttctccctccccaggtgcatgctgcccagccagggagcgtgggggagttcgggagggctggcctacacgccctggtccagctgtcccaggtggggtgctgggcttcagccctcagcccagggcctaggaagccaacttgatcctccccacacagcagccaggttcaaatgcaggtcccgtaacggaagtgctgctgtgcagcccagattggggggcaggagccagcagggcccccccaccctcttctcgcaccacactggggaggcagcattggttccagttccggttcctgggctgccctctcaaccccggcctacagtggggcccaccctgtgccttctgatgccactcccaccccacgccaagtcccagaggctttgggagcgggtgaaggcggtgggtggcgggtggcaggtgcaggcggtgggtggtgggtgtggcaggtggcgggccccaccgcaggtgtcatccctgcgaagcacctgtcgccagcactcagagcgctcatgaggtgcccagtccccatgtggcctccttagtctccgtcctgtgtcatggaagaggtaactgaggcacagaaaactcaccaggccaggctgggatgtgaggtcccttgctgctcatccctggcagtcagcaaccctacatcttcccagctgggcggcccgtggtgggttcggcacccaggaccctccggggtcttgggctgtggcgagtgtgtaggcacccacctggtgtctctctccccgcaaggcatctacatcctcatcgctgtgggcgctgtcatgatgttcgttggcttcctgggctgctacggggccatccaggaatcccagtgcctgctggggacggtaaggcagggaggcgggcctgtgcctgggccggggaggggctgggggctgcgtctggccctgaggagggggcagagctggtgctcagggcggagcctagaattctgggggaggtggctcctgtgccctgcttttcccgtttggtttttaaattaaatcccaccgtgcttggtctccatcgtggccagttcctacgtgaccgcttttctttgtcaaaaaatagccacaaatataacagggagcaagcctcagctctgaggccagcctcggcgtcccgggcacaccgccccctgtgggaagcccaggcctggctgtgccatccagggcctggccagtccaggaagagggagcctatgcccgtgtctccagtgggggaaactgaggcagatcccatggctcccccttccgtggggagcaggaacaagggggtggggaagatcagtcaggggtcatgctgctgcacacgcctccctgggggctgcagacatcctggactcaccagcctgtgaccccaaaccacacgccccgccccatccaccccatcctgtggagcctggtgccgcgtggggacatcctgggctttgacggctcctccctgcgctgagttttagcctctgtgccccagggctccacacaagccgctcactcctggtcaggtcgtgggctggtggctcccactagcccctcacagacacgcctgctgggcacctgggtgtgtgtccttgggccccgcctacagcctgccctctttcctccctctggccactgcccggctccagttcttcacctgcctggtcatcctgtttgcctgtgaggtggccgccggcatctggggctttgtcaacaaggaccaggtgagcctgggtgtgcagggacagggtggggtgggtgacgggggcaccctcctctcctgtcgcgggtgggggttgggctgactcatggcttgtgggagctctttgggctcttcctgggtcccacttgccaggaggatctccaggggctttatggaggaggcagcattggggctgagcaccaggccagcctcccgtgtcccagcactcccggggcagctgagagtgcagagtccttgtcctctggggtctagcctcgaagccaccctgcccagggagagcctgggaaaagtgcgtccgcctggggcggggcggggtgggggcaaggagggggaggttccccctgtgcatgtgaccgcacccctcccccagatcgccaaggatgtgaagcagttctatgaccaggccctacagcaggccgtggtggatgatgacgccaacaacgccaaggctgtggtgaagaccttccacgagacggtgcggccccggggggcgagggcggggagcagggccccgggaacccggcggggtgtgtctcgtcctggatgaatcctgcctacgcccagacctcaggagcaggaggtgcccttgggacctccaggacccctggtctcaactggtcctcgggtgggaacctagtgggccagggtggcccagggtgcggaaagctctgagcagcgcagctgaggaggaagaaggctggcccctggatgcattctgcagtggggagcgctgcgtacccctggccacctccccatgggttccctagagccaccgtccccctgggcacatccagggctgaccttgcacccctgctctctgcagcttgactgctgtggctccagcacactgactgctttgaccacctcagtgctcaagaacaatttgtgtccctcgggcagcaacatcatcagcaacctcttcaaggtgcgcgaggccggtggggccgcgcctgaccccccgcatgtcccgcccctgggtggggtcctaggggtgggcaggtcacacggcagccccacagggagcgaccacactgggtggcatggcccctgtcagggctgctctgctgggagggttggggtgggaccgcatctggcccacgaggaaggcaggcgccctgtgctgcgcattccgggtgaagaaggtggaggctctggggggtgggaactcacctgcacccccagctccacgtgtgcactcgtgggtgtggacgcccctgacagcctgtagctggcagggcctgcaggccatatagtgccctgtggaagtttcctgctgaggcctcagtggaagtcgtcatcagtgatgctttaggggtctagtgacaccaatgaccgtgatctcagtggaaaagggcacagtgtgtcccaggcatttcgcgtttatgttaaaacgggtggaagatagcaagccggcagaggccgggccgctgcacccgcctgttccgaggtgggtagggggtggggggctgttcccaggattcccctctacgctttctgtggtgaccacggattactgcgtgacaacgggaagccgggagccgaggcccggtccctgaccacgcgtgcctggccacccctgcaggaggactgccaccagaagatcgatgacctcttctccgggaagctgtacctcatcggcattgctgccatcgtggtcgctgtgatcatggtgagcgggcgggggcggagggcctgctctctgggctgccccttccgcggggccttgtgctgactgcgccccccaccaccctcctgcagatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaccaggcctgtgcagtccctcagtgccagtggtgtctgagacctaggggttggccggagggcaggggaatctgacatcggtggggcttggctctgtggactctgtggggtccagggtgagggtgggtgggtcgggatccctggtgttcaccaaaggagtcactctgtaaaatttggggagttatttattctgagccaaatatgagcaccggtggcctgtgacacagccccaggtcctgagaacttgtgcccaaggcggtctggctacttaattgtatacattttagggacataggacattgatcattacatctaagatgtacgttggtttagtcggaaaggtgggacgatttgaaggggagggactttcaggtcataggcggattaaaagatgttctgattaataattggttgattttatctaaagacctgaaatcaatagaatggactatctgggttaagaggagttgtggagaccaagattattatgcagatgaagccgccagattgtaaatgtttcttatcagacttaaaaaggtaccagaatcttagttaattctctcctggatcaggaaatagacctggaaagggagggggattctctatagaatgtagattttcccaagagacagctttgcagggccatttcaaaatacatcagagaaatatattttggggtaaaatacttcggtttctttcagggcctgctgtcacgttggtatcttattactacagagtctgttttgtgagtcttaaggtctttttatttttagacagagttttgctcttgtcacccaggttggagtgcaatggcgtgatctcagctcactgcagcctcccctccacctcccaggttcaagcgattctcctgcctcagcctcctgagtagctgggacaacaggcatgcaccaccccacccagctaattttgtatttttagtagagacggtgtttcgccacggtggccaggctagtctcgaactcctgacctcacgtgacacaccaggttttgggattacaggtgtgagccaccacaccggactaaggtctctgttttaatgtgaatgctggtcagctgtgcctatgaggcatgttcggccacccacagtcatcatggcctcaacgagcttttcaggtttactttagaatgcatttggccaagaggtgcccattcagttggttggggttgcttagaattttactttgggtttaaaccagggagcaactccaggtagcaagggccctttttgggagcgttctctctattctcttttgggagaggccctgtgttgcctgcagccacttccaccctgccccttgggcacacaaggggcacacagtgtaagcaggtgggcaggaggggtcgggcagccagggaatgcagtgagatgggcttggggtaggggctgggtgcgctgcaggactcctcttcctcctgagggatggtaaaggatggacacactgccccctcccgagcatttgagggtctctgccctgcccatctgttacctgtaaatgttcctttgaggagctgatggctcaggcctgagccacatctcagagggtctggaggggaagaaagacctcatcctactagggagcccccccagcccaccagcgagcggtggttgggggcagacaggctgtggggctaaggagcccctgcactcccccgtccttttccctttgtctgagcacctccagccagtgggcttggtctagactctcctatctttccccacatcgtggggtggggcttgctctgggttaggctacttttccctagttgtggggaggggggtgctggcacatttcactgttccctggaggaaatgagtgcctgggaattcatatctagggctcccagcagcctctttgcaggccaatttggaaactgtccccagccctgcattttagggggttacagagtctctcagcaggccctcctcccctgctgctcccaacttgcaagcctgcactggttgggagaacataatggtccaa

SEQ ID NO: 17115 - DNA, 11874 bp, Human
ggccagaggctgagccttcaggctgaggtcttggaggcaaatccctccaacgcccttctgagcaggcacccagacctactgtgggcaggacccacaggaggtggaggcctttggggaacaccgtggaggggcatagcatctccgagagaggacagggtctgcactgggtgctgagagacagcaggggccgagcggtaggcttccctgcccccagggatgttccaggggagcgcaagggaggggcattaatatcgtggcaagaaagggcaggcattgcagagtgagcagcgacggaactgggttttgtgggatgcataggagttcacccggataagaggtgggtgaggaatgacactgcaaaccggggatcacggagccccaaatccttctgggccaggaagtgggaagggttggggggtcttccctttgctttgactgagcactcagcctgcctgcagagggcagcgaggagccacggaggggtgtgggacagggatgccatggctgaagcagttttaggaaaggtcccaggggctattgttgaagagagaacggggagcggggagtcccacagctgacaggagcagagtgggccctgagagatgccagctctgggtgccacagtgaccagccggggtaggccttcgagaagtcagggagcgtctagggcttctggctcctgctgggcccagggtgtcatcttgggctgccaacaccagaaagcccagcagatacaggaagccccaagccctgtcggaaacggttcttctccaggagggacagcggtggcagcgttcagccgcaggccatgcactctggggccacgtccttccctctgtacagtccagcattgtcaaggcgggctctggccatctctgctgaccccagagggatggggaggcctccccttccaccagaagggccagaagccaccctgggcaggggcatcactctccctgggtggggcagcggctgggagcaggaggtgccagtgggcgtgggctggatgcgggtgcctgcggggcggacatggaacttgggggaggctctaggctggggttgtcctcaagggagttctcaggtcaccccagggtcaccctcaacccggggcctggtggggtagaggagaaactgcaaaggtctctccaaggggaaggcatcagggccctcagcactgagggacgtgcgtgctcttcaaagaaggggccacaggacccccagggaagccaggagctagcagtgggccatagaggggctgagtggggtgggtggaagccgtccctggccctggtcgccctggcaaccctggtggggactgtgatgcaggaggtggcagccatttggaaacgcgtggcgtctccttagagatgtcttcttcagcctcccagggtcctccacactggacaggtgggccctcctgggacattctggaccccacagggcgagcttgggaagccgctgcaagggccacacctgcagggcccgggggctgtgggcagatggcactcctaggaaccacgtctacgagacacacggcctggaatcttctggagaagcaaacaaattgcctcctgacatctgaggctggaggctggattccccgtcttggggctttctgggtcggtctgccacgaggttctggtgttcattaaaagtgtgcccctgggctgccagaaagcccctccctgtgtgctctcttgagggctgtggggccaaggggaccctggctgtctcagccccccgcagagcacgagcccctggtccccgcaagcccgcgggctgaggatgattcagacagggctggggagtgaaggcaattagattccacggacgagccctttctcctgcgcctccctccttcctcacccacccccgcctccatcaggcacagcaggcaggggtgggggatgtaaggaggggaaggtgggggacccagagggggctttgacgtcagctcagcttataagaggctgctgggccagggctgtggagacggagcccggacctccacactgagccatgcccacccccgacgccaccacgccacaggccaagggcttccgcagggccgtgtctgagctggacgccaagcaggcagaggccatcatggtaagagggcaggtaggtgcccggcggccgcagtggaccggagcccagggctggtgccagctgcctctgctactccccagcctggctggcagccccaggctcagggtccatgcaaacccctgggacgcagcgtggatgtggaggcctgggcacagcggcatcccctgtgcctggtgtttgagtccctgttgggggagggtgaggtgatgcctgtccctgtgtgtgcccctcttaggccgacctctctcgggggtcgtgtgggtctctgtgtcttgtttcatcttgaatcttaacgatcggaatgtggaaacaaatccatccaaaaaatccaagatggccagaggtccccggctgctgcacccagcccccaccctactcccacctgcccctgcctccctctgccccagctgccctagtcagcaccccaaccagcctgcctgcttggggaggcagccccaaggcccttcccaggctctagcagcagctcatggtggggggtcctgggcaaatagggggcaaaattcaaagggtatctgggctctggggtgattcccattggcctgttcctcccttatttccctcattcattcattcattcattcattcaccatggagtctgtgttccctgtgacctgcactcggaagccctgtgtacaggggactgtgtgggccaggctggataatcgggagcttttcagcccacaggaggggtcttcggtgcctccttgggcactcagaaccttgggctccctggcacatttaaaatgggtttttatttatggaccttgattgaaatgtggtgtgagttgtagcagtgtcatttccaggtaccttctcagggacacagggcgccctcccccgtcctcccccgccctcccctaccctcccccaccaggctccccatcaggcatcccctccccagggcgccccggggcccagcctcacaggctctccgtggcctggaactgcagccccagctgcatcctacacccccaccccaagggtaagtaagaggggactctgggaggggcttctgctgctccccttcatgttccacaaccctggaagctcaggatgaagctgattcttctcttacaaggggcccagagccttcttgggagttcagctccaagggatgagccccaggtgtctgccaagtccccctctgtccaggcctgggacggctctgggatcgaggggtcagaggcgctgagcccagggagagacacctgcgcccagagctatgacaaagggtggagggatgacaaggcagccaggagcgggcgcctgcggggtggcacagaggggcagggcccgaggacaggtgtcctgatgggagtgtgagaaagggtcccctgtgcggcagccaggagggtaggggggttgttcactggggccctgtgggggcagctccttcctgagctgccgttccctccccggcagccgatgccactgtccatcaagacatcgccctcttcccatcactaatccagttagcgcctggcctggggatgagtgacacagcgtctctgtctgtctgctcgccacagagtggggagcaggcgagcaccttcccagcccccactcctcccccaccaccactgcttctgactgggctgcccccatcgggaagggcgtgcaatgcccgcaggcacctcggctagcatctgccccagcaggcacacagtaggcgctcaaaaacgtgctctcatcccctgcctctgtgtgccatcagcgctgcccgactgtgggaccagctgtgggtggaggtccccgggtctcagcaggtggaggaggcatgggtgccccttgtccccacagtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgaggtgagctggtggccttcgtgtccctggggcaagttcacctgtgggtggggctgtgtgggctgagttcctgacccctctatagcagaggtgcagctgcccaggcccccgaggccggcacaggatgcagcaggggagtctcaggcctcagctcagcccccatggcatctagccacacccccgtgtttttgagggatcctgagcccacccctagggctgaggctaccaagccccactgtgcctcttgccttgcccatcccctggatccccctcacccaccatttcccacgtggggggctcccagcagggcagcacaagaggcaggggcagggcagtgtgccctctcccacccacccagcacagcggctcaggtgaccactgattgcattagtcactccggccccactgtgccccgggaggcaggtgacccagctcccggaagaagctcccaaatgacattaaagccagactccccgccccccagctcccagagccagttttgtggcccgagggccactgcgacccaccgcccttgttgctaggcaacaggaggtgggggtggagcggacccttctggccagtgtcctggacgctcaggggccagtgagactcagggcccatcctacaaacctggatgaggccaccagggttgggggcaccttctgaccagtggctgaggagccggactgtgtggcatggccttgggacacacacaccgagccgcccagaaccaggttaagcctcaagcggtgacaactcctggttaggcacgtaacacaaaatccaacttgccagtggcaaaccctggcctggtggccgacagctgacctgagcctggaagaacgggatctgtgtgctgctagcacaaaagtcaagggcagggcctggccagccagccagatgtgcctccttccccgcccaccccaccctctctctccatctctgtctctttctccttctctctctcttcctgcttttgctccctaagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaagggtgaggcggttttctgtccttgagggccaccaaatgaccttgagaggctggggtgcaggggctcctgcagggggaccctacagtgaccacgtggtggtggcctggttccctctctgcgggctccactccgcaccccgttttgctacacatccgtgtccgggcctggggccactccaggatccccccgcagctctcacagccccggctgcctctgccccccggaagtcttgtaggggaggctgcttcaaggtgggtgacacagccccacggctccgagctcaccaagatctcttcctccatcacccataaagtcccctggttcccaagaaaagtgtcagagctggacaagtgtcatcacctggtcaccaagttcgaccctgacctggacttggaccacccggtgagtggtgcgcccctcactcaggcctcctgcccctgatcacatcccctacccttagcccaaccctggacaggagtctgtcggctccaggagcctccgtggcctgtgcccccaccccagcacagcctcctgacctgtgcatcccctctgccctcagggcttctcggaccaggtgtaccgccagcgcaggaagctgattgctgagatcgccttccagtacaggcagtgaggggcccctgcgctcgggacccagactccgtcctgcaggctgacgctggacctggggggtgggagggaaggacaaaggggaggacccatcttgtcaccagcatcagtgcctcctgccaggcagctctgctccagggctttccatgtccccaaatcccagtggggaaactgaggcccaggggggctagagcaacctgccgaggccacatagccggctcacggcacagtcagctggggtgcaccctcctgtccatcctccaacccaaaggcctcgctgcactaggcgggtgtggacctgtgcccagtgaagctccctccctccctcctgcccttctcactccccgaggggacctgctgaccactggccccctccccagcggcgacccgattccccgtgtggagtacaccgccgaggagattgccacctggtgagacctccgtgcagctaggggctggggaggagcccgggggatgcctcctggaatcctggcgtgtgagggccgcctccagggaccttggcacaacaagagagactaaggccgggaagaagagggacttgcagggctcagaatgttgggttgggaggaagaggctacccatcctgtcgggccatccccagtgtgctgagggaccgcccctcatggccccctatcccctgggattccctaaagccaccagcaaaagcccctcccaggggcctgggtgttcaggggtccccaagaggcctgcgttggtaggggctcaggcaggcagaggcacccacagttcaggaggggggtttcgggcactggggtggggcattagagggccctgagcctggctgcccgcaggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaagggtgtgcccagacgggaggggcgcagagccggggggccggggatggtcagccaagcgccccaccccagcgcggctccagcccgtcccggctcggcagtgacccgcgtggccccttgcagagcgcacgggcttccagctgcggcctgtggccggcctgctgtccgcccgggacttcctggccagcctggccttccgcgtgttccagtgcacccagtatatccgccacgcgtcctcgcccatgcactcccctgagccgtgagtgcgcgccctggccgccagcccgagggtggggggtgcgacgggcggcccctcagcccccttctccctcctacgcgcagggactgctgccacgagctgctggggcacgtgcccatgctggccgaccgcaccttcgcgcagttctcgcaggtacgccgcggcctcggagggagccggggtcacccaggggctggcttggcgccgggggcgggcggggatcgatgtgcgggtgggtgaagtgtgctgcctgctcccgggccccgccaaggaggctcggcgccccgagggtcgcgcggcatagggcggggctggagcggagcctcccacggcctgtgctgccacctgccggctacctgggaacggcgcccacgggcttacgaatatggtcaaggagggctgcctggcggaggaggcccggtgtaggtgcggatcctgggcggccagggaaggtctctgccgcccgggaagtgtcccagagacccctggaggggctgctgacacccccggtgcccccacctcgagcatgacccagggctgcctctccccatccttcatcctcccctgctccacaggacattggcctggcgtccctgggggcctcggatgaggaaattgagaagctgtccacggtgggttgacccctccctgcagggcctggggtgtgggtttgggggtctgaatccaggcctcaccctcttgccgtccaggctgaggcctctccttccacccacgaattgtgaccctcaccctggcctgcctgcatcctggcctggcctccctgggggtggtgtcctggtcacgggtgaccaggggctgcccggtgggcggcagctgtctctgggctgatgctgcccggcttccccgcagctgtactggttcacggtggagttcgggctgtgtaagcagaacggggaggtgaaggcctatggtgccgggctgctgtcctcctacggggagctcctggtgagagtctctccttgctgcagcccccagcagaggggcagggctgggggacggtgcagggaggggacaggctcccagtgggaggaaactgaggcctggacctccaggactcaggctctgtttgggagaaggcttgtctctgcccagtcctcaccccacattatcccaggcctccgaaggcccggcgggggagatgggggtgactctacccaaggaacccacccagcgtcaggccacggtgccccagttccctcggggacctgggtgcagtggagtcagtgatgccattggcctcctgccagcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggtgggctaggctgctagggcaagccccccatggtgcccccaaactgggccagccaggccttccttctggccttgagcagggctggacctgtgagcccaggtcacagatgagaaaaccgacccctggctgcagcagcccccacacagcagggacaccatccgtgagaaggaccccagcgtctggggaggggcagacctacaggactgggggctgctgggtggccgggtcaaggccagtcttggaggtgctgacagagcctgagctttgtgaggacgtcctgtggaacctgtcccggccccctgccctgggatggggagaagtcagggggatagacagagtcaaggtgggggacagggcgggagtggggtccccagggctgggggcctttggtgcagtgaccagagtgtcaggagaggggagcaaagccctctagcctcatcctcataaaaggtctcatcattttccctccagcctcttatgcactggggaaactgaggccaggggctatgtgtccagcggacaggggtgctgaattccacccacaggcttagggatatggtcaaggaaagcttcctggaggaggcccagtggaggttcagggagggatggggtgcccggcagtctctagtggaaaaggcgcctagcctatctcccccatgaaccccctcacccagccctggaagaggcctcagtgtcccgcctgtgaccagttggctcagaaaagccctgggagctctgagccactgtgaaggtggaaacgcggcccctggcctcccctctcctggaggctgcagactctgcccgccagttgacgagggctctgccgctctcctccccaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctctacacctgcctggccccacatctgtgccacagagacagaccctgggatcctcagactcccacacccccaccccagcctcactcagaggtttcgccctggcctccttcctcctctgggagatggctggccgccctggccaggcagctggcccctccgggcctggtttccccgctcaccctgaggccccgcccagctctgagccccaagcagctccagaggctcgggcaccctggccgagctgccccatctccgtggggtgccctcccaaggtggggagccacgtgacagtgggagggcctctctcaggcctggaagggagcaggggtcacaaactgtgctggctgggggtggtctcagaggtgggcctgcaggcctaaccctccctgctgacagggctcccagcccttgagagaaacagggatggaggaacagctgccctgatgccctcacccacccggagcaggccctgcgaaccaaggggaacctcagtgtggcccccagcatgtgtgctgatggggagggtctggctgagctggtgcccaggcagatggtctgggcctgtctccccagcgaggcaggatgggggctggatttcagactctgtaagatgcccctggcttactcgaggggcctggacattgccctccagagagagcacccaacaccctccaggcttgaccggccagggtgtccccttcctaccttggagagagcagccccagggcatcctgcagggggtgctgggacaccagctggccttcaaggtctctgcctccctccagccaccccactacacgctgctgggatcctggatctcagctccccggccgacaacactggcaaactcctactcatccacgaaggccctcctgggcatggtggtccttcccagcctggcagtctgttcctcacacaccttgttagtgcccagcccctgaggttgcagctgggggtgtctctgaagggctgtgagcccccaggaagccctggggaagtgcctgccttgcctccccccggccctgccagcgcctggctctgccctcctacctgggctccccccatccagcctccctccctacacactcctctcaaggaggcacccatgtcctctccagctgccgggcctcagagcactgtggcgtcctggggcagccaccgcatgtcctgctgtggcatggctcagggtggaaagggcggaagggaggggtcctgcagatagctggtgcccactaccaaacccgctcggggcaggagagccaaaggctgggtgtgtgcagagcggccccgagaggttccgaggctgaggccagggtgggacatagggatgcgaggggccggggcacaggatactccaacctgcctgcccccatggtctcatcctcctgcttctgggacctcctgatcctgcccctggtgctaagaggcaggtaggggctgcaggcagcagggctcggagcccatgccccctcaccatgggtcaggctggacctccaggtgcctgttctggggagctgggagggccggaggggtgtaccccaggggctcagcccagatgacactatgggggtgatggtgtcatgggacctggccaggagaggggagatgggctcccagaagaggagtgggggctgagagggtgcctggggggccaggacggagctgggccagtgcacagcttcccacacctgcccacccccagagtcctgccgccacccccagatcacacggaagatgaggtccgagtggcctgctgaggacttgctgcttgtccccaggtccccaggtcatgccctccttctgccaccctggggagctgagggcctcagctggggctgctgtcctaaggcagggtgggaactaggcagccagcagggaggggacccctccctcactcccactctcccacccccaccaccttggcccatccatggcggcatcttgggccatccgggactggggacaggggtcctggggacaggggtccggggacagggtcctggg

SEQ ID NO: 17116 - DNA, 13178 bp, Human
cagcctcaaccccgtgcagaccattgatctcaggagaggcaggcagagcggaagccgcgctggcatttgtgttcaatggcaggtgggaaggaggaagaggaggtctccactggctccccaggcatctcagagaccccccatacttagcatgccttccggaggatcccattagcagactatcagagaaacagggatggaaggagtggtgaggggtctgctccattgtgaccccacccctgcctcgccctgaggaaggacctcagctcctagctcaaccgccgccctccagcagccccagtgatctgagcagcacccacccgtgacccacagctcggcctccaatcaccctcctctccacatcggccacccacaactctgaacccaacttccagcagccacatatctctaagcacactgcacaatgtggctgccgaaagaggcagcattgcatgaacataaaaggaagcctgaggacccccggccccaggaccccccttctccagctccatccctgtcctgcggtctgctccttgggcctggccaagggcacctgctgctgggcaaaggcctgtctggtcaccagcctcctgggaccctgccactggcagcctggagcttctccacctcacgcaggcctggacaacagtggggacggctgccaccaccttccctgcccactctggcccacttctcactccatcctgcttcaatgccttcatgctagatagaccccctggagtcatttccactcaaacccacccatcaggaggaactccagccctacccggcccaggccctcggaggggcacagtgccctctcctcctcctgaatttccatcaaccccagtgccctcccgcagccctgttcccacctgcaggcctgggccccctgcccccagcaacaaccaggacccatggccccgcttcttgctctgaagcatgacacccctgcctcttgctctgaagaacacttagggtgctgttgggtgcgggaacaagccaggcttgggggtggggggcacgggcagttaaagagatagatggagaagtggcctgaatccagccaccaggcagaggaaaccaggggaggagggagaggcctggggacaggggagggaggctgctgccctctactcccgaaaggtcccagcagccctcctggccagcactacccaaggaaaggagtgaggactgggccttggacgggggtccctgtagagagggccttgccagaggctggagggggctggccagaagggtggagagggggtgagcaaacggcaaggcctgaagaggccagtggccctcttggaggaggcgtggtgggagcaccgaggatggacagcgtggctggtgtggccagcgtgggggctgccaaccgggctggccagaagggcgaggtgaggggccctggggttccgggctcccgggtaaaaacagccagatggagagaggggcttcagaccccaggcccggggacccgccctccccagcactacagccccggttctccacttccagctcccagcagctgcaagcgcagcggtgcggggccaggctgtggcctggagctgccaaagggcaggggcacgggtgtggggggcgtgcaggccggggtcccgggaggcagggcagacaggcccgaaagagtgcgacggcggcgggaggtctctggggctgggaggggtgcgggcgtgggcggggcgcgagcagcaggggcgcgggcccgggcttcaggctgtggggccgggagtgcggggcgggactgctgcggccccgcgtcctgtggagtctgcggcgcggggagtgggggtcggggcggggaggaacgtggggtgcgggacaggaggggggcagggagggagaagaaggcggcgcggggcggggcgggcgcagggctggggacggcacgggcgggcggcacgggcgctggcgcgtgcggggggggcggcgcggcctccggaagcgagggggcgctgtgccaggcggcggccgtgcgggggcgggcgcgctgctccttccgcctcgcggaccccggaagcgcgcgtggccgccatggcgcggaatgtggtgtgagtaggggtcgtcacccccccgtcgcggggcgccccttagtgtcacaagcagacggaccccacagggcgcgcggactccggggagcggggtgggcgtccctgggccgcctcctggcccgggcgaggcagggttctccgggaccccctgtcatgccttgagacacgcgaggcgggtggcggaggagccccccgccaggtttagggcaaccccagggggcgggcgtggccgggctggggacagagggtccgagccaaacccatggaggccacggtgcccccgcgtggggagtgggagggtggcccggggtcaggcccggggctggtcccgcagccagggccgagggagctgtttggagacgtttctgatcgtcacggggcgggggccacgtcggctgttgggtccaggcggggaggcccgggcggcccccaccgcagcgcgggcgcggcctgaggcagaggagctgggaatccagattgggtttgagtgggaaagggcagctgaccgcagccctcagggctttggggcaggcagggcgggaggcccggttctgctcagcccagaccccccacgcccactctgcatgttctctggattcccagggggccatcggggcgctgtcctgcaccacttcgccctccccaaattgaagcaggaagccctgcatatttcttggtgaacgaatgactcaggcgtaatcagtagatgtgggctcccgggtgggttttggagaacagtaatcagtgtttctggagagggacggtcaaggggccagggtgtggctttggaggcccctgcacatagctggggagagaggggagggtggcaggtgggacccccagtggaggaggcttccttcagcagacacctgggaccggtgctgcgcgtggccctgaccttggggaacacccagcaccaaggaagaaaaggtctgagtgaggccaacactgccctgagcctcacgtgaattccacgctggcccttcgcctgtccctggagaatgaggaggaagtgagggtcagaggacccgggtggggtgttcctgaagggccaagggtggtgggcccctggaaacggatcaggtgtggttgccttggaggcagcggggcccgctcgcccagcagtgcacacactcctgttgccagggagcctttgcagggagcgctgactggacttgctgtggactggatgcagctggggtgggggtgccgagagggtgggatcctgggtgagtcactcgtggggccgtggggaggcaggctggtggcagtgagccaagtttttgtgttttgaggaagaagttagtgcagagttctacttgagataggttaccgtggaggtgcttgtgaaatcccatgcggagtgcttggggtgctccctggggagagtgggactgagggaactgagggctggtgggcccacaagggttcgagaacaaaagagaggccttagagccctgtcctggggccctgggtgtcgacagtgcagattgttccagatctgcaggctccatgcacaggcagctggcgctccagcctggagaggctcggcctgtgggaacaaggacagtgaatcgtcctggcccaacccctgccagcctctcatctcaagcccacacatggcccttcagacccttagcaaagtgtgcccttcaggccccaagcctggagactcgaaaattaatggcctgggagctgttgaaccctcttttctactgtttactgggagtccccaaactttgtctccactcctgcagtcccacagctggtcaccagagggaatgtgtgagcccctcgggtggccatggctagcctgaacctgtgggtaaaacaagtcaggcccctccacctccagagcccaccctttcttctcggcctctcactggggcccacccctgaaggctgcactctgaggcttggaaaggccaaggccatgcccaagaggaggctctgctggggttgggtgagtgaagactcagccccactggcccggccaccaggctgccatgtgtcagtgtggtcatcaggaggcctggggtggacatgattagtgatcgggctttgttacaggcgccttgcctctgagaggtcccagcagctcctggcccctgccaggccctcgggcccagaggctcagtgctgcctaccactgttggcccttcaggaacaccccacccaaggcctctgaccctcacttcctcctcatcttccctagacaggcagaggccagcgtgaaattcatgtgaagcctggggcagcgttggcctcacggagcccctcttaacttggtgctgggtgctcccaaggccagggccatgtgcagtgcctcagataaggccaccagagacccctcaagagcccctgtgctccccgtccaccaagacctgcacctaggctctcagaccccacatcccccgagacccagcaggcctgagtttctcctgtgcccctcctccccccagctctgaggcccagatagagccagggtgtgccggcagtggcaggggcgggaacgggggtgggggacggtaggacggtgctgcctgtccacccagctgaacgtgggagaatgcacgaaaccaactggctagagattctgcacgatcgtcacctggccccccagcccaggcagcgtgctggtctagtttgcggtggccacttggcacctctccatctgcctctgctggcttttagtggagtgctggggtgtggtgcactcaactcacatttagtgtactgaatcagagtcttggcagcaccgtcttccaggagcctaagcctggttagcctgcgttctccataccgaggagctaggccctgctgccaccgggagagtgcggagctggccttttctgtcccatggtgtgtggttctctgcagctccacttcacccgagcagcaggagagtgggccggccgcgtggggtctgctctcccaggggtatcagtgccccaacacacgtctttgagccttgccatcagcttattgggggaatgctgtctgcggggttctgatttttgtccattggccttttctaaagtctgaccttgggggtcaacagcgcatgctccttaagtcgatgctagggactggccgtccaccttggcaggcccatgtgagaaaggggctgtggggacctctgtgtccttgggtggtgacctgctgatagctaccccgtttcccgcccacccctgttgtgagtggacacgcgggggtctgcagggttagctaccctgtttcccgcccaccactgttgggagtggacactcagggatccgcagtgttagctacccccttttctgcccaccctgttgtgagtggacactcggaggtctgcagggttggtgtgtcgggctgccttggcctaagtgtgtgacatggacccaatctcttctgtacaggtaccccctgtaccggctgggtggcccacaacttcgggtgttccgaaccaacttcttcattcagctggtgcggcccggtgtggcccagcccgaggacaccgtgcagttccggatccccatggagtgagtccgggaggattccggctggggttggggagcaccctcggggggatccccgtggagtgagcccggaagttttcccgctgggttgggagagtgccctcaggggggcctgggtcctgagttaaaacaactctgctcacgtgctagcctcttcctgctgggaaggcacctcaggcggccctgcccggcaagtattgatggagtccctgtaggtgtggagcccggcaggcaggctgcacgccgccctccacccggggacggcttcactggaagccttaaaatttggacctctgtgctcgcgtcttctgttgagttcttgcagcttctttttaggagaggcgccctgagaggctgggttgggagcaggccgtgatgtacagaaccgctcagaagagcctgcttgaccttcagagaaatgcacagtccctacgagcaaaactggggtgctgctctgcagtgtttaagttcacaggtccccagctcagggttgacgcgagccaggcggggcagcagcgtgagctcccctgggggcgaaggtcaggcctgtgcagcctgcaggggcccagaagctgagttgacagtgaccgtgaggttctgcagtagagggaacttgcagttaacgcaccgaatgccaggcaggcctttccagaaggtacttcctagaaccgcatcagtcccatcagccgcagagcaggcctaaccctgatgcggccactgggccccggggcagacgaggtggggcacctgccagccaggagcgtgcagagactgtcacctcctctcacaggcacttgcccggagcagggagccatgtggggctgtggagcaggccaggggttggttgggcagtgctcccactctgtggggtctgtgccactgccaccccatgctggtgtgcccagagtagggagtcttgcagccagcagcactggtgttgctggggctgcctggccccactagtgccgctgatgtacccagccctcctccctgccccctgtgggtcttggtctgtcggcctctcagcctcgggtgcttgtgcatctgggacagtatttttggcttttagcctggttaagatgccgttttctttctccttcgcctccagaatgacaagggtggacctcaggaattacctcgagggcatctataacgtgcccgtggctgctgtgcggacacgggtgcagcatggtgagtgcccatgggaggttctcctgttggtgtcgtgcccatctgtgccacatgcccacctcgccgagccacagcctcagctactgcatgggggtcttggtctgacgtggctcatgggaaactgaggcacagggtgacttgtcagggtcacacggtgcttacgtgccagagcagggattggaattcaactgggctggcccggggtccattctgagccctgactcctgccgtcagcccccgaggtgggactgcagtggctgaggctggggagcaaagcgctgtctgttccataagcccctgtcgtgtgccctggctggtgccacgtccgctcctttgttgagaacctgctggcctctgttgggagaagggaggagcctgggagcctgctgtgctggctcgtttgattacagtgcccatttccctgagaaatcgcctttttgagtttttaaaaacatatttacatttttaagagagcagaggttcgttttagtggcattgacctctgaggatgtaattttttaaagttctgatttttttaaagttctgatttttttttcactcccttccggcaggctctaacaagagaagagatcacagaaacgtgaggatcaagaagccggactacaaggtcgcctacgtgcagctggtgcgtgtgagctggccagccccagcggggcctccgaggggctcctcgcaactgtgtccttggggatgtttgtgccggagacgctgcgctggggcccagggagcccccgtgaggccggatctcagggcctcagcgcagaggcaggctccacataaggtcatgctccgtcacggccttgggggtgttagtggtggcgctgggagcacgtgagcactggggcacatggggcacgtctcagcgtccggccgttttgtgattttgaagtttgaattctctgtgggcaaaggcagccatcacaggcctagtgggtttcaactccaacgcacaccagggtgtcagagcatgggaggccccggcctctggagagcctgtccttggctgggtttcagcctcggaggcagagtgtgaggcccctgagggcaaaggtctttggtgccaaggcaggtctggctggccaggctgttggctgaggcccatgtcctgcattgcagggtagcaggtcccacgtacttgttagggctcagcaggctgcttctgagcaggtgctttcttacgtatcctggggggctctggggaggaagaaccctcaccccacgttgcctgggccttcagtttctgaaacccagacttgtcaggagtgagacccacagtttcaaagcctttctttgggctcttcattttgagtcccaggcaaacccagaggcactttctctctgggccaagatgtccacagcctgccccggccacctcctgggcctccccactctgcccctggggctggccttactgggtggggatggggttgtgttccggtgtaaatggtccctggaggccgagccggcgggccctgccactagatggcagtcacacgatggtggaaaccgcctcctgggccagccggcctgttgtggggctaaggaggcagtttgtgaaaaaggccaagttagcatggcagcttttctgaaaaacagtcacatttgttgttctaaacaggggcccccggaataatttggcctgatacttgctgtgcatgaaatcagccaatccaggtggggagagcagccgttggcctcataaaggcctctgtgtgctcagtgtcagtcgggcccatctgtctttgtcatggcatgtgggtggacatcccgtgtgccggcaccgccacgggcacttcagaggcagctacggttacaagtggcattcaagtcatccgagcccttgcgttcttcctctgggccccacctcccatgaaaactgaacccagcagctccgggatccggtgtctgcagctgctgcccgcgtgttgttctccctctgtgaagtccaggcagccagagacagggcagggcaactgggagcctgaagggtcccagttgggcatggatcctcctgttccagaatgaaaatttgtaacgggtcctcaccccccttcctgaactccagcacatctttgcacagcctagaaatgggccgtggccgttggtccctgtctgcccgcagaggggactctcaaggccctttcctgtctcgtgtctgctgagaccttgctcagcgtgtccccctgggccctgcgccagggcttagaatcactgctaattgcaaagcccagggagggagcattggaaagataaaattatccacgttatttggagttggccgctgtggaaaggccctgtcccacgtggcgggagtcccacatttctttctccgacaacctgataagcatctccttggcccaaagtcctgggagctgaaagcagcgcctcagtgacccacacaacaaaaagaccattgactgcccgctgccccgaggcttgtgtggatgctgagcagcgcaggaatgaagggcgcgcaggaatgaagggcgcacgacatgagaggcaactccagaacaaaccgctgccgccagctgggccgagctccgtgctcggggctccggcctccaggtccaggcaggcggcagcccccagggcgccctgggattcctgaaggcagggctgccttgtttacttgtcattgggacatttttctccattcctgttctttaccccgatcagctgtctctctcctttttggaaggatcaagggctttttttttttaggtacaaggtgaactcttctagaaaggggaagcccctgggaaaccatgcttggcatccccaaacggtgtttgtctcctgtaagaaacggattttctctcagcacctttccccatttcttcccgaagctgtgacaaatggccatgtttgtgctttaaactgtcattttgggttccccttgcctcggaaaactagcagaatcacctccatatagtcaaggtgaatctcccattctgggcagtcagcctcacgtgtaaacgactgccccttggtattttaaaagacgcaaagttcagagctgtgtaaggcaatcctcctgcaggccggctacggcgcacgcagtgccactctccccgccagcccctgcgctctgcgccagggatcagggtgcatacacctccctcgcagggtgggatctgggcctgtttcagatcatacttggctgcctgcccacatccagatttatttacacacaaagggtctgcaagagccaagtgtacctgactgattttactcactaaagggttccagattcgggtgccatcctcactcctcctccctcttctcttccctctcctctggtctgctctttctgcctcttagctttggagcacttagtaatcattagcaagttaagatggcttcttgtatttgcttaggtccccaaggagcagtatcccctccttctcgtgaacccgagccacatgctgtggcctgggctggggcttggctgacacggacatattctgaactctcagcagaagatgtaagaccagttaattggcagagccggtcctgatttatcagctgccgcacgtgcatgtttcttcgtacgtgatgttcactttaattgccaggctctgggctgggaggagggggagctttaatgtgagtagagcctgaggcattttggatggacaggttcagcatggtaccagacgtgatttgtgtcatgtttttccatgccttgtttctgccccccaccaaccaggtggccccgtgctagtaaatgggtgcacccagggcgggggcagacaccaggccctaaagagacaatggtggggaaagcggccctgtcctggagctgtggcctctgctgcagcgtgacagccgggggccggtggccgtgggggtgcttacattccaggcagggacgctgccccaggaggcccagggaggtacctctgagcagttgaatccggcgccggcagaaaggggctgccagaaagcatgaggctcccccacagacccctctgctgaggagtctttgcagctctggctggagcctttgttctcccccttaggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaagagccggaagctctgcttccttcttctcttgggtctctgggtgccagacacgcagcagccaccccccagctctgagcgccacgtggcctggctccgctttcccagggtctgggcagtgggcgcggccggggtctggtctctgagttgacggggaactgagggtgggcagacttgagacgtggccccatgctggggaggcgggttggccagagagggccacacacaggctcggagctgcatgccaggtggggaatgagacacgcaggtgaaaagacccagaagatagttctgagcgcccacattcagagcctgagcccagaggcgtcgggaggaatggaggggtcagcgtgagcacggggcggcgccgggtgagagaacggcctggcctggacagaagttctggggaggggctgccagggcagcagccctcagggggcctggtgagggaactccggcccgcctgtgggtttcggtttggcactgttggcagcaagaacccgagaagggccgggaagggatccgagggcagcagtgtctcaggagagccatggcggagaggtgccgtcgggcacaggcccggggctgggcctaggggacagggaggacccagcctggaaaggtggttagggcagggggcaaggtgtggccagcaaccactgcaaaacagttctgtgggcttctcggccctgggggtggacaggtcgagagaggagagggtgggcttgagcatcctgttggaggtgcccagtggcctcgcagtgtctgggtggatgcctgggtctagacccttgttctgtcggcccagggcaggtcaggacgcacggcccctgctctgattcttgtctaaagggttctgcgtggaagcctgtggccctgccagaggctctgtgctgcctctcctagcctggcctggcctgtgggagcaaaagggggttgcccggccgccgtttttggggcctgaacctggcagactggcctgggttcccgttccagcaaagctggacaggccagccggggcagcctccagggggccctgagctggatacagaattgatttttggttttaatgatgtcttattcagaaccttccaaggagcccggaaggtttccagcccctcttcccagaacccctgcatctggtgaggcccagggcctccagagccccttctggccccgtctccatgcggcagctggtgcgtcctcaggacgggttgcagaggcctgggggcccctctgtttttcttagtctgtccttggttccagtgcttcgcgagaaaatccaacatggaggccagagcaaggccccctccctgctgtgtgcgggcagctccggctttggggttgggaatcaaaaccagggcccacgtgtacgtcgggagccatctgcgctccaccctgaccaggacggagccgcactcgggcgtctgggggaaagcccacggcgcggctttcttgcacgaagttgggtttgccgtgtaagcctccccatgcgaatgctcagaagaacacaggtgtcacgtggccttgggaccaaccctgatctgcagcgtgggcctgttgtggtctgagtgagggtcctggcttttccttctgcttgggcagccttccgagggtcttgcaagaggagatggcgtggcagctggctcagcctcccctcccccagcccggagtgcaggcaggagggggtgtggcgggggaagtgttcggctagggggtgaaggcccgggcaagctcacccttcagtgttgatttaaagggatggggaaggtcaggaagtagagccggagaaatggagtcaactgtgttttccttagagaaataattcatggggcctagagctctgaggaccctaactcacggcaggggaagaggaatcccatccttcatccacggcacgtccagccccgcacacaggggccgttagcagccctgctggcggccagcgcaccaggcacactccatcacggccgccacccccagacgcagccctgactccggctcca

SEQ ID NO: 17117 - DNA, 43267 bp, Human
  misc_feature (1)...(43267): n = A,T,C or G
tgttttgtttgagatggagtctagctctgtcgcccaggctgaagtgcagtggcacgatcttggctcaccgcaaactccgcctcccaagttcaagcgattctcctacctcagcttcccgagtagctgggcttacagccgcccgccaccacgcctggctgatttttatatttttagtagagatggggtttcaccatgttggccaggctggtgtcaaactcctgacctcaagtgatccacctgcctcgggctcccaaagtgctgggattacaggtgtgagccaccgcacccggccaaaattctcagtttttgaaccacagggttctgcattctcattttgctctagctccaaaagtgaggcagccggtccagccttcgggcagtagagggcaggagggggtggaccccagcctccacctgcctgtcctcttcctggcaaggttcctgaagctcccagcgacgatgctggggctgcccttctgcaggccaagggaagaacctcaagggcaggaggacacaggcattgcacctgccgatgcagtgcctggacgggtgggtgagcggaatggctgcaacctggaggcgagaccctaccaccatgaggggagccgtttcaggatggcctcaggatggaggccgcatggtgagaaccgcagggctctgccatgtgccactctgcaagggggacttgggggcccttagggacccccagggaggaggcgtggggaagacacaggcatggcctgttcatctccatggcgctgggcctgatctggttttagccctgcccatcgtctgggccacggatccctctggtgcctccactcgtggggctctgaaagcctctgctggtctttgtggtgtgtttggtgggtggggggctcgctgagtcccaaggaggcggcctccggttcggccccaccctgatgggtcaacactctgggcccagggccctcccaacccctggcctctctccagcccctctttgccttgggaccccctgtaagtccttgctggttggatttctcaggcccagccgctggccagggctcccttctcccattctcctgctctgaggtttccagcagggaagccttcgccacctctgtggctgccctactctggcccagcttaagtcctcccctgcctcagcttttggggtctggctcctgcagtcatgcatcccgcctcctgaccctggagccactgcgtggtcactcccagaagctggggacagtgagggctggaaacagcctccatccctcccctcgggctggcctatgcctcttgggagggtccctgaggcactgcctttagagcctggggacacgaaccactcggtggtcaactccagcgaccagagcacggagagcaaggggcagcggggggacgaggcggatgcccgacagctcggcatcagcaaggcagtccaagacagaacaaggcacccgacgggtagaacgcaggggcatcccgggcacagcccccaaagccacctgggacccacagctgtttgatgtgctcaaggctatgaccccaggcttcgagaaaagactccaccaagttccatgagcacctgtaggagagccggcctctgggtagatttcacccaaagaagctaaaacgctcacgtggtgcttatgggatcacagacatgtttgtccctgatgctgcaggagaactggccactcacaggtggacctgatggccagagctactagcggggaccaggggtaacatgggtccccctccccgagccatgaagagctgcctgcggccatcttggccctcgcaccccgtctctgtcaccccaggcccctgtaacttgcttaacgcttcctgaggggtggtttgggtttttttttttttcttcctctcctcttgtagcaacagattaaaaaacaacaccctgacccaagccgagacaggttccaaacctcaacctgcagccggaagggggaagtgaaacttggctgggggtgggggctcagaagccgccccagaaagcactgaaagccacagcacgtacacccactccagggatctgccagcaccctgtggggcccagactacaggctgatggcggaggcttcgagtgacccgggtgctgaggagcgggaagagttgctggggtaagggtctgcggcgacgcccggcgccctgtgccgtgtccacgggtgcatagtccttgagctgcatggagggtggagaactgaggtgcctgatggggaatctggggcccccaatgggagaacttggatgtccgatggggaaactggggacccacagacaggtggcaggaagtcttgctgggacccccctctcacaacaagggtggaggtctcttccgcctgcctctgtgccctggactcactgggggaggcgcgtgggatcctaagcccatggtggatgcctgaagcgaggagaccccaagacgtgtcctggactgccagggaggagctggggactgtgggccctgttagcttgggaagaggcaaggtgggggctggggagcagctgttctgggatgggtggaactggcccgggcccggccacctgcccacaggactatctgagaggggctatcctgccttgagggtctggaggccgccaggcttggggcccagcaggcctcagggcagggcacccaaagctgcccttgacctgcggtaaaggacaaggccaaggattctggcaggtgcctgtgctgggtgccaggcaccgtgtgttggttggagtggggacatgagggggcatggcagaggttgtgtgtaggactgccagagctgggcagaaaaaccccgctgccaaaggcctcctagcgggcacctgtactctgtggtaccaatgggcatccagccctgtgctggggtgggtggagagggctagcggcttagtaactgggctccctggcagaggggagctgccggccagcaggcatccaggcatcacagctgagcctcgccaggggaacccgagttgcccccggtgcaggtcccagaagagatgggagggctcagggcgtgcggtgcagggacaggtagggctttgaggggcagaggggcgacgtgctaatggtcaggggatggggatccggtgctggggatagaggccggcctaggagcaggtcagcgggggctgtggcctggtgtgcggaagggaaggcgctggggcccaggttgcagaaagagtgtgatgcccgcagccacacaggatggacctgagaggaggcccagggtgacgctcacataccccaaaactgcagccagggctgctaccagtctctgccttggtgctgacagcagagggtcccggtctacccgacccggggcggtgcagggaccacctcccggccttcacacaaagctcctgtgctgttggtggctgcagtcactgtcctgtgtctgtgtccttggtggccgtcacattgctgtgggtctggtatgtgtgaggggtctgcatctctgacttcttgctgccaaatcccacttgggtacaggtgcggggggccactgaagggaccccgagtgccgtgagtggagtggaggctaagcagaggccggggctggctgagggctgggtcgggacgtccgtgcctgtccccagggagaggtgggaggatgccctgcccaggccgtgtgcagggagacaggcttctgggtgcacaacagctgtgtcccagctgcaaaacgggctctcctgtcagcaccacccccagccctggactaggtgctgctcctggtcacctcatgcccatagaagggcaggacatgagcctctgggctggggcacccccgccttcctccttggcctcatccttggccaccccctcccagctgtctcaaatgccctggatcccccgggccaggagcggggagggggggttggagtgggcatggccaaggcacagatgatcctggggcatcttggtgtagatcctgggaggccagggctgcacctgtgccggggctgtcaggcgctccagctggagagcggcggttctcctgggctctgcaaagcctggaccccctccttggacatcccctgcccccgcgaattgcatggggtgcgcagccaagcctgacctttcagaatgaaactgagagccccagtggggtaggcttctcatttcacaaggtgactaagggaaccggggagtttcctgtctaggatgggacagaagtcccctgcacccaggcagggatgtatggcctgggaagcccccacacgggagtccccaggaaggcccaggctgggcgggctcagctggggctggagcagtggacaagacagccccccatgcatgtcacagagtgccaggtacgccagcctgtgacggtctcaggacatgccctcaacactaggtccagggcaggccaagcccctccagctggacaagtgggtccagcccctcagactgttgcatgatgtggcccctcccctcagactgcccgggacggggccagattcctcagaaccacccctccatgatgtggtctctcagatgcccccaggacaggactgtcctctcccacgaggcctcaggccaaagaaggtcccctgaccctgggcggggtccaggctccgcttcggctaccagccaggctggactgcggttcctccactcgggggcactcctgtctcgccccgctgtccagccgacagtcactagcttgtccttgtcccttgggggcagggacgaggatttcacagagctgccttgtggctctggggggactctctggtgacgctgggggatgcctgccctctatagctcccaagagcaaggctctccccacactgaggaactatctggccttggaggccttgaggcgatgaggacggggcgtcctggtccacagctggggagggtcaggttgccctctcagaccttgggttcgacatatccagatgttggagcccagctctgcaggggtgtaccctccctggggtcacactgcatttttggctgcagtgcctgtccttggcccagctgcccgggggtgcccacccgcccaggcgtgcccaccccatgtccacacctagaaggcaagtctgcctgccgccaccctgtcccacagacaccctggctgccctctcagtctgcccctgtgtagcccaggcccccatcaggatgaccctacccccagtctgttccccatgagcgaccaggccgtgtctcccacggaaagaaccattcaccagctacaggcaaagtccatggccctgggtggccacgccaggccctcctggcctggttgaactcacttcccatcccaccagctttcccagctcttcccagttttggaaggtgtcagagccctggcacatgcccctcctagcatcacccaaccgccctgctcctctgcagaccttcaaaggcctgcccagcccgcggtgggaggccgctgcccagggctctggcagcacctgccatggacagggccagtcctggagccccgcctggcccatcggagcctccctcgcttctctgtgtgctgagctgagttgggaagggcagggatgacctgaggggctgctctggcagggtcccttctggccatctgtccctggagaccctcagagctccagattctgaaggaggaaggggctggaggcccccggcagccccctggaagtcttcatctgagcagcaggagcccatgggatggaaccccccaggcagccaggcccttgggcagccctcccgcccacctgccctccgagccaaggccaggcaccacctggaggatgtgcaatgctccacgctggggcagatggccctgagagcccccagcggtgcccacgactgctcaggaaagagggcagagctggggacagttggggaagccacctcagccccagccctagccccacaggggctgctgagggaggttaggattgagggctaagccctggggctccctccctacaccttcctgtggtcaagacctgatgtctggacccaggatccctggggaggtccccttcctcctgccctgggtaaggggtctgaggcatctggaagtttcccagggaagcagaaggatgtcttcttcctcgtgggctggcaggcgctgctgtccaccgacacccagctgggctggtcgcacaagtgggagcatcacaggccccacccccgctgattctggaagccagaatccttccttcctgcgcccccttcctggttccctcgtgtctcctaaaacaatcctggagccacacaagggcagtgccaggagggtctggggtccagctgggacaggccctggccggtggcaccctggggtggcaggatggtgggcctctgctccgctaccctacgggccagcctgtctccgcctcagttccctgagaacgtgccagagggatgggtgagccctagagaagaggagggtgttggcagtggaaagggcccagtggtctcccgctctgagtcctcagcctggtgaggggtgggggcgtgagctctgccttgcagtcccagcccctgagatcccactgctggggcggcgggagggggatgggctgcaaggccccagggctggccttgcttcggctgctataggccctcggagtgctttctggatgagtaagccgcacccctctgaagcctcagtttccccatctgcacactcagaatgtagccactcagaccaagcgttcactccatgccagtctttgccaagctatttatttatttatttgagacagagtctcgctctgttgcccagactgtagtgcagtgacacaatctcggctcactggaacctccgccctccaggttcaagagattctcccacctcagcctcctgagtagctgggattacaggcacctgccactgcccccggctaatttttgtatttttagtagagaagaggctttcaccatgttggccaggctggtcttgaactcctgacctcaggtgatccacccgccccagcctcccaaagtcctgggattacaagcatgaaccaccgcgccctgcctttgccaagctttttaaaccaaggctcttgtttcatcccccggagctgtgaggcaggtccctggagcctcccatttcacagacggaaaccgaggctcacaggggccaagtgcattgtccaagggctgctccctgcctggggaggggcctgagtccttgcccctgtggggttcgggtgctgagggcccacaagacctgcgggcaccaggagggagctgggctgggctgcccttcccggggtctctctgaccccacaccacacaccagccactctggactcaaaggctcccaagagcaccagagcactgctcatggcccaagctcagcaagcacttaaagggaccgtcccgaaaagcggaactgggaccgggcgctgcaggaccagcaaggtcctccacttccctccagcccagccccgcccaaatcccagccctcagcatctttttgggggccactaaagaccttctgggagatggcagcccaggaccataaggcaatcgaagagggctttccacatgcgctgaggcagacagaaccaggccctggctgtggacgaggctgtattgatacttagaagagagggaagcgagcgggctggagaggctcggccagggggcagcccagcagggccccttccccagggttagactctctacagctggcccagcccccatcccctccccaacatctagggacctgaaaagaggttggaggggctgcatgggggtggggttgataggagattaggggattgagaaagccaggcctcctagccgtgtcccacccagcacggccccaccagtgccagacacaggcagacaagggaggagggagatgctgagcaggggtggcaggaggaaagcccctggccctttcttggggccaggcaagtcctatcctaactccatctgctaactgcctccaagctgcttgtgggttgtcggggaagggagtttgtggcagggagggcctctgagtcccctgtatcccccggcaggaggaggcaggcacatgggcccctgacctcagagcttggagcagggccgctctggtggggcatttgtaggtcacagcatgaagggttccagcatacttcctgggttcccagtttccctgggagcagtggtatagacgcaggggcctctacacacaccacacgctcagggagagtggctgaggtgtccaggataccctgtccactggggcagggggtggcttctaagcccagtacccttcccagagtccccagtctccagctgctcatgggctgcagatgaggattcaaggttatgcaggggtcactctcctgctccatccctggcaggtgggacctcacctactgcttctttctgctccagagaagagcacgtccccctcatctcaaaagtgcctgtgctcctccttcctgagtggaacctacacttttgacagtttggtttctgaggcaaggctgcctcctcctcctgtcccaggtacctcccctcagaaaagcaatgggacttgggatagaaggatctagccaattcattccagatgaatctagaaataatcctttagcctttctcttagacccagtcccaaccaaaatctgagcttcatcaccaccacccagcacccaccattcaccacccagcctccagcccccagcccccagcccccagcccccagcacccatgacccaccaccctgccccctacccgtggctctggcccattctcctgctgtcagcagtgcctgcttgaacagagggccacactgaacagatgcatgctgcaagcatttggagactgcctcctctttaaatcacagacatttatccaccagggatcactcgggagccaatgaggccaccaccctgacctcccctgtccccatgggctctctcagtgctcaaagcacctttcactgggatgctgctctgtgaacatacattcgcaggtatgtgtcggggatgatgagaatgtgtcaatacgaagacagatccctgcccctgtagcccctgcttaggctctattgaggtgttcagcctcctgggccatggtggtctgctttatccttgggccatgagcttatgaaccatgtcttagttgcataagaaaggaaaaataaagattagaaaagaatcaattatggagaacagtatgaatgaatggaaagatgaatgaagaatgataggaagtaggaacaaatggatggatggatggatggataattgaatgatggatggatggataattgaatgatggatggatggatggatggatgggtggatggatggagggatgagtggatggataggtgcatggatcgatggacaggtgggtgaatggatgggcagatggatggggtggatgaatgaatgggttggatggactcatgtataaatagagtataactcatgcataaatagaaagaattatttagtaattgatgaatggatgaacaaatgagcagatgaacaaaaaatagatggatggacagaagaacatctgtatgtatatatggatgtttggatgaaagaacgaatggatgggtggatagataaatgcagatgtgatatttagaatatttaacaaagcatgtggtacaaatatgaatctactggaatgggtgctgattatatatattcctatattgaactgtgttgtacctgtgcatattggctgatcatcagcccaacagctaaatgagcaaatgtaccaaaacaaaagatgagtggatttatggatgaatggatgatggatgaatgggtgtataaatgggtaaatgaatgtattgatggaaggacacatgagatggaattatgtatgggtggatgagtggatgggtggatgattggatggctggaatatggacatataaatgattggaaagattaatagaaggatgtcaggagaagtagacatatggatggatatggataatagatgaatagatggatacgtgggtggatataacaagagatgagtagaaagatagatagataatgaaccaatagacaattgaatccgtgctgagtaaactattagaaagacggatgtgtgagtagacactactaaatcaggaattttgcactctcttccaggaacacttcctcccatttctctcatctcttttcaaataagaaaagaattacttctttccatgaggctttcatatataaagacccaaggaaagaattacttatttccatgaggctatcatacgtaaaatatcaatcccctccagaactccatatgcctttaccctgatttatattttctgtcatattttccatcatctgacctttatttatttatgtgtttgttcccacacttgaaacatgatcatcataagagcagggactttgttaatgctgaatccccagcaccttcaaagtgtctgaattcagtacagatttattgaataaatatatggaaggatggagagacagatggatagacagatggatgaatgaatggatggatggatagatgggtggatggatggatgggtggatggatagatgcatggatgaatggatggatagatggataatggatagataaatagatgaatggttggatggatggatgaatggatgggtaaatggatggatggataggtgaatagatggataagtgaatggatggatggatggatagatgggtggatgggtggatgggtgggtggatggatggatggatggatggatggatggatggatggattggtggatgagtggatgagtggatgggtggatggatggatgggtggatggatagatggatggatgaatagatggatgggtgaatggatggatggatggatggattgatgagtggatggatggatgggtggatggatagatggatgaatagatggatgggtgaacggatggatggatggatggatggattgatgagtggatggatgggtggatggatagatggatggatgaatagatggatgggtgaatggatgggtggatggatggatgagtggatggatggatggatgaatggatggatgaatggatggatgagtggatgggtggatggacggatgcatggatgagtggataaatggatggatgaatagatgggtgggtggatgggtaaaatggatggatgaactgatggatgaatggagagatggacagagagatggatggatgagtagatggatggatgagtgggtgaatggatgagcgcacacataacagtggagttgacatcaaatactctcccatattgtccctcacaggacatgctctagttgtaaaaccatgaatcttggccgctacatgtaaatatctgttcttgtcacttcccatccatcagcatttctgacagatgatcattctctagtgacagggaagtcctgccattccaaggtagctcttttccctgtgggaatattcttccttcttttgaactaaaatatgccttggccacatttcattcctggctgtctgtggctgggactcctccagaagttaaaacaggaggcaaggaggaaataggcaggttgaggtgcaaatgaagcacatgctcactgccccccaccccaggtaatctcacctcacctgggtgatctgtcctccctgagcgatctcagtttctctgtgtgatcttccctacccctggtaatctcacctcccctgagtgatttagctttccctgggtgatctcacctcccctgggtgacctcacctcccctgggtgaccttacctcccctaggtaatctcgcctcccctgggtgatctcacctcccccaggtaatcttgcctcctctgggtgacctcccctcccctgggtgagctcactaaacatttgtccaacctgaggtccagccctggctaccatccctcctgcttactccagaatcctgtggtctctgcagctttgtggatgctggggatgtggggccaacaccatggtctctagtggacattccctgcttcctcctgggttgtgccgggggaggggagatgctgtgggctcctctctccaggactggccctgggacccagtctggtgtgtatgtagggagtggggacggacttcctgactcccacagtctccatggggtagcccaccacctgagtcaccacagcccggtctatggtcccatgtggaattttccgactgttgccgccacccccggcgtgctgccctccgcggtgattcacccgcttgcccgtctgctcacagcctcacccttgcttccctcagtgttcccaaggtgctgcgcaaccccaactccctggcctggccagggtcatgatagctggggaggcaagaggtggctgttctccttgaatgtagggacagagggtggcatgggcagatgagtgcccgtgcacagatggtggcccaggactaattgggtggccagcggccggcagatctggctctggttctggctgtgccaggccctcactctgtgaccttggatgccagtgctgctggctggaccttggtttctccatcctggacatgggtacatggtggttctgagtgccagcgagctgggcaaaccgccggatgtgagactgccgtcgcggagctgaccctcggtgagccctgaacatgcgtcccatcccacccctcgtccgtccggccactagccccgagtgttctccagtgagtcacagcagccaagcccaaccagaggaacagagggctgggctgctcctccctgggccagggccagaggacgcgggcaaggggggcctggctggcgagggcaccaggccgactttgtgcccactggccacctcttgggaccatgctgtgccaataccaaaccgaagatgctgcgttggtggcgtctctgcctcttgggtcatctctgcagtctggctggggggttgggcccaccaggaaaggcagcagcctccccatttggggaacagagagggttcttggggtgccaagccttctctggaggtgacaacaagagcagaggccgggaatgaacaaagggaaagtggagaaccaggagcgggggagaggggaggaggggagaggaagggaggggaggggaagggagggaggagggaaggagggagggagacagagatagggacagagacaccagagggaaaggagagaggagagaggggctgagtgcgagacggggaaggaggggacgggacaaagaggaaccagcgaagggtccaggcctgcgatgatggtgagggaggtggcaggttgacgaggggctggacaagaacggccgacgaaggagaagaacagaggagggcccgggcagggcctggcagagggcatgaggcactccgaggtgggaggcggcgatgggcagaataggcccctgtgcctggggcaggggcaccacagagggctaggggagaccgagaagcgggcagcggctaccaaggtggcctgagggcagaggcggagggaggaagggaaagaggaagggagggagggagggaaggaggcagccacgctgcccatcagcgcgccacagaggtctggctgagccccacgctgctgggctgggagagttttcgctctgacatttttactcttctcggaaggaggaggaggtggaggtggaagagatggaggcgggaggagaagggggctgggggaaacaaaagagaagcagctgctgagagtcctgaagtaggagaggggaaagggagacccacagtcagggagacccacagggatggggacacagggaccaggctgcctgcagggagccggcctgcagaccctcgtgccaggagccgaagggagggaccaggctgcccacagacccctgtgccaggtgccagagggagggaccaggctgcccaagggagccggcccacagactcctgtgccaggggccagaggggccaagacagacaggcagagggtcacagggacaaggagaacaccagacagagagaagggacaggggaggggtgacagccagcgagagaccgagggccagggcagagcgccaaggaagtgcaggagtgagaggggccaggagaggcaggaaagccaaggagagctgggcacaggggggcaggggtgcgggaggagggcagcagagaggagggccagcaggacaggagcctttgagatgctgctctatccccggggctggggtcaggccaggtcgccgcctgagcagaggctgcagcctgggcagtcccgggcttctgaggaggaactctagcagacagggcctggatacctcttgaggtaggtccctcctgccctggctgggcatggagggcagggcagggtgcccatgctgggctgccacatgcaccgggccactgggcctccccccagcttcggtaggctctgctgccccaagcgtgggcagcgagagggtgccaggctggttgcgtgtacatgtgtgagtgcggaggctgcttgaggcctctcttcctcctggctcctggcagctgcccatgcattctccttccccatcccacctgcactgccggctgcgctgtcgcctgctcacaccgtcccacccgcaccgccggctgcactgtcacccgctcacaccgtcccacctgcaccgccggctgcactgtcacccattcacaccatcccacctgcaccaccgactgcactgtcacccgctcacgccgtcccacctgcaccgccggctgcactgtcacctgctcacacctctccccgagccccagggattctgcttgactctgagcccccaaaatgaagggcccatcctctgggtggcttctggggcctcccgtggggtccttcggatcctgggcacccttcagtcaccctcacttcacagagcatgaaactgaactttgggctgagcttaccggccctggctgcagccaccaaccctgagtgggaggctcctcagggccagggaaggtgcccgggccttgtccacctgcaggtgttgggccagtgtggtgccctctcccagcctgtttcctcctctgtaaagtagtggtgtggcccttcatggggtcaggtgggagagcagagtttggagggcccaaggctcctcaagacccagcctgggcagtctcagagatatccctctgcaccgtcagccactctgagccgcctgtagtgccctttctcctcctcaacccttccaggcttttaagccaaactgaaacaccacctcctgcttgaaggctgccttgcttcttcctaacctggagggctgtcctgctctgacttcctttgatggcatggagcatgctggccggacctcgagctactggaaggcagggctggcatcggtcggcttgccactgcccacccaggccaggcactcagtgctgagactctgagaggccagagagccagggatgcccatgggggtgagctaagtggggtctgaggagttgagggcagcccggctcacccctcctccccagctcccacttgttgggtccgtgcagatgcagagagatggctccgatctggtccccacctggcagggtctccggctgtcacctgagttcaggaccagcaccaggatctgcagtgggcccctggctgggcacacctcaacccagcctccccctacccctggccccccataagcctcctcctcctgggcttccaggctctgctggtcagacctccctccctgcccaacgggaatgtgttttcccaggggacgctgctgtccaccaggagctctgtggcctgggatttgaggagtgcctggggtcaatcccccaggctcaccagtgctacttaacaaatgggcccaagagaaggaagtgcagcccccggaggaggggcagagcccctgcctggctgtgcggtggctcacccccttgtcaccaggggctcggccatgagcatccgtccagcgggcccagcaccaactgcagccccaggtgagcaagccgcactcaggaggcactgaaaccgtgtgggcccaggctcggggccagtccctgtggacctggggaggagacactgaagccgcgtgggcccaggctcagggccagtccctgtggacctggggaggaggcactgaagccgcgtgggctcaggctcggggccagtccctgtggacctggggaggagacagtggggaggggacctcacttgcggtggtcagccagtgggttggtggcataaggacccgtccctttgaactcccttggaacttgtcctgatgggggctgggcagagggcagcaagagtcccttgtccagctaaggggagccaccaaggtgagctacatgaagcaaggctgacacgtgtgcactaatacacaccccctccaggacacagacccagaggccgctgcaccccacccacccaccacacccacacacacacatgcacacacacacgaccacctgggacagtactgcgctcaccaccactgccatgatctcttctctgcagcctccaacagctcggacttccccagtcccagccctgcaggccaggcagactgccccctacccactccctgttggataaaggagtgagccaggctcagagaagctgtgggtgaagagacttcaaggccactcagccgggcatgatgagcccgggtccctgggtccctcctccacccgcatcaccccacccctttcccggggaccccttgggtgtcctgccatgtcaggtgcagggctgggagaggcattgcaggcaaagtgctgtgtcctcagtgatgaaccctgaagggccatgctaggtgcccgcagctgccagggaataaattcaatgcagtttacatccattaaaaatggtgctctgggccagtgggaaaacgtgtcccccctgccccgtcgccccccacccctgccccagcgattctccttgtctacacccagtgcgagcccaggggctctgcatgtagtcccataacaccattttctccaggtctggctgtacccagcccctgccagaatgcggcttctggctggcagggtcaggccctgggctgacctacccccaatgcctccctgccaagtctgcccttctaggcacctgggagtctgccctgtgcctcctgcctgcccctgggcaactcggggctctcccagggccagctcgggcaaggcaagtgttagggatggtcaggggacctcaagaggacttcagcccactcaactccagacgtcacccggactcagccagcggcctggccctgctacctgtggggtcctggctttgtgagagggcaccaggccggctgagagtgccttgtagcctggcccggagtgaagaggggggctggggatcagcctggcagacgttcttatcaagcattgaggtccccggagccccgtgcccacccttagccatggctctttgggcggtgtgagcccctccattccctccatctcgggcacacatctgcccacacatatacagatgtggcagccacaccgtgcttggctctccgcagggctctaaggcccctcaggcagggacccaccctgagcagcctggtccagggacctctggggctcctgatgtggccagtggggcaggaatgggctggcagcctgctgggctggccctgagggggctgggggaagccaggcctccaaccacagtgtccaaaagggtgtggctgccttgggcccatccaggcctgagatcctgagggtggggtagcccccgccctggcagggctggaagtcggtcttcggacagagcccgtcctgcccagaagcccaggcgagccagcagcaggggtgcagggaccgagtggcccagccccctgggcagggtgtcagggccagagcccagaggacggcggttcaggcttcagtcccagccggcgaaccagagctgggcagagcggccagcaagcggcagccagggtgccctgggcactcgacccccagatgcccctgctggaaccgtaaaggggaggcaccctgaggccagagggagcatggccccggggactgagcatccggctcagagcggcttggcagaggtcggtggactggggttaaccacagaggtctctggagggcagacaggagccactgcaagtgggagcttgtgggagagaagcccttgggtgacccctggatggggcggggaccattagggagaagggtgaggggcttggcccctgccccaggctccaagtgggctgagacccgggaggcttgagggtcggctgctacccatgacgggttggggaggtattggtgcgagctgaggtggtgcttgcggaggtgagattgagggccgggcctggccagggatgctgggaggggggcaaccctgtgcctggggctgtgagggtctcttgacgagaacaaaccctacctggggagaagtgacagagaaaagaaagaaagaaagcgaaggcacgagaaagaaatgagagaaagggagggaaaaatgctgagagggagggagagcaggggctgccttgaaggaggagggagggggagcagaagcgggtgcagggtggtggcaggatgggaagggcagagggaggggctgaggtgcgaatggaagctgtgtgagggtcccgggcactgccccttgccgccgaccccaggtgtgggaggagggatctctcccacgtgggccgcacctagcaggtgccggggcagaaggctcagagccgctgtctcacacagcttcttggtgctccaaagacgggcggtaggaggaagatcaaagaagcgagaaatggatgctggaggaacgcagtgaggccaggcgagggctggcgagcttgccaaggagaggacgggcgaggaaaatggggcgccccacagaggagggggcgtgggggagggctggttttccccgagactgagaaatgaatttctgcacccggactgggaccccctgggtcaggaccctccactcacattcaggagcagcacctcttctggcctctgtccctgcctggtcttccccacacccggttcttgggggttgaggggttggagccccagccacgtcatcagctccctgggacccctgcgtgagacgtgagaggtgcacctccgagcctccgtttgtgcatctgtaatggggaagataggactgcgcccctggcgaccattgtgaggacggaggcgctggctgcactggtgctcactgtgcctctttaaacggggatgtctggacctctggtgcagaggaccaaggccggtccacttgacctcagccatgaggacatcccaaggccatgtgagtctcccacggcccactgaagctggtccttcataccccattttgcaaacaggaaagctgaggctcagggaggcaccaaagcttactcccatcctggggcttggcagggggtgcccgcagcacccggggacatacaccggggagtctcctgggaaagaagtgccggcccaggggcagactcttttctgctctgccatgtcttccctgcacccccagggatgatgagtctgggaggggctggtcagccatgaaagcttcggggaggggccggtggccaggctgggcaccccagagctccacaggcagacatggtgtgggggtgtcaggaagagggcctggctgctgggtgctacggtaggaagatcccggtgctgtgggagtggagcaggtggttgaatgccaggctggcttggtccttctctctgggtgccggctgtggctcccgcccaggtgggcaccacgtctgaataatgtatgaagcctctggttgcgtggaggatgggagcgcttcgggcagcatctgtgggcagagacttcagggatgtgaggtacatctgggcatggctagctgggaaggaaagaggatggcagagcctcgagccgttgccagggactggttgcgtgtcccagaacgtgccaaaagcctgcctcgtgagcacggcaagagctctgccagggcagtcccagctggcccaggcgccgcagcgctcccgagggccgtcgagcaaaggcgggaggcgcagccgggctgtcggtggacctgtaggtatcagggctccttggtcccctcctgcgggaagcaggcaccgagtggggctgcatgtagacgcatgcgagggtgagagctgcggcggaggacgctgatcgcggagtgcaggcgagggccccagaaaggtcccgcaggtcgcctcgctcgtggcacgggctcggcagcgttgtggttagtgacacggaggaagacagaaagccatatgcacagcacgcagaacaggaggaggggggaagaaagagcaggcacggggcaggcagagccgcagccacgccgccgggatgcagcaggcagggccacccacgagcagggcggggccctaacctccgacccaggctggtcgccgcagatgggggcagagatgtgaaacagctacagagcgggacaagggtgctgccggcacagggctgaccacagagcacatcaaaagaggtagggcacccagcgcaagggaggtgatgggctggtcagcaggacatcaagccggttctggaccctgctctgaggacggtccctgacccagcctctgaggaccaatgggaagccaggggtagaggggttgggggaaaccaggctccattttccagtctcagcagggggccaaggcttgcggctctgcggaggccacaccatgaggtttccagggtcatagatgccctttggtcagcgctgtctgccgctgcacgggcacccctcctgttgggtgtctgggtagacttaggggtctgtccggctggcgtgggcacctttgggaggggggtgtgtgtggcgggcaggcctgggctgtagtcaccccagcccgtgctggtagagttggggtctgtccggctggcgtgggcacttttgggacggggtgtgtgtggcaggcaggcctgggctgtagtcaccctggcgcacgctggtagagttggggtctgtctggctggcgtgggcacttttgggagggggggtgtgtggcgggcaggcctgggctgtagtcaccctggcgcacgctggtagagttggggtctgtctggctggtgttggcacctttgggacggggtgtgtgtggcaggcaggcctgggctatagtcaccctggtgcacgctggtagagttggggtctgtctggctggcgtgggcacttttgggagggggtgtgtgtggcgggcaggcctgggctgcagtcaccctggtgcatgctggtagagttggggtctgtccggctggcgtgggcacctttgggacggggtgtgtgtggtgggcaggcctgggctgtagtcaccctggcacacgctggtagagttggggtctgtccggctggcgtgggcacctttgggacggggtctctgtggcgggcaggcctgggctgtagtcaccccagcccatgctggtagagttggggtctgtctggctggcgtgggcacctttgggacggggtgtgtgtggcgggcaggcctgggctgcagtcatcctggtgcgtgctggtagagttggggtctgtccgctggcgtgggcacctttgggatggggtgtgtgtggtgggcaggcctgggctgtagtcaccctggtgcacgctggtagagttggggtctgtctggctggcgtgggcacttttgggagggggtgtgtgtggcaggcaggcctgggctgcagtcaccccggtgcacgctggtagagttggggtctgtctggctggcgtgggcacctttgggagggggtgtgtgtggcgggcagacctgggctgtagtcaccctggcctgcgctggtagagttggggtctgtccggctggcgtgggcacctttgggacggggtgtgtgtggcgggcatgcctgggctgcagtcaccccggcccgcactcagactagtcctggcatcaccactctggggcgaagttgatgcaggagctcagggccctcatgcagcactgggtgggtcatgaagctcagggggcttcagcaatggaggaggcgaccctatcccatcccaagttggacagcagtcccagcggtggggggtgggggtatagggggaagcaggtttggattgggtgggtaaggaacccagaggaacagacccctccctgtgcacctctccccagaggtggaggcagggagagatggaggcagggagaggtggaggcagggggcagagacaagcctcaggtcatcaagagttgagggctggcatctgggatacagggaggatggggagaggggagggctgtgcgggtggggggcggctctgtctccccttggctgtgcctccctggggaccgctaggcatacgcacggccactgcaccccttcctccctgccaggaccctgcccactgcggcgaccccgaggctcagagcaggcacaggagcccctcctttgagagacttcctgccagctcccctctgtgcttcttgatccacatcatgggtcagcgctggtttcttggcaactgctaagatttgtaagggcagggaggagatctcactcctccgtctttgggtccctagcacctgacaaaataaactgctggctaaggaaagatggagggagggagggagggagggaggaaggaggggaggaaaggagggaaggatagagggaggagggaagaaggaagagggaggaagaagggaggatggagaagggaggaagggaaggagggaaggagaaggagaagaatggaaggaggagggaggagggaggaactggaccgaggctatggctatggaagaatcatgccctgggccatcccaggcaggctgagaagaaaaagctggaaccaagtctgggctagtctggtggttgtggggcaggaagtagccatcagggtggcaaccagaagagcagggagcccagcagaggagggaggccggcagaggagggaggccggcagaggagggaggctggcagaggagggaggctggcagagcagggagcccggcagaggagggaggccggcggaggagggaggcctggcagaggagggaggcctggcagagcagggagccctggcggaggagggaggccggcggaggagggaggctggcagagcagggagcccggcagaggagggaggccggcggaggagggaggctggcagagcagggaggccggcagaggagggaggccggcagaggaaggaggccggcagagcagggaggccggcggaggagggaggccggcagagcagggaggccggcagaggagggaggctggggacagtgggggcaggccggagacagtgggggcaggccggggacagtgggggcaggccggggacagtgggagcagtgtcggggacagtgggggcaggctggggacagtgggggcagtgttggggacagtgagggcaggccggggacagtgggggcaggctggggacagtgggggcaggccggggacgggggggcagtgttggggacagtgagggcaggccggggacagtgggggcaggctggggacagtgggggcagtgtcggggtgaggatctggtctcccgacaccccttcccgggagcgagacctcaggcccagtcttcactccccagctgtgaaatgggtgagaacagagggtggctgagactcagggctgttaagggtggggtgggctctggacccagcaggcccggcacccaggccagggctccaggggaggccaggtggggcgaaggccaagaaggggccggggctggtcagaaagggctcctggtgaccagagcactttgcctgagccagcgtgggagggaggtgggctggatgagccagggaggcgccgggaggggccttggcagaggcgactccctccggcagcccccaggccactgaaccctgggtagtgagaaccggcaggggaggctgcagacggaggagtggaggctccttggctttgggggctctgagtagaagcacctagggggtccctcaagaggtccccaaatgctgccccatggtgaggaaacaaggagaggcccggcagggccccccttggttacaaagggctgccactgtgagaaggcaacactgccggctggggctgggctttctacctcaccaagcctcttcccacccaaagggcccagagaggggcagctgccccccacagcgggcacagcacctcctccctgtgtgatggggtggggcccacagtctcctttctcgcggcctccctgggctgaccctgggtcccagctcggccatgggggcttcggcatgtaaagcccatggggggcagagcctccggcccctgccagcttctggctgtctgtgtcgcccccagcactgggctggtgccgtggagggaggctccgccctcccccccatcaacccgctgaggagttctgtcttcccagggttgtgagggaagccagctctgcaggccgatgtccaagtccaggcgccgcctcctccagggagccttccagacctgatctgtgcagcagaggcccagaaggacctgggtgtggggatcctaacaggaggcgggggacccagcgcgtgcagagagggtcccagtgcttcctcctgagtgagggtcacccatccggctccagctgcacagagccactccctctgagcaatcctgctctctgccttcctgcattagctcttgcctgcacccagtccagcaaatccctgctcatctttcagacccaagttcaaggcctcctcctgctccgggcggctcatcactcggcctccccaggcagagaggctagggtcctgctcactgcggcgtctcccttgcccactggcgtgggactacaaggaaaggggttgacccccaccctcccctgccatgcccagcagggtgcagccacaaccgggaaggtgctagaggccccggcggggaggctgggccagcaccaggcgttggggggcaggttcccgtctctacgcccgagccccaggcggacggcgcatgcccctcccgctgccccacctgtcacccacctgctggccccgggctgtctctgctcctggctcccctcccagctgcgtccccagctgcctctccagggaggagtgacagctggcctgtgccacaccctcgagcccctccctggactgccccctccctggggcaggacccctgcgtgtggcacaaccaaggggcctgctgatgggggctcatgtgagcagtgccccagctgtgggtgtgggtgctgccagctgccaccgcctttgccctggcttcccagataggccccgacacacactccgaagctgtatcatgaacgctgtggtgggcggctggcggggagcggggttgctgtcccactaccctctggaagcctcagccacggagggcccctgtgggcaccttttcccggcacacggtgctgtgtctctccactcttgggctctgcagtgacttgaggggtcaagtctaggaccccaggggaggctgggctcatgaggggaccagagacctcagtgctgtgcagggagccccgaaccaccctggtggaaggcccagcccagctccccaggcctcctgccagctccctgtggtgtccaagggacctgtggtcaggcctggaggagaagctccccctcccctcgacatcctccccgcagcccttgctcttcaccagagcctcctcactccccaggaccccagagaggacggaccctctccagccgccctctgggctcaggacagccgggtggggcagccacaggagctgcctgcagggggcagagtcgggacggggaccgagccggacacccattctgcaagtgtctgcagggggaggacggaggtgggtagctgggagtgctgggccgaggatgggcattgtcaggccctcagcggggactgggaggtagaagtgggggtgggggtttgtggaggaaggagaagaagggccagcgtcccgagtcggggggtgcttggcagtggatgaggccggcaggaacagacctgagcttggggagctccactccgaacgaggcatccgtcagagttctgtgcatactggtgtccctggctgggggccaggccccgaagtggagcctgggactgtgagggtgcgggggtgtgctggggtgggaggtggatggagcccccccaccgcctggccccttgggctgaaccttggacttcggagccagaacagacataggaaatggcctaattgcatttgcgcaggaacaccaaatccctcgcagctgcacggggctgagccagggccacgggcggggtcggccatcccagagtcctgacagctccgtggtgcatgccaaggggcctgggccgctggccggggggcgcctttcccaggccagaggcccccaccccaccccaggagagctgcccccctttcagttcccagaacggagcccagctgtggaatagtgatgcggtgaggtcatggggagggggcccgcatgactcatatcctggggtaggggaaagggaggagacggagaaggggcccagaggcctccacgtcctcagctctgctgggtcagaggccaggggctggcggggcttctccccagcactgggttttaggggagacaccaggagatgcttactctgcatccccactctgtcccccaggcccctagccagggagagctcagtcagagtgatcctccaggggcccagctctgcatggatgatgttcccagagtacacacctgggcctcgtgccagggccggcaccgccgttgtcggggcaatggcaaggcaaacagtcaatgtttgcctcactaaagtgaggctgcagcaccctgaagggatccctggagggggacgtggtccccttgttcccaagcttgtctgcacatgcacgtggatgtcaagggttcccgtgtgtgagcacgtgcatatttgtatgtgcatggggtgcgggcatgtgtgcctgtgtggccggagcgtgggctcgtggagaatgtgtgtgagttgggtgtgcacctgcatgtgccccaggcctagggagtcccgcgcccggccgcactccatgtgttgggcatgagctgtgagcagagtgagggcctttatggggctgttggggcccggactccttgcccataggggtggacctgaggaaacgtgtgcacacgagcttctggggtctctgcgccaatgtgtacttccaagccccgcctcccctatggcttggtggagggggtctgtggagctggagtgagggccctggacccatcggaagcccaggtccaaggaggagcatgggctccctctcatgccccaggcccagggacacacaccccagctaagcccttgctcacatggaggggctgggacatgggaacacggggagcaatatggccaggcttcccctccatggaacccctccacctcctcaacactctgccccagcctgcgccgccctctgtgtggaggggctggggcgtgagtgagcacgagggcccctgcgccccaggctctgcctcctcaggtggaacaaggcccagcagcccccagccatgcggaggccggcagaagcgggaagctgggcctcatctgcccggatgatgggagccaggtgtggggaattaagtggcttcctcgggggccgggagttgaaggcacttctgaggagcaggacaggcaggcggattcgggggcgcggggggcggggtgcacaggcggctgggtttgcgtggctggagtcccctgtggcttcggtggggggagtgggccttgaactcgggcctgtggaagggcctggcttttgtctgagaggcttaggggagacctaggagagattagatcacgcgctggcagggctgtctggccaggggactggggcccagtggggatcaggctgcagggtcaggcagcggccactggccgggaagaactgagaccccagtggggagaccccagccctgctccctgttctggcctgggctccctccctgggtctgggataataagccctgtaggagtgtagagaccctggaccccctctcaggctctaggagggcgatgggaggcagggccatgacagctgaggctgcggtgtctgcaggacctggaccatctgagagctgctgggccggggctctgatgcccaggtccaggccagcctgtgcctacctctgtccctgaggggggcgcgtgggaccccaagaagccatggtttcaggctctgagggcagaagcactcccttacctcagtttccccatttttgaaatggctcaatcggctgggtgcggtggctcatccctgtaatcccaccaccttgggaggctgaggcgggcggatcacctgaggtcgggagttcaggaccagcctgaccaacatggagaaaccctgtctctactaaaaaatacaaaattagccgggtatggtggtgcatgcctgtaatcccagctactcaggaggctgaggcaggagaatcgcttgaacccaggaggcggaggttgtggtgagcccagatcacaccattgcactccagcctgggcaacaagagtgaaactccgtctcaaacaaacaaacaaaagaaacagctcagagagactccgcagagggctctgaaataaggatggggtggggttgggtgagccgaccctgtaaggtgcccccagctatggggttaggcccaggcaggacccatgagtctgcggagcttctgtgagcggggctggtggtgggacaggaggtgtcctgcctggatgtgctcaggccctcctttcctcagccttcgacctcccctttctccaacacgccctgcctttggggtgcaggagggagcacccgcaggtggggtggaggtgccgcctggcggtgggctgcggccagtctccctggactccagtatcttcttcctgggccctccagggtcacctgggtctaggtcctggttctacttagggagggaggcaggctgggagagggggacagagggccttttgtcctgtccttgagtttcttcaggcttgaatgggccttggagtcccaccttcatccccacagggcacaggggtgcccagatcctcacagggccccaggaccctcgcctgggccagagggcacctcatgaccacgtgggcagcctctatttaaagatggacaaggtgaggcctgagggccggcctgggactgacctcgtggacagggctgcctgcaccgtgtggccccagcaaggcctgtgtagatgggaggaatgggtgcaaaacagcacctgtgtcggctgtggcgtgactgtccctctgtgtcccccactaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctgtgagcagccccataacgcgtgcctgggctctagcccctatccgtgtaccctggggcctgggcagagggggaggtcaagggcctgggcttgggggttccagtgcaggatgagagcgaggaagggcccccaggagcaggcgtgggagtgggtgagtgctcctggggcgagggtggccacagccctagaggagggtctgccaatacctggctgcctcctgggcgctgacccaggctctgtgtccgtgccctggcccttgctcggaccgcctctgaccccagccacgcagcctggccgagccccccaccagactcccccgccagtgactcacagagccacgtccaacttggcggccaggctggcttgcttcctccttgggcccaggaggcctccgcggctgggctgggctgtttttccaataatgcttcccttccttctggcctcttttgttccattttctccaagtcagcagccttgggcagagtggggttcagcggtcaccatagtcaggcccttggccacccccaccaagggccccagctatccaggggctccccctgccacatgggaggcctgagaagtcggggcttaggaggacctcatgtagggtcctcatgtggggaccagggcagcccttggggagccccaggatgatgggggaggcacagccctgccctagggagccccagactgatgggggaagcacagccctgctgttagggagccacaggctgacgggggaggcccagccctgccctagcgagtcccagagtgatgggggaggcacagccctgctcttagggagccacaggctgacaggggaggcacagccctgtcctcagggagccctacactgatcgaagaggcacagccttaccctcagggagccccaaactgatgagggaggcatagccctgccctcaggtagccccaggctgatggaggaggcatagccctgctgagcctcaaggagtcctggactgatggaggaagcacagttctcaggctgccccagaactgacaggggaggcacagccctgccctcaggtattctgaccacaggagacacagcccagagccagctctgtggcagacagggtctcccacacttggagtccagggcctgagcgggcgccgtgaggtgagtgtgggccctgggcagaggaggcagcagccgcccagtcctaagctcccccctgctaccctcagcctcagcctgaagccctcggaggcccctgaactggatgaggacgagggctttggcgactggtcccagaggccagagcagcggcagcagcacgagggggcgcagggcaccttggacagcggagagcccccccagtgcaggagtcctgagggggagcaagaggacaggtgagtgagggcctcgagggcgggcgctgggcagagcagggctccctctggacctcgagggcgggcgctgggcagagcagggctccctctggacctcgagggcgggcgctgggcagagcagggcaccgcggagctcccttcaggccctcaacctgcgcctgagcagccaccccatcctcccctttccaagcagagcctgaaatgcccccatggccaggaaagggggagacaggaggggagggaggaagagggcgagacagcatggtggccggcgaggggccgcgaggaaacctcattctggggctccccagggcccctgggccccatccaggcagctgcgaggccaggccgggtgctgccacatcagcacacagctgcggccgcttccgtaatggaggctgagagcccgccgccgccccttcctccctcggggctggctgatctccattcccacggaggggagcaggtatttccagatgtgcatgccggagagtcggccgggaggacgcactttccagatgtggggatgtgtgtgcctgtctcaaccccaacaggcccaacaggggctgctcccgagccccacttcactacccctgctcggggtccttgccgctctcagtcatctgtggccatgatggggctgaccccacccgccctgcagggcctgggccatctgggaccccagccctgctcaggacccccttgccttgagtgggaccagagcccatggctgggctgacagttctccctggtcagggtccttcctggcccctctgaggccctaaaccagcctggagctctagggaccagtgttgctgagcgacgctcccttgtcctcctacaaccaggctcccactccccaagaaccactggtcctggcctggcgcagtgcccaccgcccccctccctgggcctcagtctcccccctacgtgcttgggagtcagcggctctgcttttctgagatggggcagctcccttctcccttggcctcaggcctaggcgggcgaggctgctcccaccagcagggggcgctttgactcttccgtggagcccagctctgcggccgccaccccaccccctgcacctgcctggctgcacagacctgctcctgaatggcccctctgtgtggctgctgctggctcagacccctgcccaccttgggcgggtgggtctgggtcttggctggcacgcacacccaggggcctgaaatcatggaaaattcgagaatttcccatcttctcctccaggttcagtcctgctcaaatgcagagccgctcaaagctgccagctggctggcctcccctcccccgcagccggcagccccttggccctgctcctcagtgacctggcccctacccctgcctagccctccaaatgacccagcctccagtcccccaaacacccaagggcccccacagggagcagagcaggagtggtggccccagcagcccggcctcgcggggaccccgtcagaccaaccgggtgtgcaagcagctgccaagctgaggcccagccacaaagctggggattgaacccagcctcagtgcctgggggaccctcagtctgtagagccctgtctggcagggactgggcagttccccaggggcctcaggccctgacacaggggcccaagcagactgcgctggctctgaggccactggaccttctttcccaatgggcttgggtctcagatcccttggcactcaagtagcctgactaccttcattttacagatggggaaactgaggcttggaaaaaggaaggggtcaaccaagcaatccaatggccctagaacggctttgcctccctttccacccacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggaggtgatggctccacctcagagggtctgggtgtacccccaccccagggatgagtctgccttggctgtctgcaccactctgtgggccctgtgggtctagcccagagtgggtcagcaccccacacccctagaccttgcagccccttctgggcccacattctcagagagggcaaggctcagtgatcctcttgcaagatccggagacatctctccagactcctcagtccctccccaccagctccagaactggagcacgtcagggccacagagaacctggggctcaggaaggaacagcatttgttcccacaggtgctgggcagggcaggaggggcacaagcagggggtcacttgggatgtctgtttttttttttctagcaccagaaatgtcagcagcccaggacacccagccccttggtcttggaggggaccatcgaacagagctcgcctcccctgagccctaccaccaaagtaagttaagctgcaaagcctgccatcttctcccctcccccgtactcatacccaaaaggccaatcccacatgccagccacaggaagaccaggcccaggcctggcttttgtctgctatccccccattgcccggtgctcagcgaacccccatgatataagggttgggggttggattagtggttggagtagctggggagatggagggtgggctttacctcggctgctgcaggcctgtgtctctctccaccctctgcagctcatcgacaggaccgagtccctaaaccgctccatagagaagaggtctgtctgtctgtctgtctgctttctgggctcagatcttaggtttaaccaagtgggggttgaagggagtcacaaggtagagatctggagaccgaggggggctctgggagaggcttgggcaggttgggagaagccttgtgggagacatggggcctgacacatcttctaccctccagtaacagtgtgaagaaatcccagccagacttgcccatctccaagattgatcagtggctggaacaatacacccaggccatcgaggtatgacctggctcccctctgctgtcaggtccctcctgcatcctggcaccattccttcatccaaccaacgcccttccatccaatcagtgccgccttattcaaccaacaccctatccaaccaatgcttctccatccagtcagtgcccctctacccaatcaatgcccctccatctaatcaatgtcactccatgtaatcaatgccccccctttcaatcaatgctactccatccaaccaataatctcccatcctatcaatgcttctgcatccaattaatgttcctttatacaaccaatactcctgcaaccaatactcctccaattattcagtgttcctccattcaatcaatgcccccctcggaacagtactccaccacccaatcaatgctctttcatcctatcaatgctcctctatccagccaatattcctccagtcaatcaatccccctttatccaaccagtactccttaatccaatcagtgcccctccatccaatcaagattcatccctccatccaatactactccatccaatcagtgcctctgcatccaatgtccctccatccaatcaatgtccctcccatccaatcaattctcctccatccatcaatgcttctccatctgaccaataccctccatccaaccaatactcatctatccaatgaatggctcaccatgtaaccaatgccagtcccacatgccagcccctccattcaatcggtacctctccatccaatcatccaatactcttccatccagtcaatgtccctgcatccaaccaatagtccttcatccaccaactcccttcaatccaaccaatacaccttcatccaatcaatacccctattcattcagtgctcctccattcaatcaattcccctccagccaaccaaaacaacttcatccagtcaatgcccctccatccaataatgccttgcacccaatcaatggccttctatcccatcaatttccctccatccaaccaaaatagtttcacccaatcaatgcctctgcttccaatcaatgcccttctattcaaccaatacttctttatctaatcaggacatctccatctaaccagtatccttccatccaaccaacactctactaaatcagtgcccctccatccacccagtgcccctccatccacccagtactcacttatccaacaagcactcctctatcttaccagtattcctccatccaatcagtgctcttctatgcaattaatgcccctccatccatactttactccttcacccaatcagcgcccttctagtcaagcaatacttctgatttcaattaatcccccttcaaccaaccaatactcctccatccaaccagtactcctccatgcaatcaatgttcctctatccaaccaacatccttctatccaaccaatattcctccatccaattaatgcctctccatccaaccagtactcctccgtcctatcaatgctcctgtatcctatcaatattcctccatccaaccaatacttccccatccaatcaatactccttcattcattcactgctcctccatccagtcaatacctttccatcctaccagtgcccctccatccaaccaatactcctttatccaatcaacgtcgttgcatgcaatcaatgccccttcattgaaccaatacggctctatccaaccaatactactccattcaatcaatgcccctccatctaacaaacactccctcatataatcagtactcctccatccaatcaatattccttcatcaacacctttctatacaaccaatagtcctccatctaatcaatgctcctccatccaaccaatactctgcaatttaaccactgtccctccatccattcaatgtccctccatccatcccatggtcccccagccctaccccatgagcagcatggaggcagacccacatctgtcttgtgcgccatcatctccctgatgctcttcaggaaagggaggtgtctcacaattgcattgaatggaggaaggcacatctttccagtgatccccactctagggctgcattgggaaatcgctcccagggaaaacacaaacacaaagcagagggttgcccagtgtgaccctctgatgtgaccacggtggctgtccactaaggtaatcctgatgcttttcctcctctgcagactgctggccagacccccaagctagcccgccaggcctccatagagctgcccagcatggctgcatccagtaccaagagttggtgggagacgggtgaggtacaggctcagtctgcggccaagactccgtcctgcaaggtaaggtcccctccaggggcaaggctgggctgcagagccagcactggggagtttagtagcaggccaggtttccttgttaagacaagcgtgggactgtccaggatgaatgtgggcagacagaaccctgaggtattgcagtagggttgggttcacccttgctggtgtagaaggctgtgttgtccgagtggaggtggatggcacctttattcctttccctgcttcttccactgggatcgcacagaaaaagttttggtaggcagatcccaggccccctggccaggtaaggcaaggcaggagagaagggcccagggcttctactccccaagatccaggggtctgcccttgtgacatacccttctgctgcccccaggatattgtggctggagacatgagcaagaaaagcctctgggagcagaagggaggctccaagacctcatcaacaattaaggtagagcctaaatgtggttggtgcaggcagggtgggtgcagcaggggagggcaaagagggactgtcctctgtgcatctgggagggcttcccagaggcggaggcagcatcatctcctttctgctgctctcaccttcactcttggtctcctttcccaacagagcaccccatctgggaagaggtataagtttgtggccaccgggcatgggaagtatgagaaggtgcttgtggaagggggcccggctccctaggcgtcccatctcggtgagtccctggcaactcacagaaggggatgaggtgcacacacgtgcactgtgctgggaacttggcaacctggaggctgcctggagccctgttgcaggctacaagggtggactccgagttggccagaacccagaccagctcagtctcccagtcctgtgcagatgctgcctctctcacctgataccagattcaaactctctgctcatttcactagagtcagcccggctcagccactgctccactagggaagctcaaggctcccatctgggactccccaaaagccacagcagggctcgtgagggaagtgaggggcagcctggccaccacagggctagcattgaaggaagcaggtggcatggagcccaggttccctgaccatctgtatgctgagggtccatagaggggcaggaacttaggtcctactccctgtcccagccgagagcgattcagaggtcctgatgccctccccatcccatgctgcagacagagcagtgccactcctgccatggtgagacacacatttattagtgacctgggccccaggctccatttccagcacccatcacaccacagggtggggcagctgtcctcctaccatcttcccctgccaaaccctgactctcaagcagctgtggcagaggctttttctggtacctctgtgtccctctcctgtggttggccacccccaccagagcctggctgactgctgagtaggcccctccactctccccaccagggccacagccccttctctgtcccgcttggccaagctgttcccatagggttgggactgagggctccctcctcatccagctgtcaaagcctgggcatggccagtgctgagaccctcgctgtcccaccagcgaatccctcgagttctgccccctcaggctgtcagcccaggtaggggaagcagaggtgggccgagagagaggtcacgctgggccctcctccacccctgatgagcccctccctgcctgcccctgagcacttgtattggtgccaagtcccacgctggctgagggctcccccctgcaccctagtcccaggatctggctctgccatcaggaagcacaggcagcaaaactgctgactgctcctgacgccgatggccaagccagcctgaccgcacccatgcctcagcaagcagagatctggccccaaacctttgacagcaaaaggtgacagcaaaagggaggatcagtgagaggcccaggcccctgaggagcctgggctaggtcagtagatgcagtcctctgccatcttacctaaagttttcatcccaaggcccccatcctacatcccgacgcagaccccttctctgttcccctcacaccactgcagcccaggggctccagctcgtcctctctgccccgtccacctgaccaccctcctaaccatgcagacttccctcagcaccccatgtgcccttcccaggctgccctgcaccccatgccccttgggccctggtgcatcttcatgcagcaactatgggcccccagctagagcctcagccccttcttctgtccatcccatggtcctgggctctgggggccattctggccacttcactggagcctccagccagtcgctgtgcggttgaagttcttgggctgggggctcagctccaggatggagcggactgtgggagggggccgggtggcctcctgcagcttccgggcgttgaagcgaggccggtacaggaagggcaggcgggtgaggctggctggggtgtgctccccaccgctgggccctgccaggcgcccttgggcctccgccactgacatgcggtacagcacggcatcccacatcctggaggtccgggaggcgggggcccggggtgcggtgagggcgggcacctcctgctctgtgggggcaggcacctcctgctctgtgggggcgggcacctctggctccaggctctgccgcggctctgggcacggaggctctggggcctcctccagcagctgcttcttgagccacgtccagccactgagccggggcttgggtgcaactttggggacagggcatgggtgagggcctgatggtggggtaggggatgaggcccaggcagggctggacactcgctcggcctcagcggcggggccagccatcgggggctcctccaggtgctctctgccagggcccatggggaccaggctgtgcggtgaggactccagcgagcggcaggtcggggctatgggcaccacaaccctggcactagcctctctgggcactgaggcctggaagccgggtggcggccgtggtacagggggctcctcaggcaagggactggcagcctggactgcggtgggcagtgggcggatgtgagccactgggaccaggggctgggccctggggggacttggggtggcatctccatcctggctgttggatcccacttctggggctgtcctgggaggctcaggggtcccattgtgtggggatggtgccagctggatgtgcacctgggtgacgtgggtgcccccacccccagagacagggacgaagccactggggggccgggtaggttctggggccgaggctacaacctggggccccatggccctgaattgagcagctagaatcctgcgctgggtgaggccgatggagaacgtggacttctgcaggggtgatgccacgtggtggatgatgggggtgtgcggggagcggggtagggcagccaccatgcggggagcctcggcggggcgtggggcttcaggaaggcgtggggcttcggcggggtgcgggccctcagcagcgtgcggggctgtgacctcctggtcatggctggcctcactcacgggggacagggaggtgcggaaggccctgggtggagcgaggtgtgtgcctcccatcatcttcttccgggctgccttcctcaggagcttctgcaaacgcaagttgtccttccctggcttgggcagcaggggcggtgggggtccaggggttccctggaggcttgggccgcacacctcgggtgccatcgacgcagccgatatgagcatgactgtgtcctagggtgggagggacagtggtcaggccagccctcctccctcctgaggtgggaggcctgtgtctcccgtggtccaaggaggacctggggccaggggtgtggaggcctgagtattctgcttcctgagcacccagaacctgccagggacatgctgagctcgactgtgccttggggactttggggtggccccaccatcaccctagtgtagaaatgaggccacagaggccgagtccctccagggatggggctagaacctgcctccagggctctgtcctccatgccaccccagcacaaagcaggccccaagtacacagcctgggtcaggccgcaacaccgtgtgggctggggtgggagacggagacgcgggtgagccccaagtgacaggcatgcccctggccagctgctggccaagcccagggctggaagagcggctgcccccagacacgtgaggggcgccctgttgtcgccggctcgaccacaggcgcgtccgctgcgagccagcggtgaggggtggcggccaagaggcttgggaaagccgaggctgcatcatcagaggtagattggccggaaggtgggagcagttttcgctgagctatgctaaatgggatattcccgcagacctcctgtctggggtggcccggccaagccgcccaccctggtttctgggcaccacgtgtttgcaaggacattgacaaatggcatctgtccgagccagaggctctctggtttggggaaggagggagtcctgggggctgccgctggtgggggctggctctgccaaggcaagaacagagctgctggaggggtgggggcggaaggagcctgcttaggactgctctcagctaccggcctcctctggatgacgggactgcaggaaccacgagaaccccagttctagctcccggggtgggcaggctgcttggcaggcaggccgccttccctccaccaggagtcaggtctccagccagaggtcctgacccagggcacaagtgctcgcactgggaagcaggcctctgaggcaggacgtcttctcctgtggtggagtgggggtgtgggcagggcagggaggccagcagagagaggctcggggagcaggctctgtgggcttgcaggaggcaggtctgtggcccctccctggaccctagcctaatgccccctgcaccccatgcctatgttccagcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctcatgtgctggctgtcttgtactcactaagggggcagggctggccaggatggaaatgttgggccagtggccagcccattcccacactgcacagcatgctgtggcctctgggttcaggcagtctgacctgtctcatggcctttgcagtataagacgccaggacataagctctctggtggcctaagtcagagcacacacaatgggtggggtccgggcttccttttccagaatgtctgtgatatccctaccccaaccaggactagcccaatataaacttctgtgccttgacttcgcacccactgagggcaagatccacctcggggcctcccccaacaccacacaggaggtgctcagtgaaggtttggaaaacagacaaatgggtggatgggtgggtggatggatggatgggtaggtgggtggacgaatggatagatgaatagattaatggatggatgagtggatggataggtgggtgaatggatgggtaggtgggcgagtggatgaatggctgggtgggcaagtgggtggatggatggatgggtaggtgggtggacgaatggatagatgatcagatgaatggatggatgagtggacagataggtgggtgaatggatgggtaggtgggtgagtggatgaatggctggatgagtgagtggagggatgggtgagtggatgaataggggatggatgaatggatagagggatatgtggatgagtgaatgagtaagtgggtgggtgggtggatggatggattgatggatggatgagtggacggataagcaggtgaatggatgggtaggtgggtgagtggatgaatggttgggtgggtgagtggagggatgggtgagtggatgaataggggatggatgaatggatagacggacatatggatgagtgaatgagtaagtgggtgggtgggtggatggatggattgatagatggatggatgagtggacggataagcaggtgaatggatgggtaggtgggtgagtggatgaatggttgggtgggtgagtggagggatgggtgagtggatgaataggggatggatgaatggatagagggatgtatggatgagtgaatgggtaagcaggtgggtggatggatggactaatggatggatgagtgggtgaataggtgggtgaatggatgggtgggtgggaggatggctggctggctggctggctggctggatggatggatggatgggttagtgaatggataggtggatggatgaaaggagggatgcatgagtggataggtagatgagtggatggatggatgaagggatggctggatgaatggacagagggagagaggggggatggagggagggatgagtgagtgaatgggtaggtgggtgggtggatggatggatggaaggagcgataaatgaagggatgggtaggtagttgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcagggatagatcaatggatggacagagagtgggaaggatggatgaggaaagggatgaatgagtggatgggtaggtgggtgggtgaatgaatgtatgagtgtatgtgtggatggatggatggaggcagggatggatggatgaagggag

SEQ ID NO: 17118 - DNA, 4886 bp, Human
tctccccagcaagatccatcaccatgagccaagaagataaaattactctaaagaaaaagtttcagggagatatttaatgactcagagttttcatctagaataaatgggaaataagttgtgaagaataattctcttgtttggcaaccctttattatgtctccacaatctcacctgtacttttaactcatccttgcacttacctgattgtcatgaatgccacaaactattattaagggcaaactgtgtatcaggaattatgggacacagagatcctaactgacttcctcaagtcccacagctcatcaggagcaaagctagtcaaggaatccacatcccctgcccttaggatcattgctttttcctttgcaccacagggtcttccttacctgtctgaatccttaatactgcaacacttatctatccaagagaatgcctgaaccagcacatttctttaaacttttcagtatagacaagtttaacatatgtaaaagtagagagaataacgtaatgagcccccatgttcctttcactctgcttcaagacaattatcaactcataagctattttgttttattcgaacccctcctactcctccagcagtgcggtggtaaatgcaaaaccatcagctctccctggagaaatccctgatttgtagatttctgtggctgacttcaagttaccagcatgatgttgccaacggaggattggaaagagatgtgcagaagcacagttatatagtattttcaccacatagatataatcaatgcaataatttcaggagcacagatcatagtaattgtagtaaaataactagcaagcagtaagttttgagtatttattagcttcttaaaatttttttaagtgtaagttcatagaatttaatttttaataatgactctttaccaccagctcacaaaattcctgaaattctgacaatcaattatttccaacaagtacaacctggctctacctcaccactgcactcttccatccacagattactttcttttaattccagacattacattactttatccataaatattttagcacgtatctctaaaagataaagactttttaaaaacagaaccacaatattattatcacctgtaaaaactttaggctgggcacggtggctcacgcctgtaattccagcactttgggaggccaagtcaggaggatcccatgagcccaggaactggagaccagcctgggcaacgtagggagaccatgtatctataaaaaaaaaaaactaaaaatctgccaggtgtggtggcacatgcctatagtcccaactacttggaaggctaaagaaaaaggattgtttgggcccaggagatcaaggctgcagtgagccatgatcacgccactgtactccagcctgggtgacagagcaagactctatctaaaataataataataataataattccttaatattccctcattgttccctaactgacatgtaaattcttaatagttcgtttaatttagaatgcaaataaggttcctaaacctttcattgattcatgtggcccagaacactgttttaatttacagtttctctctctctctctctctctctcatgctccctgtctctttttccatgcaagttgtttgtttatttgttgaagaaatgagagagtggttgccctttcagttttctttattggcaaaagctctaacctggtaatagaactggatgtccataaagtacaaagcatctgctctgggaattccactcctatgggcacttgtggcttagctctttagggtgggcatctgctgctcatgaccaatagagtcctggccatgaaaatcctagtcctataatatgaaaatggagttttttaaaaaatactgaaatcaaaacaaacaagcacgtatttggatagttaaaacacggagaacagcactccagcccccaccacctgatggggaaagaaatacctgccaccacattcacaagcccgctatcaccagctttcaaaaatggcaagcccactctcctcccgccgcccaagatgccgaaaggaaagaaggccaagggaaagaaggtggttccggcccctgctgtcatgaagaagcaggaggctaagaaagtggtgaatcccctgtttgagaaacggcctaagaattttggcattggacaggacatccagcccaaaagacacttcacccgctttgtgaaatggccctgctatatcaggttgcagcggcagagagccatcctctataaggggctgaaagtgcctcctgcgattaaccagttcacccaggccctggaccgccaaacagctactcagctgcttaagctggcccacaagtacagaccagagacaaagcaagagaagaaggctgttggcccaggccgagaagaaagctgctggcaaaggggacgcccccaccaagagaccacctgtccttcgagcaggagttaacaccatcgccaccttggtggagaacaagaaagctcagctggtggtgattgcacacgatgtggatcccatcgagctggttgtcttcttgcctgccctgtgtcgtaaaatgggggtcccttactgcattatcaaggggaaggcaagactgggacgtctagtccacaggaagacctgcaccactgtcggcttcacacaggtgaactcggaagacaaagacactttggctaagctggtggaagctatcaggaccaattacaacgacagatacagatacgatgagatccgctgtcactggggcagcaacgtcctgggtcctaagtccgtggctcgtatcgccaagctcgaaaaggcaaaggctaaagaacttgccactaaactgggttaaatgtacactgttgagttttctgtacataaaaataattaaaataatacaaattttccttcaaaaaaaaatggcaagcccaggtcaccttttgtcacattctagcaaaaagcagcagaagcagggttgtaaggcaaagagaaggctgactagtttgaggaagagttggcaggtaatactagaaagctcaactgtctgagatctcattagaaaacatcaaccttgaaacttcagctttctcctttcccaaggagttctgtgtgggctgctagggtttcggcaccagttgtcactgcaaatgtcgtttggcaggggcaagaagcacaggaatctctgacatgcttctgaagggtttcagagatgaatcagcgcttctgcatttttcttcttattttttttcttcccaaatatagtaccgggaatgaaaacctcgctcatcctatttcccaaacttggcagttaagacagttttattgcactgctttattaaagcgtagccatagatttacataattaaaccaaggtctgcttttctctccccctgcatctacatctgtcactcactgcagtgtagcatggtaattccagctcctctgcacaagtgagaacttgggaggcttggggtggcatcaccccctggtaccaaggaatattctctgatggaaaaagagatgatgagttttgaccatgagtggagataaataatttcttgcctttcagcaggaagctactgggtctttttcattgcctcttagagctgaaagggcccttgaaaataatctcatatagagggtgcaatctggtaatttgggcctgatttggcccacatattttttaatttggcccttgtaatgtgtatgtttgcttttcatttgaattagttatcaatacttaaaattgagaaattcatataaaaagccaaatttagggcttttcttgaaaaacttgttagtgttgtccatgtgggggccttcatttcctgcacaccaggcacctctgagctgaccagcagctgcccccttcaggtagggcagcgatctgcagttactcacagttgtccccactcctctatctctgcatccacctgcagttcgcacgtacctgaccctgtaaaaatttgagtttgtaaactccttcacattacaggttaagaagagaaactccacacagattcctaagtagttaatgacagatcccaggtttcctgactccaaacagtatgaacaaccatttatttgatggaggtgtccaaagacctgaattctgactccagctccatcacctattggctgcggcatctaagctcaagattgaacctcactgacacacacatttcctcatctgtaaaatggggctgatggtagcatgttgtccacctcactgggcttatgaggactaatgtgtttatggaaaagttgagaaaaggcaaaaaccctatataatcttatgcttaatattattagtggtattttcatgataatattttcatttgcaatttccagctcacaaatgtctacattattccaaaatattatttattaagtacacccctcaattcaactcaatgagtccttactaagcatctactatgtgtccaggcttatatgttgatgtgcagaaatacacggggagatgagattgtaagaacacagtataaatgaaatgactgacaaaatatgtggcatataatacataatacaagttataagtctgtatgttgcttaaataacataagatggctcccagaattacatttccataagatggctcctagaacctcagaagcctgagataagaacctttgcattctctattctacagtgtaacagcagcagcataagtactaccaattattgaatacccataaatgcaccaagcactgatcagagcactttacatgaattatccccatttaattcctcaccaactctatggggtaggtgcttctttattctgcttttccaattgaggaaattgagacacagaggtcaagtgacttgcccaaggtcacacagtaagcaatggagccagtaatctgagccatgctcttacatacaccagt

SEQ ID NO: 17119 - DNA, 308362 bp, Human
  misc_feature (1)...(308362): n = A,T,C or G
ctttgccctaatgcttcttccactgaaaagatgagtctcctcagactctcatgtttctccttcactcctgtccatgaaatatcaaaatggagacaaaagatttctatgagtggtgggtgggaggaaattatgcattatcagaatgaatagaaatttgggaagagcctaggacaatttttctggtttgaagccattttgttccattgttccaggctccagactacgtctcgccaaatccaaagttctgtagcaactgatatactagctgggctccagggtccttctatcccctgtatattcccaattttatccccgatgtatatcagttcgctttacactggcaggagagttcatgttccacttagaccaggaggagaggatatgaaaaggaaaatagcaggtgtggggaggataaaacccatgccttctacagtaactgtaaagtaaaagtgaaaaacgtgagagataaagaggattctttttcctcattgcgggagaaaggggctagggagaggagtctatagcccaggaggttcatccgcagcatgctatggagaaggccaccgtcactgaaatccggtctgtactgtaggacttcataggttctttgctcgccttagagcagaggggaagaagagtcagaaagaattgataacctctgaggtcatcagtcaggggcctaggctgctaagtccagaggcaacaccaagggatcaatgcagctaggtacagttttctccagcctcaactttcaatccccacccccagaccagctcattcccacacctccctcctccttggtcagtgagcctgagcgtccttttcattaaccttttagttactacctctacgcacatactttttcctatgccctccaaagaagtcagccccatactgcccatcactgctcagcaccgcccaccccatgcccccgcaagccggcctcagcactagtttaaggggagggacacgcctcccaaagctgcggggatgggggtgggggttgctcactcgccctcggatctctgctgtaaaagcggagcggcagagaccgggcatgcgcagcatcttcgggcgcattgtgatgggaactgcttctctgagtctctacaaagactccggagtaaccactaatggccctcctaaggccccccttctttaagacagacacacaaacacagaggcaatgcagctatttttttttaaagggtgggaggacgttgcagcttgaaaggttgatccacgttaggagtggtgtatttctattgatcccatctccggtgttgacaaacgccagcgcctaggctttgcagtccggggctgcagtttgcagtagagctaagcggtgtgcggctttaattccacgtcagatcaactttgatcaatatccccctactggcccaattggaagagcccaattcaccggcactgagccttttcgctctttcctttttttccccccctctttagacctaccatcttttgcgggggggggggggcgcggagagagtctcagattgtcttgataatttattctttcgttctctttcttttgcttctctatttttgtttttcagtgttttgcttgttttgttctgttttaggattttattctctctctctctctctctctctctctctctctctctctctatcatagggacagaaatcgctttggcaaacccagcttgcagccaatgaacccgccttccagattggtgtgaagacagaagtgaggtggggggaagggagggggtgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaaggggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcactgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagcgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggcatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtggggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagacgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggttggtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtattctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgatagcattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgtttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgaacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtctgaactttccctgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaaactatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcatcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctagaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccacttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaagcaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatcttccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcaagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccacgcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatctcccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgatccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaagtaagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaacctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgttttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtgactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttggtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccattgttgaaaaagaacgcctcccccatcaaaaattttatctggtctaaaatgtatgaagtaaaagcagcttagtctaagtagagagaggcttaaattggaaagtattggaaaattaatcctgtcagaaactgtaattatccccatttcatagatgagatagctaaagtccaagtgctttttcatacagcagtttaaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctacaaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggattcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggagaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaggcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaataggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaataaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacacaaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaagcaggggttgcagtcctagtctctgataaaacagactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttaaaggttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttatcgcacatttgagcccccagaatcagagtcgtgcttcacactacctatcataacaaatggcatggaggggttctttatgttacaggttactgagttggatatttaaatagcacattcggaagtgttctgagatatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacactaagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagctctcttctgtatgaccttgagacagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaagaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttactcatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttagggaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatagagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcaaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagaggacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtggggttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctctaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctactatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagtaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacattatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagccccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgcttttatatgtaatttaatcctcacaacacgcctctggggaaggtgccattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcattttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcagttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcgtgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaaaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatagcatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactatatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggggtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgcgtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacctgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctacttcattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattacttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctctcatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacgtcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtgagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaccttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaaggtcctggggcagaaacaatcctggaatgtttaaaggaaggaagaaaaccactgtggctgaagaatagtagcctacattagaattatagtgatggagactgtgtgaaggaatcagatttatgattcattttcgaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttacacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcacaatctcagctcactgaaacctctgcctcctgggttcaagcaattatcctgcctcagcctcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatcccatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatacaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttgaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctctgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcctacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaacccttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacatacggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttctaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatggcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctttcagtttctctcttctaagttctttacgattcaacatggcttccttctgcagtttgactatttatcttcactgaataaaggtgatagctgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggacctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcatgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccaaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggctttggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactacgcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacacaaacttctcctccatacccaattaatgtgtccaccattaggctatcattcctttagctgtggtttgatcctgtgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccattgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactaagaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatggaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtacgaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaattgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatataatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaagaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctctcctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcgacctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaagaaagaaagaaagaaagaaagagagagaaagaaagaagaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttacaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaaaaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcagttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatggcttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcattcggcccttggcacatgaggctgatccccattgatcagaagtggcaaaagtgtagtccaagtgctggattcacctnnnnnnnnnnnnnnnnnnnntgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacctgtaatcccagcactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagccgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagtattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagactttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggccaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggggtacggttaaggtctagtaaactaatcagctttactttactgtatgtcaatctctttttttcttctttttttttttttttagtttggtttattgttcaaagcattgtctctttgcaaccatttgattctttgaaaacaatggttgtgctttcttgtcaggcagtggtgcttttctaatagaatggttgtaattaaattgtggtctgtgacccaaaaggaaatacaattctccagaacatcattgttcaatagaaaatatatgcaagccacatacatgagccacgtgtgcaattttaaatgttctagtagtcatatgttaaaaagtaaaacaagtgaaattaattttaatgatacattttatttaacccaatatatccaaaatatgatcctttcaacatgttatcaatacaaaaaaaagaatgacaaattttacattcttcacgctaatcttgcaaatctggggtatattttatgcttatggtacatcttgactcatactagttacatatcaaatgttcagtagtcacacatggccagtggttattgtattggacaatgcatctctagagaaagcagctgctctggaacagatattaaaattaggggccgggcacggtggctcacgcctgtaatcccagcactttgggaggctgaggcgggtggatcacgcagtcaggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaaattaggtacacaggtgaaacactgccacctcaagtaatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcctatctgaagtggaacagaacaataagcaacttcataccccttattttaggcaattttgacctcatgagtaaatgtcaatatgctgggatttctacaagtgcatttgtgttttgttgttgttgttgttgttgttttgttttggggtttttttggggggtgttctgttttgttttgtttttgaggcggaatttcactctatcgcccaggctggagtgcagtgacgcgatctcagctcattgcaacctccacatcccgggttcaagcgattctcccgcctcaccctcccaagtagctgggattacaggcacttgccaccatgcccagctaatttttttctatttttagtagagacagagtttcaccatgttggccaggctggtctccaactcttgacttcaagtgatccgcctgcgtcagcctcccaaagtgctgggattacaggcgtgagccaccatgcccggctgcatttgtgttttggccttcttatagttcacactgtggatttacatttagccaatttttaaataatatttcattcaaataaatcatttgtcttggtcatggaaaacataattttgtccagtgaagttgctggttgttccttcttcctgccttttgccacaacatattcagcacactgcaccaatccgctgacagtgttcccattgcattggtggatgtacaatacatggattcatctgtaattgcattgtttgcatgcaagcatttaatgtttcaatgtgcttaaaatgttttactcttgagtaggtgccataggcccattacaatttggggcatatgtttttataggataatattaatacatgattcataatccattttcaaagtgatccactttctttctgtagcctacacatagacaggcttgctggacatgagcaatttcaatctaacttaattatcccaaattttgaggtgctggcctccaaataaataatacacctgaaatttgtgtagcagtcatccaagtgttctcacatctattggctcatttgagataagatggatcaggcaattatcagtaagacccagcccatgaagtgacttactcaaggcaacacagttaggtagtggcagttctgggactagaacccagcccttcttctgcctatagccatatctttgctaaaccatgctacttctaaccacccatggcctgatgtcccccaggaaacttgaaatcctaatgggatcctgtcaaatggagagcagatcttgagtttctgttccacttgtccacaaaaaaagtcttgagaaacttcaccaagcctccatatgccccattccttatgcactccacacaagattgaatattcaatcactcctactttccccagaaagaatctttctgaaacaggattacatcaaggctcagggtcacatgacctccagactctttatcaacgattccatctgagaatttatgtccctactatccaattactatagcctcagactcttattaaagccccagagcagtattcatcaaacattagtgtgcatgcaactcatgtgggaaccttctaaaaatatagatcctgatccagcaggtctgggatggggcctgagggtctagatttctcacaaactcccaggtcatgcagatgctgctggtcccaggagtagaaagattctagagaaaataaactcagagaatgtaacttaagaaaagaaaggaaggaagaaaagagggatagagatacaggaagaaagaggaagaaaggaaggagggaaggaaggaaggatggaggcagggaggcagggaggggggaaaagaaagaaagagggaaggaaggagggaaggaaggaaggaaagaagaaagggagggagggagggagggaggaactgaaaggaaatgaaaggaaagaaactgggatcagcaaacctttgttaggacataatgttgccatccaaaagtggcggcctggaacatcaaacctgaggggaaagtctcagaaactaatatgccacaacttctggctttcctttactcatctgagttgatccacttttgtgaagcaaaattcaggctacttgaggcaacactcacattttaatagactcccatgccagtgtggttatagcccaattacctagcaccttggcaaccatctccagggtgaaagaaaggttgggaagagcatctgcaaacaaatctgtcctccaagcctgtacaaagtctccagacaagaagcaaaagcctcatacgacgccaggaaaacctcacttgtgttagtcaagaggcataaagcaagctgctttgaaacctctctgttgtcctcagccaatttggtgatgtgattaggggaatgttggttaagtgaagagtgagatcttcacccactcatcttttatttcccaagaaggtctggaatatctcctggtgacttctaatttgttacctagttattaggcttccagttctctgagttggcctaaatctgtcaaggtctatccaggggcaccgacatcaagaggtaccctgagattttacttctattactaattatcagagcccaccttgggagtttatagtaccagtaattgttcaggaaaaatgactcagggcaaatcacctgcaaaaatgtgatctagtgaaatctggttaataaaagggcatccttgaaagatgagggagtcgtttctcattttctatgggtgatagtcacatcaggattactgggcttattgtgggaacatgtgcctcggcctcagatcatgtttagctcccactagggagcagaaagcctcttgactacctggtgcctctctgggttactgaccagccactggaagtgtatcctcccaagcatgccttggcaggtgactgcccatcaagtgctccagattcactgcaccctagggttgactgtgctaattgttttaggaagttatttctcatttcctaattgcagttcagaagtacttctggcttctttggtttcttcaaaaatatttttgaaatctctgtcctttacaagacctcaacatgcctgaagttaggggaaaagattttcatttttcttgtaggagttttctgtttagtcatcctaaaaatattagctttgtggatgcagcccattttcaaagtgatccactttccttctgtagcctatgcataggcatgcttactggagacattttgctgctgaaaagaattcacgttatgttaagtatgaaaaaaaaaagcattctggataaccaaggtgatgatgttctttctcccaagggacttttacatcagtgataatagttcatttgaccccatttaaaagtggaaacagaggcactgagaggttgggttcctttcccaaagtcatgccactagttagtgatgtcccatgcccactggggagacagggggagactttattctttctgccagatacaaaacttctccaagcttctgcgatacatatgactcaggacttaggggtgccaaggaagaggtttgtctactttcatgttagtcttattctaccatccttggatgcttttggccttcaggtgcatatttgacattcttcttacagatacttttactacagggccagtggtagatcataattacgtcattcttttgggataaaattcggtgttagcttagaagaaaaggaagtgtttcattagtgcagaatgaaaggataaagagagggatgtaaacttgaagaggaggtaagaaagtgtcctacagtattcagaatcaggggcaaatgaatcccctgcactagttagtgcctccaaaaagaagacactatcagcatttcaatcaggcctatatgtcagggcaaagaccgcattgatgccaagtccccttcatgggtatcactgctctggcctcttcctagaatctgctgtctctttaaagtcccagagctattttcagactttaataactaaggttgtaggtactaagagaaacaattgctcacttttctagcaataagcaaaatattttcttctcacagttaaaatggatttcaattcagtaagccatagaacactgtttaccctctgtcctgggtgaacaatcctttgtcatagtttctgcaatcagaatacactcttttagttcttgtgaatatctgtattaaaatgccatggaaactttctggtatacctacatcataagtgattaaagccttgaattaaacttcctgcaacacctgcatattccttagtacaatacatatagtagagaatgtaaccagacctgtcacctaaagccagtcaaataaatgaggtgcaaccccagaaatgccaatttcagaaaacagccatagttttgtccaagatagactgagccattataaacttctcaattcctaataggaagccccttcaaatttaaatatccccttgcctttgcagatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgtaaagaaagaattctgtttctgtgctttggctagatgtttaaaatttacttggatgcagatgccaagaagttattcactaa

SEQ ID NO: 17120 - DNA, 35707 bp, Human
ttgggtggtttttccaaaacaaatcgtctttcccaaaggcctacctaagtcttcattttccacaaagtagaaaactgcccacagctttgaaatggcagcataatttgtatttctaccaccttgtccaggtttcagggatctctggtccagtttcagtcaataatgctaactatcactgcagctcactgacttctttcttgtacatagcagtttttcgcaggaagaaaacaaatctaacgaataggaataacttcaggtgatgctgttttcttcccgcttcctgggatcactgtctttcctctgaaatggttttaatcagaaccaatctgttatactcaggagcctaaatcaaacacgacatgcagagagacaaacaagaaagcaacaaatgatctgagccactgaacaagaaatatatataaaacagttttaggaattacagctgtcacaacttttcaccatggggccttctctgtgatttagaaaaaactgcatttatttgttattaggatcggagacaagagaaaaataccgacccaaatagccactggggaagagggaagctctgatgccaatttatgtggaggatggagccaaactgactcacacacacacacacaaaagtatgtactggcattttccacacagtccaggtcacttgggagcttagccaaggatattttgagcattcgactacctattgtgaacaaggttgggaactatgaggcgctatgtggccctgatcaagctcagatgggccaaatcctcaaccaaaattctctttcccataaatgtttatctctacatttcccacagaaggggattctaactcagttttgcttctgaaaccaaactatccaaggccaggtgagatgactcatgcctgtaatcccagcaatttgggaggccaaggagggaggatgcttgaactcaggagttcaagaccagcctgggcaacataacaagaccccatctctacaaaaaatttaaaaattggcgcggtgtggtcgtgtgagcccctagccccagctactcaggaggctgaggcaggagaatcggttgggctgggctgacagtgccagaccctgttaaaaaataaaaattaaaaaaactcctaaatttggaaacacatccccagctgagggccgggagatacttctcaaccgtaatccagaaccctctaaaatgggatgtggagaggctgcagcctgtagtcttgcgatgaccttttagcacctgggcatcttgcgcttctgtcattccgcccacacccgctcagctccatccaagagggcccggcagtttggagtgaaagcttagcttcccaacgggtaaatgaacctgcctcccattcacagggcggcctctggctggacacctggggcctactgcctccttgttacacattaaccaagttctggcctccatcgtaacagcgtcagggaagttttttcctggctgacagccgcagatgatgaccgaagacaacgtcttaactgagacgggccaatttggcaaatggactgctttcctccccagtgcgggcaccttcctcctctgtccggcaactggaccccactgtccccagccctctgtcacccccaaacctgcccaccgcccgcctctacccgaccctccctcagggaaatcgggactcagcccccaacgcccccacctgccgctctgcccacctcagcgcacaccgccagagcgcccagcccgcgcacgtgcttccggcgcgcgccgaagtcctcacgcgccccgccccggcctccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacggtacgaggcccgggctggcggggcgcgcgggtcgggccgcggggggcgtcggtggcgcggggccgggcctgggctgcgggggtcttgagggtggcggtggcgccggccggagccgggggacggatctcggaggtgtctgggcttgggaccgggatgggggacgcgggccgctgggggctcgggtggggtagcgggtgcgcggggcgcgggggcgctgtgcacagcgcattggcgtgatccgccttttcaagtttcctcttgctctttctctgctcttgcactcttagcgcttttcccctctcagtctaatgtaaataactgaaggtttgaaaagccagcttgatgttcggtttcagctgcgatattatccccagcgagcctgtgaagggcttagggcgacgcctgtgttcctcaaatacttcagtttgacctttcctggtttggaattccttgctttacattgggattacagtgaggagttattaataggctaattcattcatctcttcctccggagacctcttgcttcgtttatttctccctccctctcagtgttttttagccttttctgggttgcattttggctatttataaacatgtcttgtctccttcttaagaccgtaagcaccttggaagcaaagccctggctgtttaatctttgtttcccctgcagcacccagacctggaggtgcttgacaaatactgttttgaataagcgaaagctttcccagtgcatatgctgtgtgcttttttttttttctccccttttttggccttgcgtggtaagaataaacaacttgtactttgtatcagagttgaatattaatagatgtttaccagtccctaatcactctttcagatgtatgtattctcagattaagactttgatttggagttttacagtcccagagagaggctcaagttcaaaattacatacctcaagccaaattagtcctgtctccatctgtcctggcatgctgcttccttctctgcaacaaatactgtggaatggcattagggaagcgagcaccgtgctgggagggctgtacatcctgcagaaacacagcagacacggctctggtctcatggagcgtagtctattgagggaatgcagtattaatccaattgtgatactaatgagtgaataattaaaaaccaggcaagagttctgaaggagtgtggtccgtgaaagtgtgttagaaagaaagatgacccagacaggggtgtcagggaggcattaaccaggcagcacgcagaacatctcaggcctgtgggaagggtaactcaagaagggtgtgttttgagtaccacgctggagaggtggatgaggaggcagagaggagagggtcttgaggaaggcgtcagtttgtcttgtaagaaaaaatgggaacttttggaagggcttccatgctggggtcacagtgcatttggtccaccttcagtgagtgactcctgtgactggtactgccctgttcttggtgacaaaggggcatgacatctgttcctagaaggcgtaggaaatcctccagtaagtcgatgccttcatcaggacaagtgtttgcaaatgtttctgcaaatggcagtggtctggttcttcctgtagagaaccacagtcagaaatgttgtaaggaaaacatggtctttagcaatttttggttacatctttgcacttctttattttcaagtgctctttagcccaggcttagtttctttaacctgagtaaggagcacggagcactaggggaagggtggaatgtccaaataagaaaagcaagtgggggtcatgaatcagtaagaaaggattggaagagttcaggagatagagcttttatgtttcatttttcgtatacgcatgataacaactgataaaatagagcttatctttggcatctccacttcagacacagttaactgaacttttgagcttcacagattgattacattctgatcataaggctttgaccattagtattcttatttcatggtaacttccaagtatgtttttactttgcaactctgaattgaatcttttcttctaatagaggaaattaatcgaaaactagtagaaactaataaatagaaaatgaggccagaggtgatggctcacgcctgtaatcccagcactttggaaggccgagttgggcggatcacttgagctcaggagttcaataccagcctggccaacatggcgaaaccccagccctattaaaaatacaaaaaattacctgggcatggtggtacgcttgtagtcccggctacttgggaggctgaggcatgagaattgcttgaacccaggaggtgaagtttacagtgagccaagattgtgccactgcactccatcctgggcaacagagtgagactctgtctcaaaaaaagaaaatgagttttagaaggagcaagcaggacagttgaagtttgccaagctgaagtaaaagtcacctagaaccaagtcctaggctgtcactttgacgtatcagtggccatatttatacagcattgttccttaaaagtgaaacagtcaggctctcttctggacatttgcctctgagctggtgaaggaatgtttgcctaacctttaaactcctttgtactctgtgcttatttgctcttctgtaaaaggaggctctgtgtagcttgacagagagatgaggaatgaaatgtactgggtttttgtttcccttttttttttttttttttttgagacaggacctcgctctgtcacccatgctagagtgcagtgacacaatcacggctcactgccacctccatctccccatctcaagtgatcctcccacttcagcctcctgagtagctgggaccacaggtgcatgccaccacacctggctaattttttttttttttttaattttttttgtagagacgaggtctctgtctgttgctcagtctcatcccgaactcctgggctcaagtgatcctcgtgcctccacctcccaaaatgttgagatcacaggcatgagccactgtgccctgctgaaatgtactgtttatgagctacctctcattaatgtgttcatttaatatgctttttaacatattaaaacagtatttcaccttccatagactgagtagtgttgaacatttttgttgctttgaagtcaccacatgaatactgtactttatgtaatatcgtgaaacaaattgaaatcttaggttttggatgaaacccttagtctgaatatgaaacagttctaccaaatgccattagatacactacattcttaaagccctggccagttagtatggcttgggacttcccaaggaactctgcttcagccatctgagacctgggagattacaaattggctgaaagtaattttgatgctaagcagcgatgttcagaaaggagctgaaaagtatatgtagtgggaaaatgccaggaatttcttttgaaattaagtgctggggcagttcgagagtgaggaaaaatctaatacaaaatctctacatatattagagtttatgccgtctacaatgggaataacaaatgaaacagaagaatacaattcaaattgctggttctatgctcatttttattaaaatatactcttaatgtttttattttgtgcttcattttgaaaacagcacagtattacagtatttgccatataattttgagaattatcagaatattttccttaaaaatgtatcattttaggctgttcaggttgaattgtgttccccaaaatatctgtttaagtcctaacccctagtacctgtgaatgtgaccgcatttggaaataaggtctttgcagatgtaatcaagttaagatgaggtcatcgtactgaattatggtgagccctaattcagtgactggtgtcattataagatgagggaaacttagacacaaatgcattcagagagaaagagatgtgaggatggaggccaagattggagggatgcatctaccagccaaggagtgccaaggggtggctggcaaccaccagaagctagagagaggcaaggagggatccttcccttgagccttcagagagaccttgaccctgtcagcactctgaatttgaatgcccggcctccagaactgtgagacaataaacttctgttgttttaagcttcccagtttgtggttctttgtgatggcagccctaagaaactaaaatataggctttgctcatcaaaatacgattcatgagaaatttaggatgacaaggcaagatgaagtgaagaagatatccttggtaaaggaaatagcatttcttttccttttttttttttttttttttctttgagatagagtctctcactgttgcccaggctggagtgcagtggcacaatctcggctcactgcaacctccacctcccgggttcaagcgattctcctgcctcagcctcccaagtaactgggactacaggcgcccgccaccacacctagctaattttttttttgtatttttagtagaggcggggtttcactatgttggtcaggctggcctccaaactcctgacctcatgatcccgcccttctcagcctcccagagtgctgggtttacaggcgtgagccaccgtgcccgtgtataaatagcatttcaaagtcacctggttccaataaagtatgaaataacttgctcttagggaaatcaccccaattgccctttaccttaatttcatgaaagatggaacaggtaaacatgtcaacaaaggaatcctgtaacaccaaaacaaaggacatttcttcaagttgaataaatatatgattatacatgtttgtcattttctttttctcattcactgaaagctggtgaacatttcaagtaccaaagtttgggaaacattgcaccagtggcttatcaaactaatgtgcacacgagtcccctggtgtattaaaatgtagatcctgacttggagggtgagggagatcggcatctgaccagctcccgggccgtgcaggtgctgttggtccagggaggcatgtaatgactccatgctcgagaactttgaaagcatggttttttgaaaaaacaaaatattctttctcatggtcatttgaactgtaaagtattccaatccatgcctgtgactttactgctgatgctctgatgactgtaacatctatatttctagtcacatccttcactcaaactacagatctttttttcagctacctaactacacctgggtggcctacaggcatctgaatgcagtacgtcccaaacccaacaaattattcacgcctatgccccatcttctatttttcctgtgtttgcctagaagataaagttagagtccatttttaattcttccccatccttacctcctggatctattgggtttcagagtcttttgagctgacttcttaacatggtttaagttactgtttaccctgaaagatgcaaaggaaagttaaattagggccagtttacatgattaaaaggtaagcaaattgggtttcattccaaagttcttcgtcgtagtgacttgagcagctgtgctgactatcttacagcttgccacacagcatctgcaccactgtccctaggcagcttccacagcacctggaacctgggttcatgaggatacaagagcctcctgggccaggatgggagtagttttccactttagaagaactatatatctatatataatatagatatatataatatatatagtttatatataaattatttacaatttatatataattatttataatttatatataattatttatatttatataaattattattatatcagtggaaagtaacaaagagttggcctgctaagtaactgccttcctcaaatcagcctcctcagtgtgtgtgatcccaacgaatgggtcaggaaaatcaaagacccaatcacgaacctggagcaattgttgggagtctgtgctgcaaatgttaaatttacaagcgtcaggattccgctgtgccgacaacgtttaattcaggcttaggtaaaccgcggctcctacaggcacactgcagagtcccatgattagcttttgctgcctgttccacctcctttacttcttattcttcccgctcctctacaggtcgtgtgctcttctgctgcccaaaccttccacctctcctaaccagcatttcatcaaggttcccactgttcaattcctccctgaccattgtaccaaaactttttgtcctttaaagtacatgtcatcttatattctgtcctctgccagctcctcgttgctgttatctgatgaccctggggatagtcctttttcaacaaggtcatctatcatatggtcttgctctttgctctaactcctgactgatcctaggtcactgcattgtccttgcagaggtcaatcaacaactccgctccacagttccttgactttagtcaagatgaagtcaggtctcttctaccacctcttcaggtactcacttccctgactgctccctggactttgtcacctatcccattctgaccactccaactccatccagtcttcactgtaagagcttcaggctgctggtccatctcctccctttcttctttttttctgagacagagtctcactctgttgcccagtctggagtgcagtggcattatctcagctcactgcaacctccacctcctaggttcaagtgattctcgtgcctcagcctcctgagtcgctgggattacaagtgtgcgccaccacgcctggctcatttttgtatttttagtagagacggggtttcaccatgttggccaggctggtctcgatctcctaacctcaagtgatccacccaccttggcctcccaaaatgctgggattacaggcatgatccaccatgcctggcccctttcttcttttcaggcaatgagctgctctctcttcagataagactcatggcttttccttccacctcgtccttctttttctttcaactacacacactttgcacagctccagccctggctacccagccatctgccttgcctgctgtgcagacagagctccttttagattgagatcattgcagatgtatggtctctgcttccagctgggtactcagtaatacttagcaatcatttttcttatcctggccacctctctctccacatcagctattttaaaccttcacacatctcctcaagcccattctctcactcctagtagatgaccaccagtagatgtaaggaaaagatgccatgtctgcaaacttgcttacctcatccttaaccctttccatgttgtctcagaaggtctctgttgtttaaaactaaccccagccttctactttggaccccatctctaaagcttcaagtccccacttcacccatcatgtctgttcccctccttttccctttccactggtagcttcctgactttgcgccttcctcctttaaccacctctgtctctcctttccctcacagctaaactgcttataagagctgtcagtactttttgtcaacagttttacttccttcattcttcaactgactgtaattaggattttgcccccacctgaaatgatgttggtttcaccagagatgctgatgatcagtcagtggacacttggcagcctttatcttacttagcttctcttttcatattcggcccttataagaactgcttccccaaatctccactgtgttggcttacaggtattttcaacttaatctctgaattggcaacttattattttaccttaaagcctattccttctcagaaccttcagcatctcttatctcagttttcgtaatcacagaccctaagcctttaattcctaaagaaggaaaccttctttaaatgactccattctacccaaattctagtgctataccacagcacttagccttttctgccaggaagtaggacacatgaaatgcatcatacagtcagaggccatacatccgtgcttcctttctgacatttggaaatcttgaaagcaagacgattgcttggggaaaaaactaggaaggcagaggtcatcgtgtctgctgaatatggcttaattttcttgaacactcaaggtcatcattgactattgactgctgcacagaatgtgctgtgctattacggccactttctagctcatcccctgctgtccccatctgcctttgtgcctgtagttcacagtcctactttagtatatacctttgatctactgcagtttggggcattaggtaatagaggctgcttgaagtgaatgtaaaacaagtcagtcaattccaaatgaggtgtctcctgtagagttaatcttttttggctttatgtttgctatttcagtggctaggagacctttttttcctggtctttattttgtctgtgttcctgaatggctgacatttgctcaagattgaattctaattatttgatacctttcctattatctcatttgacttttctcatacggaaagttaaaagtacattagtaggatgtatctgttttagattttctgttttggggtgtggtctttcccttcaatcttaattcattctggagaaaacccttatcaggtgaatataattataaactgagtgagaaaaatttattgtgaatttgagccctcaagttaacgttcactataataaacaccgaatctaatttaagtgggcacaattatttaaccagttgacacttagttatataacctacataggcattttgccttcattaattactctgtaatatggctattcacctgttcctgttaagcctttctgtagttgttaagcactatacacttaacatataaaacatacacatggtatgctatatatatgtcatccactgttaagcaaggaaaaagaaaaaaccacagattaaaaatacaaaataaacccataaaactagtacagattctgccatattctgatatggagtcatgatgagtgagatcatcattgctgcaaaccagcaaacattgaacactctgagagaacatgatgcattcctgccagaatgatttctgtgagatccaggtaattcagcactaactgaaactcctcatgaagttggattctcatcatctaccaaggaataattcattatctccttatagttttatctgcgttatctaaatacatgtatcaccacacagaaaaagaattgatggacagctcagctgcttatctgctgctccttccttgtggtattgtttccttcttgaatcctttgctagttcttccagtttggggactgtgcatagtaaacgtacagagtcattgtctgataatatcacgtatttttttttccgttaagctttctattttgagatcattgcagattcatatagttttaagaaaaaatacggagttctcatgcacctttttcctagttttctccaatgggaaaaacttacaaaactgttgcagaatatcacaactaggatattgatgttgacacagatacaggacacttccgtcaccacaagatctctcctgttgcccttttataggcacagacttccttcctatcaccacattttccttagcctttggcaaccactattctccatttctatgattttgtcattttaagaatattatataaatggaatcttgcagttgcaattttttcggattgactttttcactcagtataattctctggagatacattccaggttattgcatgtattgacagtttaatccttgttatttccgagtagcatttcttgttatgagtgtaccaaagattgtctaacaatttacctgttaaagaacatctgggttgtttccaattttgggctataccaatacaactgccataaacattcatatacagggttttatatgactcaaagtcttcatttctccgagatgaatgtctaggagtgcagtttctgagtcatatggtagttaaatgtttagttttataagaaactgccaaccatactgttaacattttacttaatgttaaaatctcgagctgtaatggtgagtttgtctgtttggccttttaattctgttagtttttgcttgacatattttacagctgtttggcatatacacgttcaagatacctatatcttattggtgggtttacccttatgtattaatagttatgtaatgaccctttctgtctctggttattttctttgttctgaagtctattttatctgatattaatacagccagccctgtttttctttgattaatgtttgtatgatacatccttttccattctttcagcagtccatatcattataactgaagtgagtttcttgtagacggtgtatgattaggtcatgctttttaagtcagtcttccaatctttgtcatttaattgatgtatttattccatttacattattgtaattattgatattgtatgactcaggtttgccattttatttctcagttttcttttccagcctgccttgactggccattttaaagaattctgtttgatttaccaagagtgctgtggaatgtatctctgctcatagctttttcagtggtcactctgtgtattacttcatatatacataacttatcatagttatatatatatatatatatatatatatatatcatagtttactgttgtcatctttttatcctgtcttgttttaattgtcttaaatatttcctttacatattttagaatcatatagataatactatttttcttaaacagttaaacataatgaagaaaactcaagataagaaggaaagcctattgtatttgcccatgtttttgctttccatgttctttcttccactcagatgttccaagattccttcctttatcattttcttcctgtttagagaaattcctatagctattcttttgcaggcagatgtcctggtgataaattctgttaatttttttttaaatcagagaatgtcttcatttaccctttattccagaaaaatagtttcacaggacatagggctctgggttgaaaggttttctttctttgagcacttgaaaaatacagtcactctcttatggcctccctggcttcagatgagaaatctgctgttattcgaattgtatttcccttgtagatatggtatcatttttctctggctacctttaagactttttatttgtcttcagttttcagaagtttaattatgatgtatcttgtcatggacttctttgagtttatcctgtttgagttcattcagcttttcaaatctgtagatttatgtctctcaccaaatttaagttttcagtgctgtttcttagagtgcttttttcaaccactttctctttgtcctctccttccaggactccagtgacatgaatgttagatctttttcattgtctgcaggtccttgaggctctgtttatttatttcaaccttttattctttgttgttcagattggatactttatcattttgtcatctagttcactgattctttcctgtcacttccattctgctgtcaagcccatccactgaacttttattttggtagttttatttttcagttttaaaatttctatttggttcttctgtgtatcttctagttctttgctgagacttctagttctttgctgatgatttctaattttttcatttgtttcaagcatgcttgtgttacttgttggatatgatgactgctttaaaatctttgtcagataattctaacatttgtcatcttgacataggaatatgtctgttaccttttttcgttcagtttgaggtcttcctggttcttggtatgatgaggagttttcaactgaaacgtggatatttttatattatgttataggaccttagatctttatttaaatcttttaattgttttcctctcttggacactaccttatcactgccatcatgtctagattctggaatctagaagttcagattccccacttgcttccattgacacatgagaggaattcatcttgttactgctgctgggtaaggattagaatgttctcgtccctctttccctggtgacctccactgacactgtgccaggggcacacaagagctcattacacagccagcagagatgaaagccctagctccctacttggtcttctctgacaccatctttgtggggatattgatatgcccggttgtagccttgcaagggtggaagtttaggctccccattcggcctttgctggcatgggtacaggttggaccatagtttttgctgtggtgcttggctagaatagagtcattattgtgtaagagttttcctctctcttgcttggctgccccttttttggtcccatggctacagagagcaggcttttgctaggactttttttgtctgcatccattggcatttctgggttgccagcttgttctgctccaagcctaggatacaagaggcaaaaagaacccagggaacttccttccaaatcattccttgggccctgaaatcccgggtacactgaaatctctggtacactggccttcttttgctccactctttcagagtcttttttttttttttgagacggagtttcattcttgctgcccaggctggaatgcagtggcacaatcttgcttcactgcaacctctgcctcccaggttcaagcaattctcctgcctcagcctcccaagtagctgggattacaggtgctcactaccacgcctggctaatttttttattattattatttttaatagagacatggtttcatcatgttggccaagctggtctcaaactcctgacctcaagatgatccacctaccttggcctcccaaagtgcaggaattacaggcatgagccactgcgcccggcctcagagtctttgatatttcttttctagggtggttttttttgttgttgttgttgtttggttttttttttttttttttttttttggactgagttttgttctgtcgcccaggctggagtgcagtggtgcaatcttggcccattgcaacctccacctcccaggttccagcaattctcctgcctcagcctcctgagtagctgggattacaggcacccaccaccacgcctggctcattgttgtatttttagtagagacgggggtttcgctgttggccgggctggtctcgaactcctgactgaggtgatccatccgcctcagtctcccaaagtgctgggatttacaggcatgagccaccacacccatccttttctagggtttttagttgttcttagtgagaaaaataggaaaaagttcttctactccattgtcttggaagtggaagtccacctgggctttaagggtaatttttttgcacatcaaatgcaacaatgatgggttgttgttgcccctcttctcagccctgtgaagatagtaccccgttgctttcggacctttggaatcaagacacctagtttctttacaagccttctttcctttctttcttattgcttttacagtcttcatgtgtattctgcagtttcacaattatgtatttatgtgtagatttatccttatttattcttctcatggttcagagttattttttatttgaacaatcctttaattttaattctataaaattctcagccattatttattttaacatgggctctctaccctcattctcttatttttttaatttcaaaattcctgttagatccatgttagatcgtttccttcaatcctccatgtctcttgagttcttttatatgttctgtcctcagctctcagtactgcctactggtaatctccaggttttattctgattcactaattctctcctcagttttgtccattttactctttaacctatccattgaataattagtttacagacagagtgctctgtcacccaagctggggtgtggtggcacgattctaactcactgcagccttgaacccctggactcaggtgatacaccctcctcagtgtcgcaagtggctgggactacaggtgtgtgccaccatacccggctaagtttttatttttattttttttaggaacagaattttcatatgttgcccaggctggtcttgaactcctgggctcaaacaatcctccctccttaacctcccaaagtgctcatattacagttgtgagccaacgcgctcagcctggaactttttaatgctaacaaaattctaatagcattatttttagtttgattgcctgtaaccatgtgaatattatgagaggttgaataggcttcatctctcagtggtgattaacatagttcttaagaaacgtgacagagctaggccaagcatcagtaaaggaacacactcttggagcttaattgaggagggagtgcttgatctgatctggaaaagagtgtggaggtgacactttcaaagctacaaacaggggagccaggaatacagagcagagcctttgaggccacagaaggagtcaggcagcagtggggattagcagtggtgggtcaggagcaagggtaaggagtggacttagcagctgagtcaaacggggaggagggagttggtgttctggtactcccgagctcctaagctcctaagctatgcagaattacagttctttggtaacagaaaaaacaaagtgaattaacatgggtaatatgaagttactgatactacatcatgctaattaaaaatttccatttggaaatcctttatttccattttataaaaaataatatcccaaattaaatatattactatgtgtaaagaagaagttattcagtttgtcattgaatcagacaaatttcgcacttgaagtgctgacctaaacttggcttatgccgttatacaaattacagatgagggaaaagaagcaagaccacgtaaatctgcaagtgcagacaaaacttatttttttccttttcccttttcccctgctttttaagaagaagaaagaggtagactcttcaaagtctaccaggtttattcttttgtacagaaaacacttgaaattttctaaactaactttgctgccaactgaatatgcatatttctttgaatagtggctagcaaagggacaagttttattcattccaagagtagttttcagactttaaccttgcaaagtaattattcaaagagcacagtttggaaaaccactgaattaacatgtcagccaaatatcttaaatgtgaaaaggtaagtcaacatatgtattgtcatttcacaagatactcagttacctctttttcctgttatattaacaactaagatactaaatttgatgatcgtgatctaagaagaaattcacagcactattttgaagttattttcacagtctctttttatctttcagattttttgtttaagttcttggttattggaaatgcaggaactggcaaatcttgcttacttcatcagtttattgaaaaaaaatgtaagtgtcatgaaattagtcattcttccgtgcatgtcttctgagagccctctcactcagatttgtttacagtaaacttaattttttcagaggaaaaaagtaatagtttgaaagtattttgaagggttatgttattgaactttgggtgatgtgattttttattaagttagcatttctatttaacaatggttcagtatatggttacttctactgtacattttgcagatgctgagagaccatatagtgatgttgaagatagcagaggggttctgtggcaggaatcctgtttcctgacagagcagccagagaagctctaggcatacattttggataaaataacaacatttggtcctcatagtgggcttgtgttgtagttaaggcagttgctgtcatcaattctgttttataggccagaaacagacctcttgaccacacagcccatcttttaccattgactttcactgttttggtaaaggaggttgaattttttatttcaaactatgtgagaccttggaaggctgtagaagactgtaggtttgaaaggcccttaaaacaaaaaatgctttttaataatggaaagaatcgtggagaaagacctgtctagttagtggcaggtgggtgaagggtcaaaaacagagtgtcttatttaattaagtttatcttaagaaagtatatgtgaggcatggtaggtggtgggtaaaaaggagaaagaaccagtttggggtgttttggcagaaagctttgaagaataataaaatcctagaaatttactctgcttcttccattttcatcacccaagagcttgttggagcctgtttgtttagtgacatggacccagtgtggcttagtcacagaactggtccttactgaatttaacaagtattcattcactggatagtttatttacaagttgccaagactttgtgtggtacagtcttagaaaagaatacccagagggtactgggccaagtacccagcttatgtaatcattctgtcctcctcagagaactcccctgcatggtcctctctgcaactcctcacaacagtaatgaacggaaggtctctctttgtaaccaggatgcccctggcctttagttactattttttttaaggatcttaccctgcatttttcctggtagtttactcctaatggaatttccatactagttctatactgtctgggcatgaaacagactagcatagtcactgtaaccatttatctaccctctgccctgtaaataataaatccagttgccagtggcatccctgatctctgaaacaattaaattttgttctgcagttacaaaatataaactagccaatggactgtatagctgcgatattcaatttcagcttatctgtttatcatcacagaaatgttctttcataggcagtgtattcccgctgggtttagcaaaatacttattttgcctgtctcctgcccattcaaatagtactaatttctccaacaaattcatcccaaatcatttccatagaacactacgattaatgaaatctcaaacacctgtagcttgcatagggttttgttttggggtttattggagggtgtattgttttggggtttgttggagggtgttttattttggggttttttggagggtgctttgttttggggttttttggagggtgttttttctttggttcaatttttttcctccttttcccttttcctctgcttttccttccactcactgttatttctttaaaatatttaaccattcaaatacagtagttgaaactgtctccacctcattacttactgagttccacacctgtcactgggcgttatgcccttcagaatggtacgctggtatgtcagcagtcaccatctgtgagcatcttaacagtgcacagttggatgtggttcggatatggcagggctactttcaggcataggtttttaaatgtatcatttgtttgggggttttgagaaaaatctttatgtctctttgagaataggggctgtgtgtattatctttaaaactaaatgcatcttctcaatggaatgttggagaaatgaatggctagagtaatgtccattccccattgatgtaactcttggttttagtgtcacttgtttaaatctataagcctgttaatgttctaaaattaaatatgctgttcttgtttttcttttttagtcaaagatgactcaaatcatacaataggagtggaatttggttcaaagataataaatgttggtggtaaatatgtaaagttacaaatatgggatacagcaggacaagaacgattcaggtagcttttctctaacttaataaaaatatttgaaaatttgatttaaaataattgatgatattctctcaatatataaggtctcactccctccccaacacaccccttccttgtcctaatctcagaaacttcatttttggaaactttgattgacaagacagctaaaatttaggttagctctctgcagcatggattactaaagaatacaggaggatctccgcgcaactgcattataattcggaggctgacccattctcaggaggatgtggcactgtgtattgtacagtatgtttctagattcaaatcaaagcacaagcttgtttttctgtgttccttttttaaagaagaactttttaaaaccttgtgagggtttgttttgttttacattaactagagcatgttctgatgtttgatacacactccacaaaatattctctccacactttaattacaatagggtcataactgaggctcagaatgacttcagtcactgcaaatgaggttacatgtttagtattctgtaactactaaagcaagaaaatagattaatattttagttgtggtttttgcacagatgcacaaagtcagaactgatattcatagttttataattcagtgaaataaaatccaccccatttgtaaacatttcacttgaagttgagtacatgtcgtatattaaataattgaagtttggctgggcacaatggcgcatgcctgtaatcccagcactttgggaggccgaggcagacctcctcacctgaggtcaggagttcaagaccagcctggccaacatggtgtaaccccttctctactaaaaataaaaaaattagccgggcgtggtggcaggtgcctgtaatcccagctactctggaggctgaggcaggaaaatcgcttgaacccgggaggtggaggttgcagtgagctgagatcacgccattgtactccagcctgggcaacaagagcaaaactccatctcaaaaattaattaagtaattgaagttcaataattgcttcaaaaataccataaccacctttaatcaccatcatttttctggaagcattgattaaacatggtggattcaattagacatttatgtcttccctctcagaaccccactgaaatgtctgttaagtaactgaaattgaagtaactcaaaaaggccaagattgagtgagtgcacaattatgattgagagatttccaaaaaaatcttaaagataggaagtagatggtgctctgacagcagaaggagctccaccttaagtactgtaatgggggaagccatttcttcctctggagtcccagaaaaggtcaggatttggaagcatcaggttctacaggaggtagaggttacagaggttcatgtttacacacgaaataagaggttcagtcttttacgttgaaatggagtctagactcaaggtcataaggcccacctgagggcatggggtcaggcctgaaaagagggaaattaagtgaaaatgaaagcctctggcccccaacccacctcccctacctcttccctggtcgctggcagccaggtgtgtatgtcccacataggagaaaggagccttctctgcagaaaaatgaatagtcagaaaggaaaggcttgaaggtagtgacattttgctttcccagtcaaacagcccagtctctatccagtcatctgaaagtgaaaccctccaagcccacctgctccacccacacataaagagcttcttttagactttttcattccttgctcttaatgatcaggcagaattttgaagaaagtttctatagcaaaagagagagctcaaagtaaagaagctggaactttgagggagtaagaaaaacacactaaaaccacagtatccttaggaagaagagcagagattgcattggagtatgtaatagaaacaaagtcatacttaaaaagagcaatcagaataatatgttaaataaactcatggtgaaaaatgggagagatgacataaagaatcctccagaattaatccagaagatgcaatgactattaggagttccagaagagagaagagcagagagaataatagaagaaaatgtttcactgaaggaatgagattccagattaattggcccacctaaaatcaaacatagtaaggaaaaagtccagaccagagcgtgccatgtgaaatttcagaacaccacagatgaagtaaggaagaccagaaaggttccaagagggaaaaagcagccacatataaagtgtgaaaaatggaattgctttgcacccttccacagcaacattggaagctaaaagaaatggaagcattgccttcaaaactcagggtgaaataattcttcaacctaaaattctaaacttagccaaactgtaagtgtgcaagtaaaggctgaataccaacagatgtgcaagaatgaggaggaagccaagattatctttctcagagacttcttagaaatgtactttcttagaaagtttaggaggatatacttcaccaggacaagggcatgatcccagaaagaggaaaatgaagccagcaggaagatccagctcagaatggcacaggtctagagggacagtgagggaagactaagacagcagtcagtatgtgatggcactgcccttccaggaggaccaggggaacaagtgaggggctctgtaagagctcacgactctgtcagagcggggaagaaacagctctgaaattcagtttcctaaaccttttgtagaaatgagaagaaagaaactgtaagatccatgagtgtaagggtttttgagttttctgtttgtttcccctgtgcccagaatagtgtctagcacacaggggcgcagtatgtgctcttttaatgacttaattaaaggaaacccagttaccagaaagagagaactcacctcgcttgtggagagtagggctcccagagaggagtgaggcaggagatggctgtgtttaatttagagacttttcgtgacatttcactttaaaactatccacatgtattatattggttaaattacttttgtaagaaaatgtggcacatatacaccatggaatactatgcagccataaaaaatgatgagttcgtgtcctttgtagggacatggatgaaattggaaatcatcattctcagtaaactatcgcaagaacaaaaaaccaaacactgcatattctcactcataggtgggaattgaataatgagaacacatggacacaggaaggggaacatcacactctggggactgttgtggggtggggggaggggggagggatagcaatgggagatatacctaatgctagatgacgagttagcggttgcagcacaccagcatggcacatgtatacatacatatgtaacctgcacattgtgcacaggtaccctaaaacttaaagtataataataataaataaataaaaggaaaaaaaaaagaaaatttaacacctcaaagtagtattcttaaatgtgtatatttgtatactggagtaatttgtataagaaactatttgtcaagacagtgttgtaaaataaatttgaaagtaaaattttaagaagtagatgtgatacagcttatcttgaagagaactcgtagttccctcttcctctagaagctaggtgcctgctgagcaagaatagaaaggcgctgcctcttaatagatgtgaacaagcgaggcctttccccctgccttaggaggctgtggggtgaagagcaaacagtccactctgcacctctacctgccaccagtccttaaagcgtgtgcctcttgctaacagtctcaaggcagagaggaaaagcttcaagctacatgaagaccttgaagcttcctgactaagagctaaaaagtacatttaaaagtagctcttctttgccaagcagcaaagtaataattagtaattttgtttgtttgtttgttgcaagctgcacgggtttctttgttctccaaggatagttcattcctctggtgtctttttttttctgacatcaagtctatggggtttttcttcacaccagccagtcggattctctgacaccagctgggtgtccaacacttcaattcacttttgacactacccagagttaaaggggaccctccaggctaaggagacctagactgccacccccgcttcagacaccagtcacaactggagtgcccaggcttcctgcacttcttggccaaatacagatctggcagttcccacaccctccatccctcacatccccatcaggttggagaatttgttagaatgattcacacaactcaggaaaaacatttttcctggcatttactggtttgttagataggtgtcaattcaggcacagcctggtggaggagatgcttaggagacgaggtatggggatgggccacctcccagcacctccatgccaccaccagcccaggagctctctgacccccatccttttggtttttttgtggaggttttattacaaaggcacgattgattaaaacattatccattgatgattgactcaatctccagctcctctttcctccccagagggctgaggtgaggctataagttccagcactctcctcactcggtgagggctcccacggccacagccccgatcccaaggctctctagcctgctactcttcccacagttatctccttggcttacaaaagacacctttatcactaaggaaatcacaggggtttgggcctctgtgccaggaacctgggacgaagaccaaatatatattttttaatttaattaggccacagttaagttctgggaatgtctagctagcagtggtccaggccctgtgctaggcactgggatcctctggtgagtgagacagcagagccctgccccatggaggggaggcaggcagccaacacagagacagagacagaaagagcatcccaccaagtgggatggtgccacccaggagacagcacgctgagatagagggggtccactggatggggatgcttggggaacgttgctgaggagatagagttaatgagacccaagggacaaggaaagccagcggtgtgacgagcccagacgggagtggcaggggctgggagcagggaagagaatggggccaaagggacaggtacagtgacggagatgtcctgtcctgggccttgatgagttgggctgctctgaagaatggactgtgggccacacatggcagcagggacagcagcgtgggcagacacaggatttgtgtagtgtaggagactgcactaggctggcggagtgaatgtggaggtgcacaggaattgaggatgaatgtggagctgatttgctttagaaacagggtgcgtggtgatgcctcttcctaggccaggacgggcctggagggtgggaccaaaaagagtcctgctgtgcagatgttaagtttgacatgtttatcaggcagtctcatggagatatggaggcagcacttggatctgagctggagacaaaatttgagtcgaatgttaagagagcccaggacccagctctggggaatcgcaatcccagcagggcagattcagaagaatgaccagagccagagaagtggctggtgagcgggaggaagactagcagagtgcagggcgcagaggctgcgcgagtgagtgaggacagaaatgcccactccagcttcggttgcagagagggtggggaccttgacaggcttttggggagtagcagagatggacactaggttggcggtgaagaagaggaagctgcaggtaaagacagctctttcagaaagttggatgtggggccacgcgtggtggctcacgcctgtaatcccagcactttgggaggccgaggcgggtggatcatccgaggtcaagagttcgagaccagcctggctaacatggggaaaccccgtctgtactaaaaatacaaaaattagccaggcgtggtggcgggtgcagctactcaggaggctgaggcaggagaattgcttgaacctgggaggcagaggttgcagagagctgagatcgcgccattgcactctagcctgggtaacgagcgaaactctgtctcaaaaaagacagttggatgtggagaagagcagacagtgggacagtaactgaaaagatggtgcagcatatttctgttttgtgttttaagatgggcggtaccagagccaatttatttttattttgctaataggaaaaatcctgaactcctggcttttttttttttttctttctgttgcctgggctggagtgcagtggcatgatcgctcaccgtcacctcaaattcctgggatcaaacagtccttctgtctcagcctcctgagtagctgggattacaggtgtgtactgccatacctggctaattttttgtagagacagggtctctctctcttacccaggctggtctcaaactcctggcctcaagcagtcctccctcctgggcctcctaaagtgctgggattataggtgtccggccactaatgggaaaaatctcacaaagagggtgagattgacaatgtaggggaaaacatgtatgaccaaaagacgccttcttgaatgtgagagtggatatgacatactgggacactcagttttcccgtagtaatagggcagggatgcaggtgggtgtagggccgtggtgactatggattcctgtggtgactatggattccaccgcgccgagaggtggcgagaactggaagagatggagaaaattgtgccagggagtggggtagatgaggagctcgcagagaagtgagtggattgctgagccccttagtgtccatctagggggtggtgctggcttccgcagacagctcaccctgctaggagttctcaaaggagacatccatcagagagctgcatccgctgtgaaggaatctcctacttgccacagtgatgtgatttcaggcagaataacccctcacatgtatgttcaaatatctttgaatcatttctcttttaaaccagtgtctgtccctgtgttgtggtttacaaagcaagcatgggtgttttttcatgggaaagtgggatacagtaaagggtctcaattggttgaaagtaaaaccagtataattcttccaggtccgtgacgagaagttattaccgaggcgcggccggggctctcctcgtctatgatatcaccaggtaatgccagctccccctggtgaaggagggtgctcagtgccctgcagcccaaaggctggtcttggcgaggtgccctccgtgcagtgtgtgctttgtgtgtccagggacggtggtgtggctggcatccaggaagccccttagcccttccatctggggtctcagaggtctttgaacgagcccctaccactgctttcccctgcagagaaatgtgtttgtaaggttttaggtggataaagcaatccatgctattacattacatttcttgacatgatgcttggacactttccttaaggttcacaaagctttatgtatggaaagttattagaagtgagttgagagagggtgaggacacagactctgggctgagattgctgggttcaaatcccagttgcagtcactagctgattgaccctctcaggccaggtgcttcagctgcctgggccttagtttccttgtctgtaagatggagatagtaataatcacatgatcctcaggaggttattgggaggtttaaattagttaatgtgaagcagttagtagctgtttgtgacatatggcaatttaactgaaataaaaaattctgttcctcgattgcactggccacatttcaggtcctcagtagctacatgtggctggtgactaccatatcaggacagattatagaacattcctatccatgaggaaatcacattcagcagtgctgatctcagtagcactgtcttagaaatgtgtcatctaaatggcatcatctgggggccctttctgggtaggaacctgtccagtgagaggatgtcactcagcagccgcttccctcttccaatctgtgtcccgggagccaggcgttctgagaggaggaaggcagtttctggcccagcccttcctgcacttgcccaggcagtgaaaggctcagcctgctaaagtgtgaagtcatcaatcaggctagcaaagtgccatgagaagaactcaatccttagacacatgagggccaaaaatagtaagtctgagagttggtcctggagtcagacagagctggtcaagtcctgactttgccactggctgctgtatgacctagggcaacgtaattaatctctctgggccttggatttctcagagaaaaggggaataatggcagtctgtgtcatggaatctttataaagaatcaatgtgataaagtcctgtaaaacaaagtgctggcacattgcaaggattcattaagtggcagcaattagctatgaaatcttgcctaccagagtctagtgccttgcgcatgctaagagctcaatagatatttgtcaattgaatgaaggaacatctctttccttttgccccatgactgggcaaacgaaaaataacaaaatatctcacttgctgtctcattttaccagaaacaaaatggaacaaactgtgggtatggtatatacttggtgcattcacgttgtctgagttatcttaaaggtgttggtgccattaccctgaaatgttgaaaagcggtatgagtagtgagaatgactggaaagagttgctagttttataaaatacatgtattattttcacaatcttatattacgcagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatggcaagtgaccttttacttcttactatttttcaaatcgcatatttgaggataatagcatttctttgaatttaaaacatatattggaatttcaagattaaactagatttaggaaatgtggaatttccaattgtttttttctataaattagacctattaagcatatttttagtatattgcattctgcctgcagaagttactataatgataaaagcaaatgtagtaacattatgtaatgacttttcagtctagggtctttgaatattagagatcttgggctaaagtgaaattaataatatttaaagactctaaccaaatgatgtcattattttttaatgtattttgaaggaaatttggtgaaatattaacccaaatagaaagggaagcggaagaagaaatacttggctttttggcttcattttaagtcatttggttatagacaactttgaaacttttttgaatttccatatagaatacatgaaaatgccacataaaattaatggttgcttaattaatggataagagaatgattttttaaaacttcagacattttaaataactttaatttttagaaccaaaaactagaatcctaatatcaatatttggactctaagattccaaattatattgtaacttgactagtttcttgctaagaaaataaacatgagagaaatccatatgccatcatgacagtttttaaaaagctgtttagaaatcagaagtttagaatgttaacaaagatgaaaaggaatttagatgtcatctaaactcatttttacaagtgaggatacaagaggctagagaggccatggtttgctgagagagcaagcagaacaggcctttctgctgagatgaacagccactctggtgggtagaaagagtattaattcctatactgtctcttcatgggctgtatgacagattgcaatatagtcccctaaaaagtgtaaacacttgtaggtcatatttgtggtgacactcagattgtttgaagaaggacattgcaactttccctgaaatcaatggcagggccattttggcaagccagctcctttctgatgggctgtcatttggctggggaagcctggttgcttgctcagccccttcaccaggttaagtgctagcacaagatagcagttacttttcagaaaaggctaaaattcttttaacatttaaaaaacacataatgacatatattgattttatatttacagaaatatatggttttaggtcataaattatatttcgtctgcttttctaagagaatgctacacaggcttttgtaagtgaaaattatgatcatcttctaaacatgactttattttgtttgatgtccattttagagctgatgtttttggaaacaagtgcgctcacaggggagaatgtagaagaggcttttgtacagtgtgcaagaaaaatacttaacaaaatcgaatcaggtaaaagcctttccattaagcaacttttcttctgcatattttacactgtagctcagtagatcaccttttaattaatagtttcagggtgatttagtaaagaatgttctctctctacctgccaacctaaaatcatcacatatgggttcaaaggtcctgttcttatcaggatgaaagccccatccttatcaggatggtttccatggtgatgaaagtggatgggcacaccagctcagctgtggaaaggtagtcaaggtttcagggagtgtttgcatttagaaccatagtctttctttggtccttcactaaacggaggaagaataggcctttgtccactctgtcaacagcacgctaattctgttgggccagtggtcatgtgtaagggagttataggtacatggtatagtgttgattgttgcagatcgggcatcatggaactatggagtccagagtaattttatttctgaagcttactgagcatgcctcaattataaaatgcctcatttttgtatttgcttattaaaataatttaaaataatcctaatgtaggcagctgacgaaatactgtgtagttgtcatttactaaagtaactatatatgggcatcaccttttaattgattcattcaaacatctgagtgcctatttgtcagatgctgggatacaaaaatgaataaatcacaccccttgccccccaagaaactgtctttcatgggagacagtcagaggataattataatatcacaaggctgatgtagtagctgagagatgcacaggctcagggtaacgtgaagaaggggacctgccccagccagaggatagaggaggtgtcagggagggctttcaggggaggtcttagatgagctcagtctttcagaatataaggaagagtgagccagcaaagggagtgaggaagagggaatagcaggagaaaaggttgaagaaaggcaggagccagccagtcctcatcaaggatctagaactttatcttgtagattaccaattgtcaaccctggatgagcactagagacactgagatgcattaaaagttctaatcccaggctctgcctctggagacgctgaactaattgggctgaagtatggtcgaggcaccagtgtttttaaatgtttactcatgctgttctaatgttcatccaagattgagaaccactgctgtaggtggtgggttgtcagcaggtgggtgatgtgattgggttgtgacttgagataagtcatgtatgtaggaggttatgttgaaaacaaactgaagggaggacaggcctggaggccaggataccaattataaggcatttttgagtaatcctagtaagagatgactgattaatgctttaacaaggatatggaagcagagatggagagagagatggatctaagatatatttaggcagtagcatcttatgactcatatgcccaatagtgggacaggacaactgactcttaggtgggacaaggtgaggaggaagggccagcaggggaggaggaaccaaggatgactcgcagctgtcacactggtgtctctagacagagatggggtggagccagaggagaagcagggaatgtgagggagtaaagatggctctgttgcaaatgtgcggcctttgcggtaacgctgagacatgaacatggagttatctagtaagcttggggaagagttcctggctggcagtataagtttgggaaccatcaatatataggaacagctaaaactgtggaagcaatgtgatcgtccggagaacagtgtttaaggagagcagtgatcaacagaaccctggagttggaggatgagcagaggaagaggaatctacaaaaaagatgaaaaaggaaatggtcggaaatgtgtgaagaaaatcaagggaatgtgggtgtcacttaagccctaattataagcaaatcaaaggagtgttcattatgtaatgtaatagtaacagagggaagcctcataagctaagactgagctgaaaaacacacattgggatggggaatagaaagtcagtgatcattttgatcaagaacaatttcagcagaattatgaaggtagaagatggctggccgtccgttaggaagaagtaggaggtgagcaagcagagtgtccactcctctcctgaggaagcacaggctggcactgtagggtgcaaagggttaatttaaagctggggttgtgggtgatgggagaaattccagcatgtttaaatgctgagggggaaggagagaagaatgggcaaggagagggcagggaagaaggagggtgctaggtgaagtaggagggaggagagtcgggcccaggtagaagggctgggtttcaacagaagtggacatgtcatctttttgtatttttttttatcagaaagaaaaaaaaattactaagcttggtacaaaaaccaagacactgttacataaatccttacagttggcttactgttgagtattattaagctcagcatgaggttgtatttacatgaccttgctattttaatattgtatccctgaatgcatcagatagaacaactcatatgcagtcttccaagatgtgtttttttctgagatcatcaaaatcataagtacctctaggtgaaaaaaatataagagtataaattaggattcttcagcagtactttttatttttttaatgggtaatacattcagaaaccattgttttcttccctttttttatataaaatgtatcatatgatagactaccacgccttgcttttttacttactattgtataacctacaaatcattacaaatcagcttatagtttccgtatatacatataatacataaggtacatatatataacataatgtcatacataatgtgtgtgtgtaatgtgtaatatgggttgagtatccctaatccaaaatgttccaaaatctgaaactttttaattgccaacattgccactgaaaggaaatgctcattggagcacttcaaatttcagattttcagattagggatgctgaactggtaagtataatggaaatatttcaaaatctgaaaaaatccaaaatacttctggtttcaagtattttggataaggactgctcaacctatatttggataaggaccgctcaacctatgtgttaccataattcatgagccagtctactttggacatttgggttgttgccagtattttgctattataagtaatgttacagtaaataattatatatatatatatatatatatatatatatatatatatatatatatatatattttttttttttttttacatgtgcatgagtctgtgtgtcagacaaatgcccagaagtggaattgctgggtcagagaacataagcatttgggatcttggtgtagaggctgtcacattttctcctagtgatgggcttatttcactaaagccatgtccacagcatgtagtatcatcatacttggacttttggcccatctaataagtgaaaaattatatctttgtaatttaattttaaattattttatataaataatgtattcacataatttgaaattcaagaagtataaaagagtatgcaatgaaaagtccccctgttaccaccccctcctgtcctcagccatctagaactcctccgaatcagccgttccttatgtatcctgctagagatgttttgtgccggtgcaagcaaacatatatatagttttttccctttattcagaatggtgggatatatacacagtgttctgtactttgctttttttttttttaatctatttttggaatcaaagaaacataaaagccttttttaaaagaagacttgcttggtccttaggtgagctggacccagaaagaatgggctcaggtattcagtacggagatgctgccttgagacagctgaggtcaccgcggcgcgcacaggccccgaacgctcaggagtgtggttgttaggagagcacacaggtgggtttggacacctccctgccctgagttcctggcaagctcaagtgcagaggcctgttaaagctttgggaagctgcagtatgaaaaagaggggatcccagccgggtgcagtggctctaattccagcactttgggaggctgaggtgggccagttgctttagttcaggagttcgagaccagcctaggcatcatggtgaaacatcatctctacaaaatacaaaaaattagccaggcgtggtggcgtgcacctgtagtcccagctactcatgaaacttaggagaattgcttgagcctgggaggcggaggttgcagtaagccaagatcataccactgcactccagcctgggcgataaagtgagaactgtctcagaaaaaaaaaaaagagaaggagaagaacccataagttaaagttggatgttctaactgaaagaatttatactctataggaaattcttatgctcttgttcagaaagaaaggaagggcaggtggtggttgatgggaagggtgagatatcctgattccttatgtcagtgaggagcccttcctggattgattgaggtctaaatgaatgtgccttttgctaaaacaggaggcctatttataaaattgacaaatgtctccctttaactttttaaagcttcttcttttttcccatttaccacagtggacgttttatttatagtcgacatcatgtagtaggcacaggcaagtgttaaaagacaagatattcacgaattctcttttaggctttaagctgtatttacttttgcatttatagttatgcagattttgaaattgttcttaatattttttaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaa

SEQ ID NO: 17121 - DNA, 9409 bp, Human
aaatgaagaaactgaggcacaaacagcttaagtaactttcctgtgataggctgaatagtgtccaaagatgtccatgtcctaacctttagaacctgtgcatttgttaacttatagaatgaaaaggcctttgcatatgtgatcaagttaagaatttttggatagagatattatcttggattatctgagtgggtccattatagtcacaaagattcttacaagaatcagagaaggagatggaagcagaggccagagttatgtgatcagatattaaggagcttaggcagcttcaagaagctagaataagcaaggaaatagattctgtcctagaacttccagaagaaatgtcaccttgactttagctcagtgaaactgatttcagacttctggcttccagaattataacataaaaaattcgtgttgtttgtgttgacttaagccactacatttgtggtaagtaaagcagcgacaaagaaactaacacattgcccaaggttatgatgctacaaagtggcagggccaggattaaaactgaggcaatctagtgctagttccagggatttaaccactgtgctatttagggcctctcacaggcagaatgaaatttaacgctgcaagcaaaatgggggtctcctaggttttcctcttatgctgagaattccaggtcctggagaagaagaaaaagagaaagaaagagagagagagaaggagtgagagagggagggagggagggagggagggaggaaggaaggaaggaaggaaggaaggaaaggaaggaaggaaggaaggaaggaaggaaaggaaggaaggaaggaaggaaggaaggaaggaaggaaggaaggaaaagaaacagcaaaaaaagaaagagggaggatgggagggagggaaaaagtaaaaatgattctgtatcagctggtatataccaacacccttccctgccccatgtcttcacagctgtgtggcaagtgaagactaatggatccaggcttcctgatgcttctatttatcattattcacttaggaagggtgggaaaagaaatactaattacacacttaccaatggaatacttttacaaggatcaaaatttctcactgcggccatgaaaaagaatgagagctggcggccatcatgcttagcaaagtaatgcaggaacagaaaaccaaatatcacatgttctcacttgcaagtgggagctaaataaagagatcacctggacactaggaggggaacaacagacactggaacctacttgaaggtggagggtgggaagagggagagaatgagaaaaaatacctattggatactattacctgggtgatgaaataatctgtacaccaaacccccacgacaagcaattcacttatataacaaacccgcacatgtactcctgaacctaaaagttaaaagaaaaaaaaatatatactaaaatgaaaacaattctcactgtaacaatattatcccctcgtaattattatattcctaagttttaggcacttttacatcctgctcgctgcccccagctctcttaacacagcatccaggacatagtgggcgcttataaatactgatggcattaaactgagcgcttatgatagcatatttagagcagtgcttttcaaacgtctaggtgcatgtgaatccctggggacaccgttaaaatgcagattcagagttagaaagtctggttggagcctgagattgggcatttccaccgagttcccatatgatgcttgtctatgttctgtatttttcaaggtctcagaaaatgagacctccctatccatatacaaatataagtcacacaaactgtgataatttaatgaaagtttacaaagagcatagaagtagatgtttcctcttttcccctgccctcccaataaagggaacaaattagatgcgagggttcaatggaaagagttgcaacagcatccaggcgctcgctctcctccggtcttcctgagacagggaaaggggtaatgagaggaaggaggaaagtgtccaggagctcccacgctgctgttcttccatttccagcttttaaagagcacccgccccttcgaaccaccgaggtcatgggcgaacacaccggagcgcagcaccgcgcccccccgcacacaccgcccgcctccgcgcccttgcccagaccgaggcggccgacgcgcctgcgtgcgcgctaggtataaataggtcccaggaggcagccactgggcagaactgggctacgggcgccgcgggccatggcgggcgagaaccaccagtggcagggcagcatcctctacaacatgcttatgagcgcgaagcaaacgcgcgcggctcctgaggctccagagacgcggctggtggatcagtgctggggctgttcgtgcggcgatgagcccggggtgggcagagaggggctgctgggcgggcggaacgtggcgctcctgtaccgctgctgcttttgcggtaaagaccacccacggcagggcagcatcctctacagcatgctgacgagcgcaaagcaaacgtacgcggcaccgaaggcgcccgaggcgacgctgggtccgtgctggggctgttcgtgcggctctgatcccggggtgggcagagcggggcttccgggtgggcggcccgtggcactcctgtaccgctgctgcttttgtggtgaagaccacccgcggcagggcagcatcctctacagcttgctcactagctcaaagcaaacgcacgtggctccggcagcgcccgaggcacggccagggggcgcgtggtgggaccgctcctacttcgcgcagaggccagggggtaaagaggcgctaccaggcgggcgggccacggcgcttctgtaccgctgctgcttttgcggtgaagaccacccgcagcagggcagcaccctctactgcgtgcccacgagcacaaatcaagcgcaggcggctccggaggagcggccgagggccccctggtgggacacctcctctggtgcgctgcggccggtggcgctcaagagtccacaggtggtctgcgaggcagcctcagcgggcctgttgaagacgctgcgcttcgtcaagtacttgccctgcttccaggtgctgcccctggaccagcagctggtgctggtgcgcaactgctgggcgtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccgggtaagggtactggccttaggcgccggcttttcccagctcacaaaagcatcgggcagtgcctatctaggggcgcgggcagtaacgagttttcagtgatcaggagagtgtcggggcaaaggtgaagaaatcgtgactaactcagcagagttggggtggggagctccaggaaccacttctgctgggtgggctgctatcagaaactcagccaagaggaggggagttgtttgtttaggtttgtacttggctctctacacatttcttaccatagaaaagtttgtgccttcatgggaaatggttattctttcttctttagctttcttttaagtccagagcatatctttttctaaaaaaagtttttgctcactgaagattctgcaacatcgatttctgaaaccccattctgaaatttactagaaccttttttggggggaggaaatctattaaggctagcaaaaaaggaaacatttgttaaagggtcccatagagagactattccctagggacacacaagacactagatgtagtgtttcatgggcctgcctctgaatggttatttgtatggtcctaagcatctggactatcccttcctccaaatctctgtgaataatatcaggttggcaaagggatagggaaaaaagacacattagggactgagagcaggagcactgtattttagaattcaaagagactttagagacctgctaatcaaccccctttgctctgtagcctccccccaccccattttactgagtaggtagatgtgtcccaaggtcccaagtgaccttactccaaagtaaatggttggtgtgttgtggcacctgagggtcctgtcttctgggcccagtgggatattggctgcactaaactttcaggttgtctgttgggtgctggacacactgtcccacagagtgcaaccaaatcactggaggaacgtctccctggacagccaggcaccttgtcttgggtgtttctcactattagaatcatcttcaaccagcgtcctttcaaaatgattgaagtgggaacaaaattttccaggcaacttgagttgggatagtttttataatgctccttttgtatcttttttccctggtgctggaatctctgattaagtccctgccccctgcctagcatttttgagggtgcatagatcagtatttggtgggataataatttgttcaaacctcacgtttcatgacgtagagacctcagctcaccccagtgtctattatatgttacctttttgcttataccattgttttccaaacttgcctgtgcataagaagtacttgtgtgtgtgtggttgggggtgggagggagtagataaaagtctttctaggctcctgccttatatattctgattcagtagctctggcccagggtctgcaaatctgcattcataataagtgtcgcagatgattcttaagattatttggaaaacagtcttcttattccttcagccagtgttactaatcatccactatgttcctcgtcctgttgggatataaaggtgagaggggctcagcttccagaaatttacattccattagtttcagtatcaacagtttcccttgactctgttttatatacttttaacacacacacacacacacacacacacacacacacacacattcttccttattcttgattgacttttcctaatcctctctcaatatgagtttaaccagctaagctgagtgtgtttgaaacacaaatgtacctatatttgggagaaaggtaatgcctattaagagtgtggcctctctttgctgtttatcctttgtatgtcccatatataaatttaaatacattatatatataggttcaaacttaaggagatataaaactgtggagtccatttgcattttctcttccctgaccttattttgaaggccagtttgtgtgtctctgtgtgggggggaaccacttgggtggggagaaggtggaggggtatattgtgaacacagagaaaagtaatgtggcatacacaagatgaagttttcacaagccatgaatctagacctagagaagcttcagatttctggtggagtttcatgcaagcctcttcctactttcatcgatggaattcaaacacaacaaaattgggtcttaagcctggatctcaagctgtagatagaaggggatgataatgtgtggactagagtaatcagaactggaatatggattaaaatggttgctttatttttgttcttatttatgagatttgatattcgcccataataggagtgcctctcgcttattaccattattatttttttaaagaacactggttctgctgctctgtgatgattggcatggtgcttttaaaatacttttctgttgaattttttaggaaaagggaaggaaaatgattgcaatcatcattaacatcatttaaaccaagtggtcaactgctaattacttgaatacaagttaaagaactttgcaacgatattatcatcatggaagatcaaaggaccttcaaaagcagcctcctcttattactttccttataaaaacttacatccacttaaactttcctgcatttatttctttcacttttacttcggtatcacactatactgcaaaaggtcatgtgttttctattacaaaagttattcttgaatcatggtacaattcgtgatgttttcatgtttactttttaaacttttaatgactataagaattttcaaaaacttcttactttaatatttttgaaaagagcctttttgaacactcattagaatcattcttttatttttttcaaaatcttccccaatacagaaatcatggtgcaatgagctaagtggccagtgttagctttcaaattattcgggcctctagactaatattggcctgcaggcaaataggtaaaatgaaactgtgcgtcaaagtttgtggctgtgaagtttaccaccattggctgaacgatcagtgtaatgatggaaagttcaaagaagaatggtaaaaacatttgtctcatggcaacacttcttgtttatcatggcttgtttctcataggtaaagtgcccacctcttgaaatatcatgaacttcttcatatttgcatagaaagtgaactggagtgatgattcattaaaccgtattctactgtcatattaaattgtgtgcgtttgttggctcatggccagtgtatttgcaaacgtgtgcatagaaacatagtaaatattaagtaagatcacatgatgtttcattcttggacacgttgcttctgaaaacgtagactggtttggccttttacccttttaaccgggaagctttgggtcttgtttaattgggatgaaacagaaatggctatttttaaaaagctagcaaaggactctgtggtgagctgttttataacaaagagatttttctccctccagacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggcccatcatcggcacagtcagcatggatgatatgatgctggaaatgctctgtacaaagatataaagtcatgtgggccacacaagtgcagtagtgcagttcaccatgagggaagaataaagagctgtgggcaaaagagtgtaaaatattttaaaataaactttcttaatatttttacatgcagagtatttttgtattcaattaaagaaataattttattccagacagtcacaaatttctctgttccatagttaaagaagacatttgccaacaggtagcatagctctgtacatcttttaaaaaaaaaatagcagggtactagtataataagctattttcacaagtgtagcaatttcatggaacctgctcaaatcaaatttgtacatattgttataataaattttaaggtcttaactattaacttgattgaaaaaagcttcagcagggtttaagtaaggcctcaaaaactattaaaacctagccaacataagcaaaaagtatctttggaagtaacaacatgacattgaatgtaattatgtgccagtatcagtgggaggtcactttgctctatcttcatttccacttccctcagctgtatggaagactgcgtttgcatccaactggagtcaagaagcaatctgtaattataaagacatgcagaagtgaaagaggagattttctgttttattgggggatctttttggtacacagttatggatttaaagatccacaaggaacatacattctataatgaggggttatagttccagaaagctcaacatcattataaaaccactaattacacttcatcttttagatacattacgtttgtaactggtatattgaacaacatggcatgaaatcataaagcaactttattgttatctcctgctgcccctttaattataatccatagaactaatttttctttgtgtccagataaaatctaggctactatatgtctatttgtttatgggcaataaattgcctgttattaatgagtgtatctagtctagggtaataacccattgcaggaagtcttaaactttctttcgtgcagatccctttggcagtctattgaatcctatggacattttctcaaaatcaggctctcagaggaatgcagtagggcggaagcaagcgtcatgatagtcacagcacacacacacacacacacacacaatccccgagggctcatgtggtcccctagaaacaaagagttaaaaatgttagggcaccccagcaggatatgcattggttaggcagcccccagtgcggcctcccaccgaggtgcctccttccccaaggtattcagtccagtgaaagtaattcagttcagcccctggttttagaggggctgcctggggctgtcagtctcaaatagtctgtcagtgacactacttcatctgcctggtgagtgtagatggcatctggacatgttctgcggggacatgcagtagaagctggccctctgctgccagctcatagtcacgctgtcacgtgccatctaggctcagcccttggtctgagtccaaagcgcctgcagcacttgcaaaagcagcacaagagttttcttcgaaaagaggggaaagcttccagaagcagttccaaaaagcaaaaatcattaatgccctacttcctccccgagccttcccaggtgtcagggttgtttttcttgactgttacaaaatcaatgtgccccattcaataatcctaacttcatgtattttttcctaatcacttctcttttcacctagaccttctggaaggattgtgtgtaagagggacagaggcattttcacagagtaacgttttaatacaacttaaccagaaagacacaggaactggtcagggcaaaatcctgattttcaatattttttcaaaatgggtttacgtaccccccgccccaagcctttttccatgatcatttatttagtgaacacctagcaaaaatcagttcttttctgaggacagctgcattggatgatcaaactgccttaccaagttgtgtacaacaggagaaaggcaagggaagtaaagtcaggctatcggtccactgttgcaaactgcaactaacctggaaagtggaacacaagtcaacagccttgagacatccctgagagtctgatctatcaggggtgggcagaggggtcacataccctgtggtgtgcccttccctaaattgcagcctttggctagaatcaaaagttaggaatgcaatcaggctcttgtatcccgtatcagaaatatcgagtccatcagcagctccatttctaatggtcccatcagagaacaagcctttttctctagggcatctgcaggtgacccagatggtcagctagcatccatgatgttttatagctgtgaccccacagggatgtcttaaatttgtggcagttccagagactgagttctgttcgttgagcctgtgccgacttg

SEQ ID NO: 17122 - DNA, 50381 bp, Human
  misc_feature (1)...(50381): n = A,T,C or G
cctgagcccaggagttctgaggccagcctgggcaacaaagtaagacctcatctttacaaagaaattaaaaattagctgggcatggtggcacacgcatgtggtcccaatatacatgggaggctgaggcaggaggatcacttgagccagggaggtcgaggctgcagtgggccatgttcacatcactgcaccatgacctgggcaacaaaaatatataaatgggctgggcgcagtggcttacgcctgtaatcccaacattctggcaggctgaggcgggtggatcacctgaggtcaagagttccagaccagcctggccaacatagtgaaatcctgtctctactaaaaatacaaaaaattagctgggtgtggtggtgggcacctgtaatcccagctactcgggaggcttaggcaggagaatcgcttgaacccgggaggcagaggttgcagtgtgccaagatcacactatcgcactccagcctgggaagcaagagcaaaactctgtctcataaaaaaaannnnnnnnnnnnnnnnnnnnnnnnnnnnnnntatatatatatatatatatatatatatatatgtaaaatttattttaatatttataaatgttgcatttataaaatatataaataatatatattacctggcattcctccaactcacaaaggtacagttgctctaattaaagggactcctggttaagccgtggctttaagaacagtttgaaaacctttttgcttttaaaagacataaaacagcaagtaaaatggaaggacagacagacctctagtttggtttgactggagctgtatgcttaactaaggagctgaaaaacagaggcggaggttgcagtgagccgagatggtgctactgcactccagcctgggcgatggagtgagagtgactcaaaaaaaaaaaaaaaagaaaaagaaaaagaaaaacaatacctattaatagcctttatttgtgcgtgttagcaacagtttataatgatgcttccacatgctttcagttaggccctccttgtgaatgtgaccttcacttagacgccaactttgaagggaatcaatactacggccttgttctcattagggctgtactaaaataattgaaactgtcacacatcatcaaactcaaaattttacaataccttgaatgacactgtgcttacaaaactgacggtgatgtgtaatgatgactaatgtaagtcaccatgaagaatttttatgggaagtaaaaattcaattaagatggaagtacctacccttgcattgtgcaaggcaatgaagatctgaaggaagcctgccttcaagggcttggattttgacagcggacaggtacacaaatacagcaccaggtaaaatacggcctgtattatcatttatgggtgggtacagaggagaaattctgacttacggaatgatttcctggagaagaaattactatctggcttcttgtgaaacaaaggctctacactttacccttgccaacgtatagtatgaaggtctttaagcttaaaaaaaatcattaattagaggaccactgggcatcatctaaggcaagtgtatgactttagagtcgggagaaacttgcgcctgagctagaaatgcactagcctaccattatcacaagagcaagtcagtgacagaacagttctctgaccgccagtgcagtgccctcccacttgatcaatcagtcattaaggctcactggcaagcccttcgtacttcttccctctccggcactagcttccttaagtcgactctgtgaaatacctgctaatcttatcctgaaccagagtttcgaccctcggaacagtcttgcccacatctttgggacccgattcgtcctgctgattccggcactcgaggggcgggttggttggaacccaccccaccaggcccctctcaatcccacacggtgtccacccttgcccgcaggacggcggcccggaagtgacgtagtggaagcggaagtggtgtagtggtgccgacttcctgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaaggtgaggctgcgacgcgctcgcctcccagggcgcgcccaccgctcccttccgcgccctgtcgagtccgtcccggcccagccaagcaagcttcccagacgggccggaagccccggtgcagtccttagcgacctcctcagaaccccgccccgaggcgcctgtcgcctggtgcgggaatccccgtacgggagctgggagggtgggggacggcgacagtcaacaaaggcgtggagcggaggctacctgacacctgccgcccacccgccctcctctcttccactgagtttggagctgtctgtggggcagtgtagtttttcgtttgtttttataaacacaaacaagggatcatacttagttgtagatctgaggcaatcctctactcctgtcccaatctagggatcctccagtcttagcctttcttttgccgacccgcagagagtgtggccttttcagttttgtattctccagaaaagaagcgaaaataccagtcccttactgccccaggtgaaatacataccattaccatttcagggattttctaagagtaactacttttaagtgtatgcttcttataacgcgtatttatttgctttgagcttaatttatgatcttcacggctcaagactagtgttttttttttcaatttttaaaaaagcagttaagcattttgtattttaaagccatgatttatttatataattacttcaaacgtggcacctcacaccagagtggaatggcttttgttatgttttgttgtaattttccaaaactatgtaaaatgattgagagttgagtcttgaccagttcaacgtgttagcttgggatagttttgtcaaagcaagaatggtagcaatcagcggtttaagcggtttcaatttttaataaaacacactattatgtgtaaaacttttttaaaaacagactttttccagttaaatcgcccccatagttcttgattgaagaccaaataatctctaaggagaaaatgacagctttcaaaataaagcatatattggttgtgtaatcgtatattttaggcttcttggttttgttttgataaacttgttatccttagttatagaagacatatgggaagccatagaagattgtgacccaggtaaagatccatgttgtaacttttatatatcactttttgaaaaaaacggtatattgttttacatagtatgtaactgaagagtatctgttccatgactcttttttttttttttttttttttagagtcttgctctgtcacccaggctggagtgcagtggcgcgatcttggctcactgcaatctccgcctcccaggttcaagcgattctcctgccttagcctcccaagtagctggggattacaggtgcccaccacttcacacagctgattgttgtatttttagtagagacgggatttcaccatgttggccaggctggtcttaaactccagacctcagtgatccaccgctttggcttcccaaaatgatgggaatacaggcgtgagccaccacacctggcctccatgacatttttgatctttaaattgatagcatagtcattaagannnnnnnnnnnnnnnnnnnnnnnnnnnnnnnnnnnnnnnnnnnnggtggatcacctgaggtcacgagttcaagaccagcctgatcaacatggtgaaaccccgtctcctaaaatacaaaaattagccgggcatgatggcgggtgcctgtaatcccagcctactcgggaggctgagatgggagaatcgcttgaacctgggagacggtggttgcagtgagtcgagatcaggccactgcactccagcctgggtggctgagcaagactccatctcaaaaaaaaaaaaaaaagatttattccttaatgtatgtatattcatataaagagcaagaatattcaaatattagcttattttttataccctaattaagtttcctaagcttccctagagaaacctgccatcaaagacaaaggcaaggcatgttcagaagatattttatacctctacctgccttcccctccacccaacctgtgattactttagaaacaaaaacagaggtagggaagaggtgggagagggcatcctacctgccttttggtccttgactcaatatctggaaaattgagactcctgtatgtgattatgacgattctgagcatcagcattagtactgtccaacctatgaattttagacaggtaagaataggaagtaaagtaatagaagcagttgtggggctccttcctcctaaagaagggcttcaaatgttttcctttcagctggtgtggtctgatgtaagaattgttagccaggaccctgaacacatagctagggtgaaggtcattattgttttctctttatctgattgtaggctctccacacacatcatggtactctggccacctgccttatgttttatgtgtttattataaaaggtctttttttcccttgagcattatcttagctcccaacttcaacataactttcaacacctttctctgttatttttgcaattaacagatatatttataccagattagtccttcttcttttacagaaacaacttcccactttagatgtttcatacatacagccacttatatttttacatagtttatctacagcatttctagaggcacagtcactgctaaatgagtagaagaaaactgtgggcctggtgtggtggctcatgcctgtaatcccaatactttgggaggtagagatgggagaatccacttgaggccaggagttcaggatcagcctgggcaacatagctagactctgtctctacagaaaatttaaaaatcagccagacttcgtggcttgcacctgtagtcctagctacttgagaagcagaagcaggaggatcacttaagcccaggagttcaaggttacagtgagctatgacagagaacctgtctcaaaaagtaaaaaataaacattttaaactataacaaaattggccaggtgcaatggctcatgcctgtaatctcagcactttgggaggctgaggtgggcggatcacttgaggtcaggagttttggaccagactggccaagatggtgaaaccccatctctactaaaaatacaaaattagccagacatggtggcgcacgcctgtaatcccagctactcgggaagctgagaaaggagaattgcctgaacctgggaggcagaggttgcagtgagctgagatcacgccactgcactccagcctgggtgacaaagcgagaatccatctcaaaaacaaataaataaataaaaataataaaataaagattgatatgtccctcactgttttaggttctagggatgcaacagtgaacaatcagacaaagaaactgtgcttctggaatttaaattcttatagaaggcaataaacaactcaataaatacatcaagaagtacgttggaaagtgataagtgctttagagaaaataaagcagggaagaaatggggaatgctagggtgtggaaatgggatgagtcaccgttttatatctgatagtaaagagaggtctttctgaaaaaatctacttgagctcacctgagagaggtaaagaaactgtgtgcttgacatggggcttacacctgaaatccaaacattttgggaggcggaagctagaggatcacattgaggccaggagttccagaccagcctgggcaacatagcatgaccttgtctcttctctactaaaaatataaaaaaattagccaggcgtggtgcatacctctaatcccagctggttgggaggctgagatgggaggatcacttgagcccaggagtttgaggttgcagtgagctgtgatcacaccactgtactccagcttgggtgacagagcaagatcctgtcaagaaaaaaacaaacctggaacaatctggggtaagaacatttcagaaggaaggaaaaacaaatgcaaagactcatagacagaagtttgtcatgcatgatagaggaacaacaaaggagggtatggtggctagactggagtgagcaagggaggaaagtggtggtatgggtctagacagcatcaatggtatgggaggtttggagggccttgcaggccattgtaaggaccttggcatttacttggagtatgatgaaaagccgttgctgtgtttcagctgttagcaatattactctagatgctatgctgagactagactgtagggggttaacgatggaggcagagacacgtaaggaggctgttgcagtaatctaggtgagaggtgctggtggcttagaccaggactgtagctgtggagattccggatgtattttgaaggcaaagctaacaggatattttgacagatttgctgtggatgtgaagaaaagagagggcatcaaggataatgtcatggtttttggcctgagcacctggaaggatatgtatgtatacacatatggaagacactggagaagtaaatttggggagaagatgaggagttcagttttggtcatgttcaatttgacatttattagatatccaagggaaatgtcaaattggtaattgtatatatgttttctggagttcagagaagaggttaagattggaaaattttaatttaagggtttcaacatataaattaattttcaaccatgagggagatcaaaggaatgagtttagatagagaagaagaccaaggacttagcctgtgctcaataataattggttaggataagagaacgaaccagcaaagagactgagaaggcacaggcacagagtgcaggagaacagttgatgtcctggaaatcaaatgaagaacatgttttaagagaaagggagctgggcatgatggctcatgcctgtaatcccaacactgtgggaggctgaggtggacagattgcttgagtctagaaattcaagactagcctgggcaacatgctaaaatccagctctatcaaaaatatacaaaaattagccaaacactgtggcgcatacctgtagtcccagctacttggaaggctgagatgggaggattgcttgagcctgggaggtggaggttgcagtgaactgagatcacaccaccgcactccagcctgggtgacagccacatgctgtctcaaaaaaaaaaaaaaaaaaaaaaaaaaggaaggggccaggtgcagtggttcatacctgtaataccaacactttggaaggctgagttgagaggatcacttccaggagtttgagaacagcttgggcaacatagtgagatcctgtctctatgaaaaatttaaaaattatccaggtgtgatggtgcatgcctgtagtcccagctacttgggaggcggtggtgggagtatcacttgagtccaggaggttgaggctgaagtgagccatgatcataccactgcactgtagcctgagcgacagagtgagaccctatctcaaaaaaaaaaaaaaaaaaaaaaaaaaaggaatcagtttggtcaaatattgctgaatcagcttggtcaaatactgctgacaggtgaagtaagacaaaggtagaattggtcattacatatcatgtggcagttattggtgaccttaatgaacaatttcagtgaaatgctgagtgtagaagcctaattggagtggatttgaagagaccaggtctctagacgttgagcatcagtggttgctgatatcacagagatactcagatatattgtgctccatgatgaaaaaacgttatcctctatgaagtgatcttaccagagaagaggagaaaaatataaaagcaaattttttttttttttttccaagacggagtctagctctgtcacccaggctggagtgcaagggcacgatctcggctcactgcaacctctgcctcctgggttcaagcgattctcctgcctcagcctcctgagtagctgggattataggtgcggaccaccacgcccagataatttttgtatttttagtagagatggggtttcactgtgttggccaggctggtctcgaactcctgacctcgtgatccgcctgcctcggcctcccaaaatgctaggattacaagtgtaagccaccacgcctggccggaaattttgtaatcatgaaaataacctctagatccaactaactcacagaaacatatatctatgaaactatactaaagggatacaattaacacattccaaactgtgagagcctctgtaggacaaatgaacaaatttctttaagaaataaattctaaggagcaaaaaagagatgtgcccatcagttaagtatttttcagctgaacagtaggtgaataaaatgttcagtaagaagtgggccatacgtgcctgtaaatcccaacactttgggagcctgaggcaggaggattgcttgaggtcaggagttggagaccagcctgggcaacatagcaagaccctgtctttacaaaaataaaaataaattagctgggcatgatggcacatgcctgtagttctgtatacttgggaggctgaggcaggagaatcacttgagcccaggagttcgaggttacagtgagctgtgattgtgccactctacttcatcctgggcgacagagcgagaccctgtctccaaaataaataaaaggagtgaaatacagataaatgctacaacgtggataatctcaaaaacatgctaagtgaaataatttagtcatgaaagatcacattgtatgaataagcaaatctgtagagacaaagtaaattcgtggttgtctaggatgaaggctggggacaagtagaatggggggtgattgctaaagggtatggatttctttttagggatggtgaaaatgttctgaagttgattatggtggtggttacacaactccaaatgtactaaaaaccattgaactatactctttaaatgtgtgaattatatggtatgtgaattatatctttaaaaagctattaatggtgagttaaataatataaattattgagacgttttaaccaatgcaatgtgtggactttatttggatcctgattcaaactgagaacataaaaaacatgacttgagactatagatatttactgatgttaagaaaatagtgattattttagtgtgataatagtattatgggttttttaggttctttcaggctttcattaatgttaacaattagtggaagagattttaagaaaattcatccagctgtaaaatatatgcattggttttaaactaaattcttatgcgattttgcttttcagtacaaatacagagacctaactgtacgtgaaactgtcaatgttattactctatacaaagatctcaaacctgttttggattcatatggtgagtttatgcagtaaaaatagcaatttctatactttgagtttactctctttgttaatgattgtaattttttccatttgaggtttgtggatttttcaattgtgggattgcaccaccgcctaataaaactgttggagggtagcaaattagaagatctaataaaaacatttcatatttctttagttttagttttttatgttaaaaaaaaatactgtacctggatgtggtggctcatttctgtaatcccagcactttgggaggctgaggtgggtggaccactgagcccaggaggttgagaccagcctgggcaatatggtgaaacctcgtctcaacaaaaaaatacttaaagttggcctggtgctcctgtagtcccagctacccaggaggctgaggtggaaggattgcttgagtccaggaggcagtccaggaggcagaggttgcagtgagccgagatcgggccactgcactccagcctgggcaacagagcaagaacctgtctcaaaaaaataaaaaacaaaacctctaacatagaactatgcaaatttaaacctaggaggggatgttaaagataatttagtccatttcccaaagtgttgtctgtagacccttagttatgctgggaacaggggtagaggcagaattctatagttaagcttgagcaacttatggattaaacaaaattgagtttcattgcatgaagatttatcagagcctttagtatgctaatgtgttgtgtatcaccgagacgagcaagaatatattgtataatacatcctaaagttatttaactgctgaacctccctgcccccatagtgtctctttatattttcaggaacacattttgcgaaactatactctggactgtccctttcattttatagatgaggaaaatgttatttaatgtggtctttaattctgtagagtaggtaagcataacagtttgtctctactttctattgagacaaagttgtaaggcaagacaacgcttggagttttccttattttaaaatagtcttttctgtccctaccaaatcctaacataatttcttcaaccctgtctccttgaaaataatatgccagggccgagggaaaacccatgctgctgcttgtccattgtgagtcccttagctctgaaagcaaggaactgaattttgtagctgagactttctaaatttcatttgcttccaaggctttgaaaacattaggaaactggtgaagagaggtgggaagcaacagaggggcaatcagttctgcatttcctgaacaataaagacatgaacccaaagtcctcttccaaacctaggacacgattccttctcatctcagcctaccttatttctgtctgcatactatatgtacaatggtattttgaactacaaaggcctcacattaccaaaattaaagttagtttttaaatggcttcagtggggagaaaaatggttggagctagaattttatagtttttactgcatataaaagaataaatacatttatcaaaactgacaaagactccattataaagtcttgtatagtttcatgtggctggactaagtgtaaatcattgttaacaaatacttttagagtaaacaaagccccaaatttatataaggtggttttcttttttaaaatgcacaaaatcagaatacattgcggtatagcttacattcgtcaacagtaagtaaaataacaaaggtcaagaatgtacagtcgtgcattttgtagtgatagagatatggtctgagaaatgcattatttggcaatttcatcattgagtgtacttagacaaacctagatggtatatcctactacacacctaggttatatggcatagcctgttgctcctaggctacaacctataccagatgttactgtactgcataccataggcagttgtaacacaatggtatttatgtatctaaccgtagaaaagttacagtaaaaatacagtattataatcttatgggaccagtgttcttatgtgcagtccattgtagacccaaacattacacagtagatggctatagttctatgtttttgtactgcacattacaacctttcctctatgggtatagtgttaattccaaattattgttagaaataatagctgtccaatacaaactatgtgccatattaattatagacataaattatagatagaaaaatgtgtgtggtatgagaaatacagattgaaagaaattgtttatatttggctatgaacttttctttttttcattttaatactggctaaggaggctgaggccaggagaccatttgagtccaggagttcaagtccagcccggacaacttagaccccatttctaaaaaaaaaaaaagctgggcatggtagtgcacgcctgtagtcccagctacacggaaggctgaggtgggaggattgcttgagcctagagtttgaggatagcctgcacaacatagcaagaccctgtctccaaaaaacaataataaataaataactgtgagcgactagggataaatgtctgcacatctctaaaatagaaagacagtaggttaacatttagtatggtattgtttgatagtgtttttttgtttgtttgtttgcagtggagttttgctcttgttgcccagactaaagtgcaatgggcacagtctcggctcactgcaacctctgcctcctgggttcaagcaattctcctgcctcagccttccgagagctgggattacaggcatgtgccaccacgcccagctaattttgtatttttagtagagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacattgacaggtcagcccctttcaaggataatgatgaattttaaccagtctttctgaaagaataacttatgggagtatcttaaaaaatgctcatgattaaatcattgctctttcctttcagtttttaacgatggcagttccagggaactaatgaacctcactggaacaatccctgtgccttatagaggtaaatgtcttattaggtttccagcatagatgcattttgaatacataataaatatgttgccaaagagttataaccaaattaaacctactttctcagggctttgatgctgatatagattttaacttctattcaaattgaagttcatttggcagtaacacctaacattttcagctttcttaaaacttccttaccaagatatatgaacaaataagtgcctaagttcaccagaggagtttaatgtttcactgaatcaaataattgtagaactagaaatggatcttacttgcctcctagttcagcctcccacaccattcaaactttcctgacaatgggaagctaagatataggcttcaaagtcaggacagagttatgtttgagttcttgctctataatcttagcagttttgttacatgttatatatggatatctttgacatttggataatagtacctaacttgggggaagtgagcatttattagataatgaatgtaaaggacgtggcacagagcctggaatataataagcagacagttaaaagtagctgttatttatggttgtgatgttggtgataatgctaatgatagataattgatctctgttagcctgtctttcaccctctgctgaaatatttagtggtgaggaagcatttagcttaatgagagaccattttgtttttggacagctctgtttgttaattattccttgtaattagctaagacctatgtcctttacccattgatttcacatagtacctgctattcataaggcaataaggataggagctgtggctacaaagatgaataaaggatgtacctcttctggaagaactccactaataggggaaacaaagggaacagatagatatttacactattctgtaactgctatagaattataaaatgaaaaagtgctatgagattacagaggagaacaaggccacatgggaagatcacagaggaagtgacatttgagccactattaataagtcaaccattcataataaacagagggaaaaaacagttaattgagtatcagcattgtataaagcaagtataagtttagggaagactgagtaaaatttaagattactgactttgctattgccctcaggaaataaattctgctgggggaaataggaatgggggggatgcggatatatgtataaattgtatctagactaaacctctgttcctttaaccattcttcaatttaaaaataataaaaatagagtaactgaagtttctatttctttttcaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacgtaagtattcatagtgttctgtgaattagttatgttttatatattttgctcactagcatctgctttcttttagcactcaaggaggattcgaggtaggatagataagttcagataatggactaatcactgagttgagggtaaattagaaaaggctgactaaaagaaatgggtttctgtagagctttgtaattttcagaatacttatattcaatattttgttggctttagttgaacctttttaaaataggcaggattcacatagtgggaagtgcattttaaaaaatagtatcctggtgaggtagttatggaattcaaatctgattactcaaagcatttctgtcaagaataatagtagggaacttctgtttatgtgtctgatagtgtaactgtgacagattaatgttcctatgaaaaataactagaaaagcaagagaaaatacaaacaacacctgttggaaggctttggaaagctgtttaggcaatcaagacatgtatggccaagattctgtagagaagaaaacagcaaagagatgaggtagttctgccaataacttttcccccagggtacttactgattcctttttttttttttggagacagagttttactctgttgcccaggctggagggcagtggcacaatctcagctcacttacaacctccacctcccaggtccaagcaattcagcttggtagactcaacctactgagtagatgggattacaggcgcccaccaccaaatacaaaagttttgtattttagtatttagtagaggtggggtttcaccatgttggtgaggctgttctcgaactcctgacctcaagtgatccacccatctcggccttctaaagtgctgggattacaggcataagccaccatgcccggcctacttacttattcttgatgaaggatgaagggctgagaatctgggcaaagggccttagctaagaggcagagaaacctgcagagtctctagcagtctcagagggctgaaaagacaaaagttgctgttctgtctaccaaagtaactaggacttttagatccaagatttgggagaaaagccataaagaagtgagtagctctggggatggtggctcatggctgtgatcccaggactttggaaagctgaggcaggaggattgcttgagctcaggagtttgagaccagcctgggcaacatagtgagaaccccatctctataaaaaaatattttaaaaaaaccttggcatggtggtgtgtgcctgtgaccccagctactcaggaggctaaggtgaaaggatcacttgagcctgggaattcgaggctgcagtgagccatgattgcatcactgtcctccagcctggacaacagagcaagatctgtctccaaaaaagaaaagaaaagatgagatactctgaattttcccaccttaagagatatgttgaattcctgagcttcaaagataagatgctaaaaaaaaaactaagcagaacgcctctgaaaatcagccaagttttcagcagtcttaggttgaggaggcaattggagttcagtaccttatcaagaaggggaacaagtaaacatcctaggctgttagttggcaccactggaagaacacatcttaggagggagaacttagaggtagaatgagccttataaaaatctgtccttgaggctgggtggggtggctcacacctgtagtctcagcactttgggaggctgaggcgggaggatcacttgaggccagaagtttgagacgagcctggccaacatggtgaaatcccatttctactaaaaatataaaaattagccaggcatgatggcacatgtctataatcccagctactccggaggctgaggcaggagaatcgcttgaacctgggaggcggaggttgcagtgagccgagatcgcaccactgcactccagcctgggtggcagagtgagagagactgtctcaaaaaaaaaaaaaaaaaaaatctgtctgtccttcaatcagctcagtccctgatcctgactgtctgcctgccacaggatagggtgaacccttgctggaagaagataatatatagactctctataatttttcacaatgtctagcatacaatttatatttatcaagtacaccaagaaagagaaccaagaggaaaaaaagacaatagaaacgggacatccctccactccacccccacaaacacacaggtaacttggttatcagacacagacttaaaaatggttgtgatcagtgcattcaagaaaatagaggacaagatggtaaattttattaaaaagaaactaagtggaaatcttagaactgaaaaatagaataatagagattaagaactcagtagatgggtttagtagcagactggactcagtagaatagagactgcctcaacctcctgagtagctgggattacaggcgcccaccaccacacctggctaatttttgtattttttagtagagatggggttttgctacattggccagtctggtctcgaactcttgacttcaggtgatccgtccgcctcagcctcccaaagtgctgggattacaggtgtgagccattgtgcctcgcctcagtttgaattcttaacctgttgctttatattaggcctggaagtagatattaacatagatattaatttttttcttcaaagaatttagtgtaaaaggaatggtatgataattaaaacttaccttgacaaaactgtaagaatgtatgaatgaagaattgattcatactaccacattaatgaattctgaaaacattatgccaagtgaaagaagccaagcacaaaaggccatatattgtatgatttcatttatatgaaacatttaggaaagcaaatctatagagatggaaagtagattagtggttgctaaagggctgtggggaaagggaaacgggaagtgactactaatgagtacagggtttctttttcggatgatgaaaatattatggaattagatggtggtaatggttgcatagcttcgtgaaataataaaagccactgaaatgtatactttaaaaggagaaagtttatgggatgtgaattatatttcacctacatgcatgaggcttacatgaggctatgatttagttaaggaattttgttgggccgaaaaattgagaaagcatgtggtctcagtggccatccccacacacaccagccacagtatctgtgagtgttgcacagatactgtgcttataacaccccgagtctcagtatataaatttacaggcaaacacaagaaaaatattggaaaagtagatatcagcaagttttcacagaaagctttgagaaatgttattaattgtcatcttccatgagttaggtcaaaattgaacaaatgaggtgagtttggttctttggaaaaggtgaaaactgccactgaactcttctgtcaggagtattaaaagaagtgccaatcctaatcctgtaatcctgactacttgggagactgaagcaggaagattgttgagttcaagtctgagctgggcaacatggcaagaccttgtctggggggaggaggggtgtaaaaagtagtttctatgaagatggttagcctatcaaggtgattgagtaattcttcagaactcagtgaacttatgaatgaagtacgtgagatgagatatacacaaaatagattaaggagtaaaagaagaataatcaaataagccattttgaacaactttgtctagcacagcttaattagtggttggtagatatttcttttgttgttttttgttgtcattgttgttgttgggttttgtttttgtttttttgaaacagggtctcactctaacccaggctggagtgcagtggcgcagtcatactgcagcctcaaccttcctggctcaggtgatcctcccgctgcagcctcctgagtagttgtgaccacaggcgcatgccaccatgtacagttaatttttttgtagagaccaggctggtctcaaactcctgagctcaagctggattacaaaatggaggggaaagtactggaatagacctagaatttttaaaattatgcatgctgcaaaatagccttatttgatcctcctgcctcggcctcccaaagtgctgggattacaggtgtaagccaccacccctggccagtgctcaataggtatttgagagaaaatcttagtaacttatgaaaaaataggaatctctttgtcattgttggaaggaaagatcctttaacaattcacccctttgtactacaatctagcaatttctaagctagaatctacgtataatttttttgtttgtttgttttgagacagagtcttgctctgtcgcctaggatggagtgcagtggtgtgatctcagctcactgcaacctctgcctctggggtttaagcaattctcttgcctcagcctcctgagtaactgggaccatagacgcacatcaccacacccggctaatttttgtgtttttagtagagatgggattttgccatgttggcccagctggtctcaaactcctggcttcaagcagtccacccaccttggcctcccaaagtgctgggattacaggtgtgaaccacctcacttggctagaatctacctataatttcagagttcataatatctttaataaaaattaattttaagaacacgtatttccaagatatcattgatgtcttttaatggcctttaataatattgtgactgttgctcatattcatccctaaatttgtaccagtatacttataatacattgtacagtggcaataaaataaatttttgttagttctgtggagtcaaatgaagaacaaaactctatgaattttgcaatatgctgctttaactagtgctatttttatatacttgaagcaagaaccttgctgcacatcatgtttaaaaccacttaactctattaaaataaattaattaaatgaaattttcatgattggggtcctacaaagaaaattatcaagctgagttgaaaaccgatgagaaatggctaacctttttctttttactgaaaagcaactctgtagctgacttgaattttttttcattttgtagccacagtcagacttgttggggcttattcaggtcatgattgtggtatttggagatgaacctccagtcttctctcgtcctatttcggcatcctatccgccataccaggcaacggggccaccaaatagtaagtagaattgagattttactttaaaactcatataaacaaaagagaacagaaacctttgtaaaaaaataaagaaaaataatgacttctttgctttttagtttatcaagctagtggattttttggaagtattctgaggccccacatctgcatgtacagattcccaccaaagactggcatttgggcttccatttgtaggtagaaatctaagaatggttgtgctggattccaaaatggaggagaaagtgtagaatagagctagaatttttaaaattatgcatgctgcagaatagccttatttgatcagcttggaagcacatataacttgaaaggtagtctgacctctcctttctctttgcaactacaaaatcagtgttgtagataaggattaaggtcaactgaagcgttcacattcagctattctgggtatacacaattggacatctagctcttagctttcttctctttcgtacagccaattcatgattttaccttgtgtggagtggtgggagcatggagagagtgttgcttctcccctaattggaatatattatctctgttatctctattttcttgaataattcttactgatacttaaaaatcactctgaataattgtgagttggttgtacttattttgaatttactaaatctgcattgatttcactgtgttttgagctgtgactttttttttttggtaaattttctttaagattataattaaccaaacttgtttatcttacaagacaaattatatgtgctttcatttttcttctgctgaaaattatactttttcctttttaatccattctttcctgaggaacatcttggtttataagctgaatgggaatttaacagaaagaatttttgaacccatttctctttccttccctaccttcccagaataagcttgattttaggattactatttcttttagtaaaggtactggtaattcctttggattagaaatttgtttttatcttattaaattctgttgactctagtgcccaagagtagagtatcttgcttaagtttgaaatacgaaatatttggccgggtgtggtagctgtaaccccagcactttgggaggccgaggtgggggtggatcacctgatgtcagaagttcaagaccagcttggccaacatgatgaaaccccatctctactaaaaatacaaaattagccaggtgtggtggtgcatgcctgtagtcccagctactcgggaggctgaggcagatgttgcagtgagctgagatcgcattactgcactccagcctgggtgacagagcaagactctgtatcaaaaaaaaaaaaaaaaaagatatcaaatatttcctagtctcattacctttgtttatttgctcagataatatagcgagtgaccgctatgacaaaggtaaccttttcagaaattcaggtagtctcctaagcaacttttttttttttttgagacagagtctcgctctgttgcccaggccggagtgcagtggtatgatctgggctgactgcaacctctgcctcccaggttcaagtgattctcgagcctcagcctcccaagtcgctgggattacaggcccccaccaccatgcccagctaatttttgtatttttagtagagtcggggtttcaccatgttggccaggctggtctcgaactcctgacctcaagtgatctgcctcggcctcccaaagtgctgggattacaggcgtgagccaccgcggccggcctgcaacattttttttttcctaaatttctttgagttttaaattgacattggaagtgcagtattcaagaaagagaccatactattgttactgttgcaattcaattttgtactcagtcactgtaagtcatgttaaacactctagagcagattctttactatttttttttgtcagttaagctcaagattaacttctctttttcttcctctatgttgattagcctcttggcaccactgatcttagttctttggcattcacgttctctttaaagaatgtataaagtattctttaagcttgctgggttttaaccttttatccctagtatttctaagcttttgttttgtttgtttctttgttttgagatagggtctcactctgtcacctagactagtttttaacagtctggataatgtaagttttgtataggacttctcatagtagtttgaagtctcttgaagtctttaaaccaacaaaatcagctgtgctaattggccaacatagttataaaagaaatatcaaaagatttattagatataataaagaagttactctctaagaagttaaccttggaccgaagaaggccagaattaccttcctctaaatttgaaattgaacttgctcttaggtaatagacttcttgagaactttaaaagctgaccaggttgacctgtttgccagttcttttggtagggattgtcataagtattgtaattcatgtttaatgatttcaggattatgaaagggagaggtatttgttttgttttggtgctgagatttggattttttaactgtgaaattttgctgtgtattgacagtgtgatgtatatcttattcagtagcctacatattcaggccttgtatattatttttacaatgtgaaaaaaattgtttttagcttcctacatgccaggcatgccaggtggaatctctccatacccatccggataccctcccaatcccaggtaatgaaaaacgttcttttgaataattgtattacaaattcttctattagatctagaatcaaaataatttgctaattagggcattaaaataaatttaattgcaatttagtggaagataaaacttggtttattcctggaatttatttatttatttatttattttttttgagatggagtcttgctctgtcacccaggctggagtacagtggcgcaatctcggctcactgcaacctctacttccccagttcaagtgattctcctgcctcagcctccctagcagttgggactacaggctgtgccaccattcccggctaatttttgtatttttagtagagacaggatttcaccatgttggccaggctggtctcaaactcctgaccttgtgatctgcctgcctcagactcccaaagcgctgggattacaggtgtgagccaccatgcccagcctatgtatttttttttttttaaaagaagagagtattataaaatatttttccccttggctgaattcattataactagcattccatttaatatttcagctatctatactagatatacaaatttcttaaaaggacttcaagatcaaaaaccaattgagatcactgtcattactcaacccatttctttcctctttaaaataaaaatgcagcccaggagctgcttttctgtagattgaaagaaactcctttcaaattatacacacacaccttaaaattctagcaataaggccgggtgtggtagctcacacctgtaatcttacccagcactttcggaggccgatgcaggcggatcacctgaggtcctgaggtcaggagttcgagaccagcctggccaacagagtgaaaccccatctctactaaaaatacaaaattagccaggcatggtggcacatgcctgtaatcccagctctttgggaggctgaggtaggagaattgcttgaacccaggaggcagaggttgcagtgagccgagatcgcgccattacactccaccctgggcgacagagcaagactctctctcaaacaaacaaaaccccacaacctatcttttctatacattgcaggaatcaattaatggttcagataatggggtcaaacttgtcgcatgatatttacttattcagttcatagactacctgtactatcaacctttattatccatttagtaataacataggtaactaaattaaattaacaatgaaatcagtctgttaacacacgctagaaagtcaatgataaataattactaacccatgttttaaatgtgtacttgtttcagtggtaatctaggagtactctccaaaggtggtctatgggctaacttaaaatcccacccagcactttgggaggccgaggtagggattgcttgagcccagaagttggagaccagcctgggcaacatagtagacctcatttctacaaaaaaaattaaaattagccaggcatggtggtgtgaacctgtagtcccagctacttgggagggtgaggtggaaggatcacttgagcctacagatcgaggatgcaatgagccgtaattgcaccactgtactccagtctggccaacagagtgagaacctgtctcaaaaaaaaaaaaaagattggcatatactgatgccaagatgagacttccagctgctctaacaattagcaaggaaaatttaactctactaagtcttcttagtttcatataacccagtcataatcctcatggataaatgcagccagatttctgaacacatgtcataggtaaatatatatatgtacatatataatatctaggatcttgaaagttaatttagcaaacacttcatttctgggttgtcttaatttcacaactttttagaaggtaataagcattctgtcactttggataggtaagcagagattagaagaacatttgtcagggacaatagagaaagattcctttggtagtaatatataagcaggttattcattttagatttcttgaggccctaaattttctgattaagttctagaaatggaatcctacctgaagccttgaaattacaaggctactgaacaattgctagtaaaaagcagctttggacatagagggaataattgttgaaggtacactatggaaatggacttctgaacaataaagctacagatggagatttctctgaagttaatatctgtaggcttagaagagttttataccaagttacaaaaaaattcagcaatgtgatcacattatctttgcaaaggtatgcaaaatgggagaaactccagaaaaaaagagcagtttatcccagttttcagaaaggtggatttagaaatttcagtaggattgacatttctttacagcattatagcatggattactgaagagactagaaacaaaagtactgtgttcagtagcctccagcatgtgtccactaggaacaaaaatgctttcttttttttttgtctgattttgcttttatactgatatataagagaagtaccatgattacattgaatcttcagcaagtcatatataaaacttagttgaggacaagttataaagtggaagctgataatacaaataggagaatctttgaaccactgcattgaaaaaggattattgacgataaactcagaaggagctcttgctccagtgtcctaggctagctttttttttttttttttttttgagatgggggcttcactctgttgcccaggctggagtgcagtggcataatctcagctactgtagccttgacctcctgggctcaggtgatctttcaacttcagcctcccaagtagctgggactacaggtgtgtgcccctacacctagctaatttttctatttttgtagaaatggtttcgccatgttgtctaggcttgccttgaactcctggactcaagtgatctacctgcctcagcctcccaaagtgctaggattacaggtgtgatccactgcacccagcctgggctagctctttttaatcagtaattttaatgcgcttgtaaaaggcaaatgtcatagaattgataattatagctaaaataggattaattgagatttattgtctaactaaccaggtggccagtaatcatcctattctaattttcttcttcgttgtaagggaaacactgactagtaagcattcagaggaaagcaattagatctgaaaatcatgtcctgagacaaatggttaaaggaattaagaatagttagggctgggtgcggtggctcacagctgtaatcccagcagtttgggaggctgaggcgggtgaatcacgaggtcaggagattgagaccatcctggctaacatggtgaaaccccgtctctactaaaaatacaaaaaattagccgggtgtggtggcgggcacctatagtcccagctactcaggaggctgtggcaggagaatggcgtgaacccaggaagtggagcttgcagtgagctgagatcacaccactgcactccagcctgagcaacagggcgagactccgtctcaaaaaaaaaaaaaaaaaaaatttaacctgaagaagagaagcttgagggaaaaatgttagaagttctcaaatattcgagttttaggagtctccaaatagttgagtgtcttccaaaatgcaaatttaggactcctatttataaattatattgaaatgatgtttaatgttaaatagagaaagatgaccatttgtcagggatgttataaatgatgtgtgtagataagagattgttggaaaggtgattggagtagaatacctctaaggaaagttcctctgactttgatacgaatacatgaatgacagaaactgtccagaaagtgagaaaaaaggtttttttttaaactaaagatgagtttggtacgaatgttatcaaaagaggaaaaaaactatttaaagacaagtgttttcgggttaaatatccccaaaggttaccaataagccacaggtacaaattaaatagtatcattttcccacagactgagaaatcggaaaagttctctcacaaattacttgttgcttctgatgctgttggattgtccttagaaatactctagttacatttccgctgctatgagggtgactctcatataactgggaccaagcaagagcatttagccatttaagagtaaatgcagtgtcattaatacaatttccatagagctttacttgaataaacacttgcagctccaagactataaattcatcaactggtaaaacaaccatatgtcaaacttaacttcctgaatggggttcttcaaaatactataaggttgggtcatcttaaatgttaaatgttttttgttcttgtctttagtggttacccaggctgtccttacccacctggtggtccatatcctgccacaacaagttctcagtacccttctcagcctcctgtgaccactgttggtaagtacccttgaaaacttgtgtttcaccatataagcaaagtctaactccctgttgtgaaaagcacatttcacttgtgaattttggactactctttcttcttagaggaaaacctataataatgtactataatcttaaacttgaagtaaatgacttaacatataaatgaaccttctaccagggcatgaaaataaatctgattaactcatcaatctttcttttgatcacatagttttatttgtgagccaaacatgtgttgaactattagcagatacatagattttcctagcttggttatatgtgaaaacagatcaccatcattaagagaagaaagtaaaatgggttaatatgagcaggtcaaatcagacaaatgattgaagaccagtagtttttgctttttgtgtttgcttattagcgttacctgaaatataattttcttcaactaaaaaaactaaggcagtgagagaatttctttagactccagccttcacctatgcctatctcccactacctgcaccaccatatctgccttctccctgttaccataagttggttatctttgcttctatctaaagctgatttctccactagaccttatcccctctaatgtactcaggggcatcacttcagcagttccttcctctcaagttttgttctctactggatgactcatcagcacagagaaccatgccctaaaaaagccttaaagagtccaattgagacaaacaaatggaaagacatttcatgcccatgaagaattaatattgtaaaaatgactatattacccaaagcagtctgtagattcagtgcagtctgtgtcgaaataccaatgtcagtttccatagaaatagaaaaagctatcataaaatgtatatggaaccaaaaaagaagccaaatagccaaagtgatcttgaactaaaagaacaaagctggaagcatcatactacctgacttcaaaatatattacaaggttatagtaaccgaaacagcatggtattggtataaaaacagaaacagaccaatggaacagaataaagaacctagaaataaatctacatatttacagccaactgattttcagcaaaggtgccaagaacatatattgggaaaaagacattgttcataaatggtggtgggaaaactgggtatccatatgcagaagaatgaaaactggacccctatcttgtaccacatacaaaaatcaacttgagatggattaaagacttaatgtaagacccaaagctataaaactactagaagaatacataggggaaacccttcgggacattggcctaggcaaccattttatagttaatatctcaaaagcatagtcaacaaaaatagactactgcgatgatactaaattaaaaagcttgtgagccagatgcagtggctcacgtctgtaatcccagcactttgggaagccaaggcgggcgaatcatttgaggtgaggagttcaagaccagcctggccaacatggtaaaaccccgtctctcctaaaaactaaaaatgcaaaaatctgggcgtggtggtacacccctgtaatcccagctacttgggaggctgaggcaagagaattgcttgaacctgggaggtggaggttgcagtgagctgagatcgcaccactgcactccaccctgggcaacagagcgagaccttgtctcaaaaaaaaaaagcttctgcacaacaaaggagatagtcaacaaagtaaagagacgacctgttgagtgggagaaaatatttgcaaagtacccatctgacaaggaactaataaatatacaaggtattgaaaccactcaacagtaaaacaaaccattaaaaagtgggcaaagaacatgaatagacatttcttaaaggaagacatacaaatggccaacaggtatatgaaaaaatgctcaatatcactcatcatcaggaaaatgcagataaaaaccacaaagaaatataatcttatcccagtttgaatggccattattaaaaagacaaaaaataaaaaaataacaaatgttattgaggatgaggagaaaagggaacttatacaatgttggtgggaatgtaaattaaagccactatggaaaacagtatggcaatttctaaaaaaactaaaattagaactaccagacagttcagcaatcccactgctgggtatttatccaagggaaaggaaatcagtatattaaaggaatacctgtactcccatatttatagcaacagtattcatactagctaagatatggagtgaacctaaatatttatcagcagatgaatggataaagacaatgaggtatgtgtacacagtggaatactgttcagccataaaaagaatgaaaacgtcattgtagcaacatggatggaattggaaataaactaggcgcagaaagacaaatatcaaatgttctcatgtgggagccaaaaaacttgatctcttggaggtagacagtagaatgatagacaccagagacttaagaacggtgtgtgggtgggatagggcttatgaagaaaggttggttaatgagtacaaacatacagttagatagaaggaataagttctaatgtttgatagcagagtagggtgactatagttaacaatgtattgtctatttcagaatagctagaagacttaaaatgttcctaccacatagaaatgataaatactcaaggtgatggataccctaaataccctcacttgaacattacattccgtgcaggtaacaaaatatcacatggtacccacgtaaatatgtacaaatattatgtatctaaaaaaattttttaggccaggcacagtggctcacacctgtaatcccagcactttgggaggccaaggcgggcagattgcgaggtcaggagttggagaccagcctggccaacatggtgaaaccctgtctctactaaaaatacaaaaaaattagccgggcgtggtggcgcacgcctgtaatcctagctactcaagaagctgaggcaggagaattgcttgaaccctggaggcagaggttgcagtgagctgagatcagacaactatactccagcctgggcaatagagtgggactccatctcaggaaaaaaaaaaaaaaaaaaaaaaatttatatatatatatatatattaaaatttaaacatatttttttttaaacatatttaaatatccataaatataaatttttaaatatttttaaataaatatataaatataaatatatatgatatatataaatatatataaaatatatataatatataaatatataattatatatcatatataaatatatatattttatatatatatatttaaaaaaagaatcctcttctctattccacttttcctgccaccactattggatgtcttcattcttctctgaataactccttgaagtaactctctttgttatcttcagtacctcttctccgtttttctcttaaacctccttttggactttttctcataccattttgctaaaactggtcatgattaccaataactttttgaggttacatccaatggatagttactattctcatcttacttgtcctatcagcagcatttgacacagttggttacttcctccttgatacactttcctcttgttttccaaaacaccatgctcattttattttcttcctgtctcatgggtattcatacttagtctcctctgcaagttcttccatttttcttaacattggtgtgaccctggcttagtctccttggcactctctatcctcactctcctgataatttccaccagttcaatagctttaaataccatctctgtgcccccagttctcaaatttatgtctctgacctatacctctctcctgaactcgagattgttatatccagctgccttttcagtatctctacttggatgtttaataggcatctcaaactcaaccaaaaccgaattctcaatcttcctaacacctgccccatctccattgttacctactctatactctttggagtcatccttgactcctcatcaggaaatcctcttgtcttcaaaatatatctagaatctgatcatatccagtgctgatccaagtcaccattatggctcatctaatttacttcaaaagccttccacaagatttctctgcttctttccttgtccccctacatctctcttttttgacacagcagctagagtgatcctaataaaatataaataaattgtatcactcctctgctcaaaaccttcaagtgatttcctgtttcactcagagttcagtccaaagttcttgggcccagaaggccctacatgatcctgccctcttccccattacttttctgacctcatctcctactggtctcctgtcttaggatttgtccacggcctatttctgtgcatggatcagccaggcctatccttaccaatttgctgccaccaccaccaatcccccctccaaccccccacccacacactcaacatccagaagagtgcttggtatatagaagtttgctgttgaagagatttgctgagttcctgaatgaacatagaatcttgtgaagtttatttttctgttatgttttctgataacttgtaaccatcctgaggtctgatgtaaatgtcatccccccaccccataaagggttatttccaccgtttttctcattgatacacactattcaggttccagtggtgtggttttgatttattaaaatgtatttgtcattaatgtaactacaatataatgaaatgattggagttagaaacctaaatgataaaaggtctttaatccataagcaaagcacactaaatctggtgaagctctcttattttggttcagcattatcaataaaataggaatagtgctgtttgtcaccctgtttctcattgaaataatagtataatccttttgatttgtagagaaccttagtttacaaagatcttttttatattaacttgtttcattacattaggtacgaagcatttttttatagcttagatgatttccatatatccaaagaatagaaatgtgtggaaaatggtatatgtggaatcagatctcatgtttatgatttttgaacgggtaatcaaatcaactaatattttactctacattttcaagagtactgtcttaggcatataggctagaggcaaattattttatgataatttaggatatcctttaatatatattgtttttctaccctttgatctttacctacttgatttgatttttttcatcatatttcattagttgaacatttagtagtctgttgaactttagacttaaaggaaagcagaaacataaaagtatcatttagatattagagtccacagtcacattttctcagtatatcaatggtcacgatttgggctgttattctgttactgaggccatgagaaagaatgaatttggttatttatccttgttttttttgttgttgttgtttttgagacagactcgctctgtcgccaaggctggagtgcagtggcgcgatcttggctcactgcaacctccacctctcaggttcaagcagttctactgcctcagcctcccaagtagctgggattagaggagcgtaccaccacacccggctaatttttatatttttagtagagacagggttttaccatgttggccaggctgatctccaactgcaactcctgacctcaccacctgcctcaacccaccaaagtgctggtattacaggcctgagccaccacacctggcgctatccttgttttttgatacaggatcttgctctcttgctcaggctggagtgcagcagtgctgtctgcccactgcaacctccatctcctgggctcaggtgatcctcccacctcagcctcctgagtagctaggactgtagacacataccaccatgcccggctaatttttgtattgcccaggctggccttgaactcctagattcaagtgatccacccgtgctggcctcccggattacagatgtgagtcactgcactaggctcccttgttctttttgaaacttagcagtttcactctgtagatttattttattttattttattttattttattttattttattttattttattttattttattttattttatttttgagacagagtttcgctctgccacccaggctggagtgcagtggcatgatctcggctcactgtaatctctgcctcctgggttcaagtgattctcctgcctcagcatcctgagtagctgagactataggcatgtgccaccacacccactaatttttgtattttgtatgttagccaggctggtcaatctcctaacctcaggtgatccacctgcctcggcctcccaaagtgctgggattacaggcataagccacctcacccagcctggattttaattttatggtgtaatctgaattaagaaagatttaaaatttaccagatgttcaaaaatattagtatatagtatggtacccagaagagaatggtgttccactcagtgacacttccatatgttgtgaatttatgtgtgaggaatgtcagtggactaattggcccctccctttggaggatgtactgtcagctgtgcttgtgccagaatctccaggtttatttgatctctgtagagtactttttttttttttttgagacggagtctcactctgttgcccaggctggagtgcagtgatgcaatctcagctcactgcaagctccgccctccaggttcacgccattctcctgcctcagccttgatctatgtagagtccttttatcagagtgctatagacatcttcaacctcagtttacatagtgttttgaaaactaactaggggaatgaggaggtggtagtcggtgaataatgaaggaacaaaccaattcatgtagcaaaaaaaaaaaaaaaaacctaactggtagtatgcattgaaacttaacacaaagattctttttcctgttactgtaggagcaaaacataaactgactatacctatcttaatcagtttcacatacaagatccctgaaaaatagtgggtatggatgggcaccaggtgagccaccatgaagtttctctaccacaaccaccacccctgcccctggtaaaaaaagaggaagttaaaaggctttggtgattccttactccagtctcagcagtggtgaaagttctcttttgaaggttgacttattttaaaaagctatatagatgattgtagttgatttatagctctgaatcctaggctttaggcctttaacatatacacagtttgacctttcagtagttgcagtttaataatagtaaaattgaagagtaggtgtttattcccggttaaagccaatacctaccacagaatttttcttggtaaaacttcataaatactgtatatttcaacctctgagttttaaaaatgtcattttaagattttgttcctaaaaatcaaataaacaaggatcagaaacagtaagtttggaagggtgctattaacagagattcagggaccagttttacctttgttaaagtgttgtttaaaaatgtgggagtggaaaaccctgaaaatgctgcagctgaatgatgtgtttctgtagtttccactctttagtccatactgaatatttagataaagaaaggaaaaggtgaagaaaaataagagagcttacctgttaatatttctttgaggacagaagctagtaaacatgacaagtttttcttgactgtcttatccaatgctgttcttccctctggccatcctagattaagtgtttggcctacagaaactgtactttcaggatatggcacccaaggcacccagcccatgtgggtttactagtgcacgcttgcttgtgtgcaggtttgggtgcctcttccccacacctttcacagacttcctttgggaataactgcctcatcttcaggataagtagcgttttcttccaatcctggacagtcagtgagtcatgagtgaaatttaaatgctgagagtttagtctgctaaatgttaaatccttttctgccaaagcaataatgataacagaaataatgataacagaaattcaaagcaataatgatagatttgaaagcttttaaaaaagctattgtgtaagttaacaaatgatttttattttgttagtaaaggaaaggtaggagaagctgattcatttggcttcctgtcgttattcctatagaatacctctaacataatagattcttaaattagtcttttcacaaaacgttaattttaatggaattactttgattctgattcatttttttaagaatagaattttaactctccttcagatttattggcttttgtgcttatgcctaccaggtagcatctttcatcttttatgacttactatgatagctgaatgattttgtcacactgtttcttttttggagtagttattattttgctgtctcattttagcaagacttatacctacttaccttcacttttgaaaactttaatttttatgtaaatgaatttaaactttttttgtggtgtgtgtttattttcaagaagtgtaaacctgctgatagctttctttaaattttttcttattgattgtgttgatagaaactttctagagctcaagtaaagcgcatttttctgagtgtttaaaagataaattgaggccccctaatttctttggaagaaaagctccatagcctgcacaaagcctgtaagtagtattagaagcttacatattcatacactataaataaaaaggacttttgtaagccatgtaatggatttgcagtgtttgcacttaatagcacagatcagaactcctttgctcatacagttgtctgaaatgttcttccttcttcagagatagacctgttttttgttttttattatgaaagaaaaataatcctcatatgttctcggtctagtttctaaatagatggtcagtaagctactgtgtgggattacttgggctccatagtttgctgtgtagcacagatgccagacctaggaccattatgtgggcctgagcaagtaacatccaggagtaaaaatgctgggcaggtagtttacttttgctgattaagggtgaggtcagaaaaattatcgttgagttatagtttactttgggcttatggattctttctctaatataaaatagcttcatttgagttccaggaagtagtgatcgtttgtaaatactcttaggagataaatgaaaccgggtgtcttaagtgtttaaatagtggctttaaatcaggtagtgtatactagtgcactgtgaatatacttgcataaattattcaatgaatttttgggtccattgagtgtagagtgttggtttcctaatactagaaaaattatatcttatttcctaaggattaagtttggagatcagatcctacctgacatttaaaggaagttttgcttaagattgttactcaaagtctgttagctcttcaactgctaatctggaattgtagaagggcacttttgaaatctgactctgcttgagtaaaaaggtcagtgtgttggggacttggggtatggcagtttgccaaaaactcttcttattcttgttatagcaggtatagagaatattcaaatttcttctaagatgtttgagaagaaagtttggtttggtaagtgttcacaaagtagatgagaatcttccaccaaatcttttttcttatttgtttgcataaacattatcttaaagtggcatggttcatcgaattttgaactttgatgagtttttcttttacttctttgaaaaactctgggtttttctttttttactttcttatttcagatcttagttataattcctttttttttttttacaaagtagttcgattttttaaagtttagatatacttcacagtgaagtctatgtgtgatagagataagactaggtctaatcttggtgtttgtaacttcctcaggtgaactgtgacctttataggccaagcgactgctgcctcggcttggttcttattttgagggttaatgactttggctggaaagtcttggcaaggacttatttggtggtattatggtagcatttgcctgaacatattctataaagagaaacagaatgtaaattccaggatttaaatgtgtgtttttaaaaataaggatttaaaaatttagcatcagtataatttgacccattagaccagatataatagctttaacaaagtatgttgatgtgtttatgtgtgaaaaattcactaactataaaaagactcttaagttttcattagttctgataacttctgtgccaatgaatggaataccaccactgttgcatgtgattgaatgcttaattatagacatatcatttaggtacgtaatctatgggagaaggattttccttcctgtctcacaagaaccatcataatatttcatatagattataagacaggttcttctagaaaggttttaaaattccttttgctaatgcagccttactataaactggggacttaatgaaatcttcaatagtcatcatatcatgaatcatcctttggatatgaaattctaaaccaaactcttgtagaaattggctctttttcactttctttaaaggactttttaagtacagtataagaaattagagatttttattcggtctaaattctgtccagatgactgaacagctaagactttaattcatattaagtctgtgaaagagagctcactctctgacgtattttaatctgtatgttcagtgagtgtggaaagatgtgttgcctttttatatggcctcatttgaagtagaccgacttattctacaaattgccatgaagagcaagttcttgattaggtaagaaaatactctttagttaaggacctgtaaagtttggaagttcacaaaaccacctgcacttctgacactcattgcaagttcatggtttcccaaggccaccctaaagttctataattatctagaaggactttaaaagctcactgaaagctattatactcacagttatgacttatggcaaaagatacagattaaaataggctgaggaaagacacgtgggcaacccagaaagtttcaagtgcaaagcttctagttgtcttctcccagtggagtcataggcagtgctgacttttcccagtaacagtatgtatcattatgcatggagtattacccaccaaggtagctcacctgagccttggatctagagtttttatcaggacttggtcatatagacaccattgactgcctgtgaggctgacctttagtctccagctcctccagaggttgagctgttacctatcactgcatggcccagacccccccataaatcacactgttagactgtctggtgtagataaagaacactctaattagtcaggaagttctgagggcttagacatcacctccaggagccaagggcaaaggcgtggcctctctgggtaaagttaattctttactacacagaaccaagctgtaaggcattttgccttattttgcttgaactttaaaaatatccgaatacaggagctgctgctaccgtcgctgcagccacggcaggcaccgccaccgctgccagaggagtgggcttgggaaagaagtggtcacctcacttggagctttgctcagaagcatcctcgtcccctgcagccctcccacgggaacgactggataaaagtgagctggtacagaaagccaactcactgagcaggctgagcgctatgatgatatggctgtagtcacgaaggcagtcacagaacgaggcatgaatactccaacgaagagagaaatctgctctctgttgcctacaagaacatggttggtgcccgctgctttcctggcatgtcttctccagcattgagcagaaaacagaggaatgagaaacagcagcagatggggagagagtagcatgagaagatagaggcagaactgcaggacatctgcaatgacgttctggagctgttggacaaatatcttgttctcaattctatacaaccattttctatttgaaaatgaaaggagattattttaggtatttttctgaagtggcatctggagacaacaaacaaaccactgtgtggaattcccagcaggcttaccaggaagcatttgaaattagtaagaaagaagaaatgcagcctacacatccagtttgacttggtctggcacttaatttctcagtcttttactatgagattctaaactctactgaaaaggcctgcagcctggcaaaaacagtatttgatgaagcaattactgaattggatacactgaatgaagagtcttataaagacagcactctgatcatgcaattacttgggacagtgttactctgtggacatcggaaaaccaggaagatgaaggagatgctggggagggagagaagtaatgtttcttgtgctttgtaatctgttcaatgtcactctgtaccctccacgtatatcccttgtgtggtaaaaaataattgtatgttgactttggatttttcacagcctcagcctagcaaaaatggttcatgggataaacagctggtgtttgtattctaaaactcagattggtcacataaatgccacggcattctgaagttttgattttgattaacattgacaggattactgtgtgtttaattttttttaattcaacactgtgattatggggttttgtaatttagcaaaactcttacttgtagaaaaaatagacctgaattatgtgtaactttttggaaagtttaatctgataccagaatcattgaaatacaattccattgtaaagttgtacagaaggttatagagattatattatgatgctagaacctggagtgagacacacatcatttggcatttgagtttaatggtaattcatagtaatgctgcctgttgtttggcacttaaagacacttgacctgtttgggctgttgccactcaaaagttcatgaccacagatgtccacagtgtcttcctctgaagaaactcgaatcctgaaatttaaattctttgtggcagataactggcttatgacaccttgaaaagtccaagtgctcatataacacacctgactaaatccccttttctactgcagtgtgttcactttgttaccaatttgcaacttgtgcttcaataatggaatctattttcattgttaacactgagctaaagaaaagccgtgtgttttatgaatgaccttatctgtttcctggataatacctttaagaataatcttctgagtcaggcatggtggtgtaggcatatagtcccaactacttgggaggccgaggcaggaggatcgcctgagcgtaggagtttaaggctgcagtgccctgtggttgcacctgtgaaataaccgcactccagcctggacaacgtagggagacctcatctccaaaaaaaaaaaaaaatagaatgatgttctgtagagattgcctttcacttgaggagtactgaatttcctggcttggggcttttaaattttgaaatcaaaacattctttcccaccatccttttttttttttgagatggagtcttgctgtgttgtcaggctggagtgcagtggcatgatctcggctcactgcaacctccgcctcccgggttccagcgattctcctgtctcagcctcccaagtagctgggactacaggcacgcaccaccacgcccagctaatttttgtatttttagtagagatgggttttcaccatgttgatctcgatctctggacctcatgatccacccgccttggcctcccaaagtgctggaattgcaggtgtgagccactgcgcccggccccccatcatcctttttgactgttgactttggttttcccttccctcctctctaaatttctgtccttctgcttccttcctttttttgctttttgaattctatctttacctgtcttttgttcactttttaatgctgtatatgggcaggggtgagagacattagtgagcaacttggtgagcaagcctggctttaaagacttgagaagaacttctagcaccagagctctgtcttcctccagttctcaacacggtgttgctctttagtcataccaggatctgaatcaaaaaagtatttttaaatatccctgacttctccctgtattgaggctggccctgatcatgctttttagtgcccctcaccaggtctcccaagtgcacttatccagctcaactctcagatgtgttttaacgagaccctatattcagggaagttgtgtggacactgcagtggagagaattgataataggcctatcagtctcacaatatcacccctctacctttaacattccatctagctgtagagtccatctgtttgtccatctgctgaaatgagaaaagaaaacctcatgcactgatttaaaacaaaccaaaaaaagaaaaaaaacaaaaatccctcctttctaactgaacaaaaatgtgcagttaatagttggcccttgaaaatgcagtagtgaatgtggagctaagcctgtttgtatatctggtagctcttttcttgctttgtttttccttaaccagtattctgcctaatgttttcttctgtgatggttatattgtctagcaagcacacctgtggttgtgaaaatagtatagcaaaaaagaaaaatcctgttactgatgtactaggtttgtgtatgtcttttaaacagttccagtttcaccttacacagaataatcaggaaaagtgtaaaacttcaaaagtgaaataaaaattttatcagttaaaaacaaaaaatacccaaatacaaaaaaaaaagatctaccaaaagcttcctgcctaatactgtaatttgaagatgagatgggcaacatggagcaatggaaaaggaggatgtatgctcactgaagcatgagctgggccaccactcctgttacaaaccaggaattatagcagattcctatactttgaggtttttttgtttcttttgtttttgttttttgcaatagcaaataggtgggatgccaggcacagtggctcatgcctgtaatcccagcactccaggaggctgaggaaggaggatagcttgagcctggaatttgagaccagcctgagcaacatagtgagactacctctctactagaaaaaaaattttaatggttacagaaacgatctaatgttttttcttccttgtgttaaggtgttttagtaaagttttctcaaattatattgcattttacattttttctaatcctttgaatttgttgtgagagaccaaaattataaatcagttttcccctccctgccaaaaatggaaaccaaagcaagtccaggagattgaattatggtaattatggtagtattctttgttaaagaatttggatgttcccttgggaacagaaatttttttttcttttttttttttattatactttaagttttagggtacatgtgcataacatgcaggttagttacatatgtatacatgtgccatgttgttgtgctgcacctactaactcgtcatttaacattaggtatatctcctaatgctatccctccccccaccccacaacaggtcccgatgtgtgatgttccccttcctgtgtccatgtgttctcattgttcagttcccacctatgagtgagaacatgcagtgtttggtttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacagtgctgcaataaacatatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtcttttggctgcataagaaatttttaaagaatttaactgccgaaggggcttagccctgaattatggtggctggttgggcagaattgtttgaatgaagtgaagcagtgatagtgttgatgatgcaggattttcttctcagtcactctgcaagccagggacctctgacgagcgacaccctgcctgggcctccctcagccatgctacctgctgccagagacagccctcccattcggcccacttgggccgagtctggcttacccgctggttcccgagttcttgtcctgtgcccacaaagaatggggatgcactgacaatcaagagtgagcaagacagggagttttattgactgatgaaagagctttcactggagaggggatgcaggggtggttcccctacccaaaggtgggaaagtcccctctaagtggctgagtcctgcggcttcttacaggctcagaataggggaagggcaggccataggtagtattggaaaaggcaacatttgattggttaaaaggcattattgaggaagaatcaatgggaaagggtgggcaaacaggaatagaagttctcactctaggtcaggggtttcatccgggaccagcagtccaatctttcagccttcaggctgtttttggcttgaaggtggcgtttcaccggggacccaccccatctgcctcagcatttggctgcctcctgttgctgttaatgaaatccataattttaaatattttactctattaatgacttttcagcactgtttccaaccacatgccttcaaagcagtagagcttcagcagttcatttttctgattttcaggtagagatattgatgagttctttcatttggtttaataccaccataccatttattttggagagcgctcatatatttataaacaattttaataattaccttcttctacattgcagcagaagacaagagaagggaagtttccaaaaaagcacattctaaggacttctaaccatctgaggccttttctctaggactcctagaagataaccaattctgttgatttcaggagatcattcagcaacagtttgccacccttaacatttagtatttaggctgcataataaggattatagagacctttccttcagaaaataggttattaaactaataaatatagtgataactgttaagagagagcagattctagttgttgtgctgacgttttgggaattatggttaatggaggaaagatcattggcaaagattaggtttcaccataatttaatggtagagagaagatgggatctgatgttcgagagcattaaacttttttgttagtttagaatggcttagagtttgttgacagagtttgttgatggttttggtaaaaagcaggatcatctaacaggtaattagaagacccaggtaattcacaaggcccttcaggaagtttgcttcccagctactcgggaggctgaggcaggagaatcgcttgaactcaggaggcagaggttgcagtgagccgagatcatgcgactgcactccagcctgggtgacagagtgagactccatctcaaaaaaaaaaaaaaaaaaaaaaggcggcaattaaggttaaatatacttaacgtcctcacgtagtattttataatcaaacataattaaaagtcaaaatgccatttacacatttgctgatttgggacaataactgaagaacactgatagtcataaagaatacccaaacttatattagaaaggggacctttttgaagaaaatatccagaggatgtttatttgatctgaaatatgcatggaaatgatataatatactgattaggaagggacatttggaagagaatagtaaagaatctgggaataaacagtttatcagctgttgaattttttggatgtcattcttttttgttcatctgttctgtcctgttggtaaagggtgaagtagtaaaagtcttacagagggaagccttattaacctgtacattcgtttagggaaactgcccattctcagtcctctcactggcctctacagtgggcacttgtctccttcagcttagcagcgaagcctgatgttggacttggcctgcaccaaatgtttttccttagtggaaattattgtgccatttgttggttatttaggaataattgtaattggtagggacatagcctctgtctcattgagaaaataactaattgtagctaattgtttgggctatgaatagggaaactgggtttaacatggattaatagtaatctcttgtagggcaagtatttctgaatcaactcagatttttacattatttctcatgaaactggtaacataatttttttctttcctcacattttgaaagtgtcggttcatattgcccccttttctgaaggttcctgtgagacaaatagaaggaacttgggaagtaagcaagtgttttttgcctctgtttcctgcaggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagtaagtgactcattaaagacttaaaatttttggattgaattgtagccatggcagagtgttctatatgttccctggatgttgtgggcatagtaggagttcagaaaattataggcatctttaaacatttgaatgtaattttttatacctttgtttacagtggagcctatgtttggcatttggtcttagattgggaggggtataatatttagaccattttgtttgcaccttgtattagttcgttttcacgctgctgataaagacatatccgagacttgagagaaaaagaggtttaattggacttacagttccacatggctggggagacctcagaatcatggtgggaggcaaaaggcactcctttttttttttttttttttgagagtttcactcttgcgctcaggctggagtgaagtggtgcaatcttggctcactgcaacctccaccctccaggttcaagcgattctcctgactcagcctcctgagtagctgggattacaggtgcctgccaccatgcttggctaatttttgtattttttagtagagacggggtatcaccatgttggccaggctcgtcccgaactcctgatctcaggtgatccacccaccttggcctcccaaagtgttgggattacaggagtgagccactgtgcccagccaaaaggcacttcttacatggtggtggcaagaggaaatgaggaggaagcaaaagctggaacccctgataaacccatcagatcttgtgagacttactatcacgagaatagaaagaccggctcccatgattcaattaccacccctgcgtgccatccctccccaccccctgctacacacacacacacacgcacacaggtccctttctgtgagatacaattcaagttgagatttgggtggggacacagccaaaccttatcacacctttgccctaggaaatgttttaggcaaaggatgttttaacccaaaggaggactgtttgagtgcttgatgttgccagttactaggaaataagtttagagagttctaagccatgataaagatctgcacatcttaggagcagacttaaaaggacagtactattttattgtttccaaaggttgtgtgagccattttttaaaagtatgttcagggaactttctcaataatccagagatacttggttggctaaagagctacatataaacatagcatatgcaaccttcagctctttaagctttctcataacagacagctatgccttggacagtccgtgtgtaagtcagccctatggctttgcttaatgatgataaagtggaagcatcagcataattgaagtgccaatttcacgctccattttcatccccatgagggagaatttattccagtaaatgtgtgtttttgatggaatagtaaagaattcttagaaggttgagggctttgtggaaagtgatttgtatgtacccattagccttacaaagtggttctagattgtaaaatgagcctcgaagtagccaatttttagaattcaggaaagtgacaccaatacaactcagagcctacaaccagcacctgcgtgtgatactttgtgattagaatgcagacatttgggcctctatgcattgaatcctcttcatagactgaggaaagttactctcctatggcaggtgcccatttgttgggaagaaaaacctcttatgattttctatgtaaaggaaccttctgctggaaagtatcttgtctgatggcttagtttgcagtatcatttgtcgctgacaggtgacaagcttgttactgtcactgaaagtgctgtcacctcaggatatctccatcattactctatttcactcagcatagtagatcacatcttttcctctacctttgaccagggtgttatttgaaacattattctcatccatgagttgtttaaacatggttgttagcctgtcttttcctgtgaagtgttgtaggtgtctgacaagtggataattatgtacagttattaatgcttggactgttctgttttcaggccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaaggtatttcttcattttacgttccaagattttttaacttgggttgtagaggcactgaccttgcaaaccacaaaccaagagagtttctttgtagtatggattaagattctttatcttcccaaaaaacactaaatgagatgtagggttttgcaccatctttttacctacagagtactgaggattggtctgagcaggggaagagaagtgggctggtggctgcagttctctgcccacaggcagcattaagatgagtgtaactcttctgtgcctgggtggatcaggaggtacgatcagatttccattggttctttgaggtcataccacctaaattgagatcactgattgtgccacctccattttttatctgttaattttcttagagttatataactttagaccagttttcccacatcaaagtatcaggctgccctttcaagccctcttgaatgaaagttgtctcaagcttaatgctgttgtacagaggaaaatctagtaagcgaagtttggctactgctgtctcttgggtcatggagaacatggttttagggataatagcagccacccttgggatatctgatccagctgtagctggagcctggtcaggtcatgtgctgatcttgcctatctcctctcactgtgggggaatggccaaaccatgtgcctcagaagtggtacaaccacatgaatggctggatataaaccagagacccaagagaggactctttttctgtacaatctcttgcttgagtggcatggcttaggaaaagaaagtgtaggtcaaactcctgagccagatcctgcaatgtaatgctttccctgttgagtaagcctttataatatgcagcttaaaagccacatataatgaggtattcattccaaaggttggcaggtcatgagttagggttcttagatcccatctaggttacaaattgtctattttatgcctgggcctaaatcaaagccattctaaactattcaaacttttctcccctcccagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataatttttctctcctttattggactttaggaaagatccatgaaaccttagtaagcccaacttctcatttagcaaaaaaggcataaaatccatcttaagttgaaatttagtattattctacagcatataaagtgaattaacatggggatataccaaatagaaatctaaattttgaaatatttgaaattgaagcatttgagtaacttatctgtgaaaggtccaaggagatgctctcctaccaaccctactaaatttgtttcctttctaggcctcactgaaccataagtgttttcatcaaaaaggagcagagtggcaggtccaaactatatacctgataactttaggattaaagggaaagatagtgtaccattgcctccctgcttttattgtcatttaaagtttcgtcttcatggtgagtgattctgtagccaagtttgtgaccacccaatgaactatatagctgctgtatgtcctgcagagctcatccagaatagaatgttcttgatcaaaatgagagtgctagaaagctcatgaggctacaaggctacaaagaaaagtatattccaatttgggatgttattaagataattaggcagcccactctactcccaagagaagaatgaccaatttaatctgttgtcaccaagcggtttacagcttaaggccttttctgtaaaaattaaaatgcactcaaagaataaaaaacagcaaggtcaaatcaaggttttatctagtgttaggaacatttagattactctctgtgtgtgtgtgtatatatatacacttttatttttacattgtagagatagcatgtaaatgaacataggtattaagccatagagaagaattactatgcacctgatgaaaagaatcaggatttgtgtaacacagtaaacacattcttgtggaccagatggcaattacgtatacatacaaggcaagtactgagaagtaccaaaaacatctttgatgccgtcactttaaaaaaaaaaaaaaaaaagtgtcatctatcatctggatactaaatcaaagctaaggccaggcacagtggctcacccctgtaatctcagcactttgggagttcaaaaccagcttggatgacatggcaaaaccccatctctacaaaaagatacaaaaattaggcaggcatggaggcacacgcatgtggtcccacctactctggaggctgaagtgggaggctcacctgagctcgggaggtcaaggttgcagtgagccatgattgtgccactgcactccagcctgggtgacagaatgagaccctcccaaaaaagaaaaaaaaaaaagctggaaggctatactaaataggtcactctttcctctatttttccaacttttagaaattcaaatttattcaaaagtttgacatatacaattccataactactatttcatcttcaatctacagaattagctttaagcaactttaaagcttgagctccttctgaatttcccaaagtgtttctgcactcttttgcaagcaggcctcctcttcaagagtcagttttacttttatgaggtctgtgataccattctctcccaggatacatgggacactaaggaatatgtcttcatttattccatagaggccctgaaagtaaagacttaaaaattattccttttttaacaaagttctgcaatatgagaaacaacagttgggaggtgaatgaataacagattggtatagtacgaactatggcagagtaccaaggcagagaacttttttcttttttttttgagacggactcttgctctgtcgtccaggctggagtgcagtggcacgatctcggctcactgcaagctccgcctcccgggttcacgccattctcccacctcagcctcccaagtagctgggactacaggcacacaccaccacgcccggccgacagaaaacaatttaaaacatgattagacatatttattgttcagtttcaacccaccatctctccatataggccccagcctcctgccatgtttgctggggct

SEQ ID NO: 17123 - DNA, 42954 bp, Human
  misc_feature (1)...(42954): n = A,T,C or G
agtgagtacctactatgctttggtaaatgttgcaatgtacaagaataaataaagacaaattttggttctaaagttactgcaatcaagtaagcaaaatgttaagtaagtttggagtatttgggcaggcatggatgaagagccagttctagtcatctagcatcagtttggccactaccaagctgataccttccttggccgccaggggcctgaggcaggtgtagagcttaaatttccagtccatccaggccagcaatctccctctcagcccggggataaatgaggttgctgtggaggtataggaccaagtggttgctgctcctgtctgctataggaggcctctagcttcaggctagttgctggttgagaaaagtgccataagagagagatatacaggaaatgatggtagttgacatttgtcaaggaaagccagagtatgtatgtgcaaagctgaaaatgaggaattaaccttgagaagggctggggaaagagctttcttggtttaaagaacagcaaaaagtcctgatccaaaaaagctgtccaaagcctagttggaaggaagtgtattgagtgtcctgagatgatatgggaagtgggggtaggaggccaaatcttgaagatctaggttgtggtaaaagtgggttactctacctgtaatggaaagccacggaagagtttaaagcagggttattgcataatctgaaccatattgaaaacaaatactgactgggtgcggtggttcacgcttgtaatcccagcactttgggaggccgaggtgggtggatcacttgaggtcaagagttcgagaccagcctggccagcaaggtgaaatacaaaaaaatacaaaaaaatttgcccggcggctgggcacggtggctcagcacggtggctcacgcctgtaatcccaacactttgggagggcggatcactaggtcaggagttggagaccattctgaccaacatggtgaaaccccatctctactaaaaatacaaaaattagccgggcgtggtggcgcacgcctgtagtcccagttacttgggaggctgaggcaggagaattgcttgaacccaggcggcggaggttgcagtgaactgagattgtgccactgcactccagcctgggcgacagagtgagactctgtctcaaaaacaacaacaataacaacactacaggctattataagaaaaataaattatattttggattttgaaaaaggttcaaatgcaaatactctacaaaagatggagtaggttgtgtccccttctgtgagatatatatctctctcacaaaaaaaaaaatatatatgtaaattttttttgagatggagtttctctcttgttgcccagtctggagtgcagtggcgcgatcttggctcactgcaacctccgcctcctgggttcaagcgattctcctgcctcagcctcccaagtagctgggactacaggcatgcaccaccatgcccgactaattttatatttttagtagagacggggtttcgccatgttggccaggctgttctcaaactcctgacctcaggtgatccacctgcctcggactcccaaagtgctgggattacaggtgtgagccaccgcgtccggccatgagttataaatattaacaatttcttgctgtaaattgaaagcatccttcgcgtctttgcgtttcattaccaccctctgttctctcaagagaaattctaactttatttcagcactcagtcctgaagttacagaagttaataattttttaaaatcctgcaaacaatgcatggatatccccgtcttgcacactctttgggccagtctagaattcttcccatcagcatttcggtgatctggaccgccgccacccacacagcgctccagggcagaaaagacgccccatgcccgcgcctgggccggcggggggcggagcttgcgtgctgacgcataagagccgagcgggggaacgtgcgtgtctcgagtcgcacggagggcaaccgtcgacgggcttagcgcctcaactgtcgttggtgtatttttctggtgtcacttctgtgccttccttcaaaggtggtgctttgtccctgtgggtcatctgtactgattgcgccaagcaaagcatttgtgagcgtgtggtgctggggtgaaagtggtggctgggggcagggagaaatccaaaagcccgctggtgccccagccctcccattgcctggtagactgggccttgctttaccctccccgcatcctttgaccaggaaattctttctttggcttccccccatccccggctccaacattctgcaaactgaagaggtagtttcttagatgttcagtgtggttaatccaatgaaattgcattatccctatcaggttctccaaatgtcaactgtcaaggagcagctaattgagaagctaattgaggatgatgaaaactcccagtgtaaaattactattgttggaactggtgccgtaggcatggcttgtgctattagtatcttactgaaggtgagtgagaagcccatcctgtggctgaaaatcaagtgagcacttcagagtgttgtatatgtcgatgtattcagggttgcaaggttaatcccttgaaagcaattatgtatcctttgacctttcctccctccctccctccctcccttccttccttccttccttcctttttctttctctctttcttttcctttttttttaaacttcttctttcttttcctttctttttttttctgactttccttttctttttctttttttgagacaggatttgtctgttacccaggttggagtgcagtggcgcgatcttggcccactgcaacctccatctcccgggatcaagcgattctcctgcctcagcctcttgaataactggggccacaggcatgcaccaccaggcctggctaattttttatatttttagtagagatggggtttctccatgttggccaggctggtttcgaactcctgacctcaagtgatccgcctgcctcggcctcccagagtactgggattacaggcatgagccaccacacctggctgccaataggtattgtttttaacccttgtgccctcctccctctctgcttttggagtccccagtgtttattgttctctctttttttttttttttttttttgagacggagtctcgctctgttgccaggctggagtgcagcggcaggatctcggctcccggcaacctttgcctcccgggttcaagcagttctcctgcctcagcctcctgagtagctgggactacaggcatgtgccaccacgcccagctaatttttatatttttagtagagacggggtttcatcatgttggccaggatggccttgatttcttgacctcgtgatccgcctgcctcagcctcccaaagtgctgggattacaggcatgagccaccacgcctggccttaagtagggacttttacttctttcccttactgttcgcttttggaatctggctattgaaatctgaatgaatacactccttgtatatagttccgtactctgtcacatgtgacaaaaacccagtttaaattagggtaagcagaaaaagacgaaatattgttcatgtaactggaaatagggcaaaactgcttcaggtactaccggattctgaagttcacacatatcaagacatagtctttgtatatcttggtttagattttctctgttggcttaattcgtagagcctttctatgtggtggtaaagatggctgtacagtttgttcttagattcttgttttttctccaactctacagtccttactaatgttcttagatttgcatgttattcttagagcttatgattccaaagaaaagtgagatgtaatcttccgtcttccattttcaaacttcatagacatgcttgtttcttatacctgggccatatgtccacttatgaactgatttctgtgaccagaaggaaaggatggaacaattggctaggtctggttttatgcccatctaccctaagcttggaaaaccaatgttaattgtactgcactgaaacatatggaatgggttcccatggaaaagagaaattctattaccagaaaaagggacactagacagatgaaaacaataagtgttcatcagaggtggttaccttcctgtttgggccataacgacgcatactaaaagcagctttagccaactcagaaattagggttaaggttaaatataataaaatcctggccgggcgcagtggctcaggcctgtaatcccaggactttgcgaggctgaggtgggtagatcacttgaggttaggagtttgagaccagcctgaccaatatggtgaaaccccgtctgtactaaaaatacaaaaattagccggacatggtggcgggcgcctgtaatcccagctactcgggaggctgaagcacgaaaattgcttgaacctgggagacggaggttgcagtgcccgagattgtgccactgcactccagcctgggcgacagagtgagacttcatctcaaacaaaacaaaacaaaaaacacaaaaataaaggctaaatataataaaagcctttgaaatcattttattttccttggtttcaaactgttatctgaatggcaaaaaaaaacaaaaacaaaaaacacccagctctaaaaagttctaacaattatatgaagtcaaacaatttttgctacatcttaatatttacttaccttgactttcggtcacccaggctcattgaaaaactatttttatatcatttttccctattaaaatatgagattcctttaattatcaagtagccacatgaaaattcttcttattctcctaaaacttaagtaggaacattttattcagaacttttgtatattttaggatttggctgatgaacttgcccttgttgatgttgcattggacaaactgaagggagaaatgatggatcttcagcatggcagtcttttctttagtacttcaaagattacttctggaaaaggttaattttagttttataaagttattttcaaagctttttaaaaaagtaataaattttaccaaacagatgtcaataaatataaaattaaaaatagcaccatgccattgggccatataatttaatttagttgatcaattttttttgttttttgagagagtctcactctgtcacccagattagagtgcagtggcgcgatcttggctcactgcaacctccacctcccagcttcaagtgattctcctgcctcggtctcctgtgtagctgggattacaggcatgcgccaccacgcctggctaatttttgtatttttaatagagacgtagttttgccatgttggccaggctggtctcgaactcctgacctcaggtgattgggccatatagtttatttttatttatttatttattttgagatggagtctcgctctgttgcccaggctggagtgcagtggcacaatctcagctcactgcaacctccgccacctgggttcaagcaattttcttgcctcagtctcctgaatagctgggattacaggcatgcgctaccacaccccgctgatttttgtatttttagtagagatggggtttcactatatgttggccaggctggtctcgaactcctgacttcaggtgatccacttgcctcggccttccaaagtgctggaattacaggtgtgagctgcggtgcccagccgggccatataatttaaaaagttaatttttttaaaaagaacacttcgatataattggagcatatttggaaaacagaaagtataaagaaaaattgaatctcttctattaatgactttatgtaggttttctaagcttttgttttctttacataactgatgtataaatgcttttaagcttgtcattttgtcttatatattttcccaagaatatacaatcttgaagagtttctgtaatattattaatacatttatccatattctttagttttctttctatgtttatagtgaaccaggtttcaaggcatagcatgaggccatagaacataagaaatttagaacttggcctcattggtgttagcatcatctgttgaccaactaagaagcctcagataattaggaaacataattattttatcatacactaaagtatatggtgcactgtttggtaatgtgattcaacagatatactttctactagaagccctcttatctaacatgattgagattgaaggcagttacctaatttaaacatgcttcttagaaagagccatgataaacattttatatcgacctaaaacatacacatgtagataaaagttcatttgctgattttctggttgtagggcaaggcctttgagtacggctcagctgattagagttttgcagtgccttcccatcccttcccccttcccttccatcttccccttcccttccttttccctttccccttccttccccctttcccttctccgttcatttcattcctcctttcctcctcttcccctttccccctctgatcctctcccctctactcacctcccctaccctccccagccctccatcctttcctttcctctcctctccatgttgcccagattggagtggctatttatttacttatttatttttgagacagagtcttgatctgttgcccaggctggagtgtggtggtacaatctcagctcaccacaacctccacctccgaggttcaaacgattctcctgcctcagcctcccaagtagctgggactataggtgtgtgccaccatgcctggctaatttttgtgtttttagcagacacagggtttcaccacgttagccaggctggtcttgaactcctgacctcaggtgacccgcctgccttggcctcccaaagtgctgggattacaggcgtgagccaccgcacccggcctggagtggcaatttataggcatggtcttagcacactacagtcttgaactcctgggctgaaggggtcctcctgcctcagcctggcaagtacctggaacaacaggtggtgtctttctgaaagcacatcaataatgatcatttagattgctttaaagtactacaagaaatttaaaagtgttcatgaagcagtctggttataaaaccttactaaattttatgactttatttattttatttttggagacagtttcaccaggctggagtgcagtggcataatcatggttcactgcagcctcgaattcccaggctcaggtgatcctcccacctcacccttctgtgtagctgggactataggtgcacagcaccacacccagctaatttttaagaaattattatttgtagagatgcggtgtcactctgttgctcaggctggtctcaaactcctaggctcaagcagttgcaggtgtgagccaccacgcccaacccatttttatccctttctcaaacctagaaggacaatttttaaacaatttgcttttaatgtcttcccagggattaacttacttttcatagaaacaattatttttaatattaattatggaatacttgatagagaaaaagagattaacaataatgtaacattgggaggctgatgtaggagggtcgcatgaggccaggagtttgaaatcagccagaggcaacatagtgagaccctgtctccattgtgcctgtagccctagctttgcgaggctgatgcaggaggattgcttgagttcaaggttgcagtgagctatgattgtatcactgcactccagcctgggcacaaaggaagatcctattgctaaaatatatataataatataacaaacatcagtgcatctaccactcagcaaaagaaataaaacattaccaagtcagttgatacattctgtatattcatatcttcctgtccctaaatctcaatgttgaatgtggtgtttacctttaccaaacatttctttcacactggtatttagtgacttatattatctttaattatatatataataataaatacataattatatttgggtacaaatatgactaattcttgatatgtagcaactaatgagcagaagtacatagacatactagatagtagtttactagttgagagtgtttagtatgtctggggtatcagtatgttttgtatcagttaatttggtggattggttaaatggagtcaaattaaaagagtattactattttattttattttattttttgagatggagtcttgctctgtcacccaggctggagtgcagtggtgtgatctctgctcactgcaacctccacctcccaggttcaagagattctcctgcctcagcctcccaagcagctgggattacaggtgcataccaccatgcccagctaattgtatttttagtagagacggggtttcaccatgttggccaggctggtctcgaatgcctgacctcaagcgatccacctgcctcggcctcccaaagtgctgggattataggtgtgagccaccgcacctggccatattttaaaatacttgaaaacatattcaactttcaatttctaataatatggcaggataaatacctggattaatcttttgctgtaaatgagaaaactcctgcataaaatatgaaataaaaaaatcaatccttgagaaagaatatgttcttaacaaaaaagtaaggcattttcacaacaggtactgaatgaagtgagaaaaccagagagttaagcagagcactgcagctctgattgctctttttaccctgatagcatttgccaaacatggtggacatcaattttggttttcactgactcataaaatttaggagaccagagacagagcttggggatttggggagatcaccccacaaacctggtgccctagtggactaagccaggggttactaaactttttctgggaagactcagatagtagatattttaggcttttccagctatgtagttcctattatacctactcaactctgctcttacagtgcaaaaggaagccacagacaataatacataagcaagtgggtgtggctccagtgagactctatttaccaaacacaggtggtagaccagatatcgcttgtctgccaacagtagtttaccattgccagaactataccgttaatgtaatgatgatctacaaataattattctctccctgcctttggggactacaagtaaaattgaatgtcttagacactttagtgggggaatatacctgctaaggatttggaaccacaagctggctcttatttgaattccagaaaaccttaagcaatcagatggtagctagaggaaactcactttatttcaggcctcaaagaacttccacaaataaacttccagagaaaatgaacatctcacaatagaaataattaaatctgcaagaaaaggcatgagcaagaaccagcataacagaaacatgccactatagatttaaaaattatcaaacacaaattataaaattaatatgattattctacataaaaaataaagaacagacttgaaaatatcagcatgagacaggaggctataaaaacattaaaaaaggaacaaaatataacttataaatgtgaaaaactcaatggagccaggcatagtggctcagtcctataatcccagcactttgggaaggtgaggcaggtggattggttgaggtcaggagttggagatcagcttggccaacatggtgaaaacctgtctctactaaaaatacaaaaattagctgggtgtggtggtgcatgcctgtagtctcagctactcaggaggctgaggcaagagaatcacttgaaccaggaggcagaggttgcagtgaactgagatggcaccactccacactccagcctgggcgacaaagtgagactccgtcttaaaacaacaacaacaacaacaacaacctctatggatacaatgatagattagacacatttgaagagagaagtggcaaatctaaggcaattacccagaagacaagaagtagaaaatataacaggttaagagtcatggaggatagaataatcacatttgaagagattatgattcagcatttttgaagaccactgaaaaatatcaacccacagatttaagaagccaaataatctcaagaagaataaatataatatccctacctggacatattcttgtgaaattagagaacactaaaggcaaaaagaagttcttaaaaattgtcagagagaacataaattacctacagaaaagggagagggtgacaatagcagcagtgaaaccagaagacaatggaatatttttaatgtgctgagggaggagtaagtgtcaatctggaatctacccagcaaaaacatctttcaagaacaaggacaaagctgggcctggtagcaggctgaggcagaaggatcactttgagaccagcctgggcagcatagtgaaatcttgtctcttaaaaaaaaaaaaaaaaaaaaaaaggagagtgaatgaaggtgttttcagaaacagactgagacaattactgtcaggccctccctaaaggaaacacaaaagtatatatatcaggcaaaagaaaagtgatctcacatacaagatctgtgatgcaagacaaaaaatgaaggacagagaaaatggtaaatatgaaggcaaatctaaataaacatcaattgtataaaactgtagtcttgggggattaaaaaatttttgaatatagcatataaatatacgggcgaggggtgatagtgatgaatgaagtagtgttctaagtttcctgtgtcattagggaagcaggaagtgtggtgattaactttgaactttgataagttaaaaatgcacgttgtaatttctttttctttttcaaatttttatattttatttttattttgagacaaagtctcacactgtcacccaggctgggtgcagtggtgtgatctcagctctctgcaccctccacctcccaggttcaagtgattctcctgcctcagcctctcgagtagctgaaattacaggcacacaccactgagcctggctaattttttgtatttttagaagacatggggtttcaccatgttggccaggctggtctctaactgcctgacctcgaggtggtctggcgtcgttcggcttccgcaaagtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatacaaaaattagttgggcgtgctgatgcatgcctataatcccagctactcaggaacctgaggcaggagaatcgctttaacctgggagacggaggtggcagtgagcagagatcatgccattacactccagcctgggtgacaagagcaaaactccatctcaaaacaaacaaaaaacacagagatgggatctcgctatgttgcccaggctggtctcaaactcctgggcccaaatgatcctcctgcctcactcagctgggattacagatgacatgatctaacttctgtgacagctaacaaaagaacagaaacctttaaattcttaaaggtgtctgggcatggtggctcatgcctgtagtctcagcactttgggaggccaacgcgggcgaatcatttgaggtcaggagttcaagactagcctggccaacatggtgaaaccctgtctctactaaaactacaaaaattagctgcatgtggtggtgcacacctgtagtcccagctactcaggaggctgaggcaggagaatcacttcaacccggcaggtggaggttgcagtgagccaagatcactgccactatactccagcctaagcgatggagcaagactgatccaaaaaaacaaaaaaattagtaaagagaaagaagtaatattagataaacatacctaatgaattaaaaagaagatagaaatataagaataggacagcatataaaactaaaagtttagcaaggatgacagacaaagttagtaatcagaataggccgggcacgatggcccatgcctgtaatcccagcactctgggaggctgaggtggtggatcacttaaggccaggagttcgagatcagcctgggcaacatggtgagacccctgtctctactaaaaatacaaaaattagccaggcgtaatggtgcacacctgtaatccagctacttggtacgctgaggtaggagaatcacttgaacccggaggtggaagttgcagtgagccgagattgtggcagtgcactccagcctgggcaacagagcaagactccatctcaaaaaaaaaaaaaaatccattgtatttctgcatgccaaaaccaggcaaaagaaatctaaagctattatttacaatatcataaaaataggaaatacctggcataagagcttttgtgcagaaaacataccacctcattagaagatgttaaatgtcaggctgggtgtggtgcctgtaatcctagcactttgggaagccgaggcgggagtatcgcttgagtggaggagtttaagaccagcctgggaaacacggtgaaaccatgtctttaccaaaaatacaaaaattagctgggcgtgttgatgggtgcctgagtcccagctactcaagaggctgaggtggaaggatggcttgagcctgggaggtagaagtcacagtgagctgaggttgcgccattgcactccagcctgggtgacatgtctcaaaaaaaccaaaaccaaaaaaaagaaaacaacaaaaaactcaaagaatatattatctaaataaatgaggggaggctgggcgcagtagctcatgcctgtaatcccagcactttgcgaggccgagtcaagtggatcccttgaggtcaggagttcgagaccagcctggccaacatggtgaaaccctgtctctgctaaaaatacaaaaaattagccaggcgtgatggcacacacctgtagtcccagctactcaagagtaaaataaataaatgaagtgatattccttgttcatagaagtctcaatattgtaagctatccattcttcccatattgattatatgcaatcctagtcaaaaccccgcaggttttgttattattggacattccaagctaattcaagacttattataaagcactaattatgtgcagagacttaattaggagacaatataaaagattgttatataacactgatgattttctagataaataggaaatttatggacctttagaattgttcttatggcagtagttatcattatggaaaaaataaattgataccacacacacaccctacctgataccacacacaaaaatcaaagccaggttggttgaagactaaaatgtgaaaagcaaaacttcaaaatttcctttagaagataacgtagaatatccttatgacctgaaggtagggactgatttaaacacaaagacacaaaaagcataatcaataaagaatacaaagttaagagtgttcacaaaaatataatataaaagagcaaagagacaagccataaactgagagaagatatttgcagtgttaacatctaacaaaggaatagtgttcagaataaaaatacttgtattaatataatacctaaaaaaaatgcacagctcaatagaaaaatgagaaaagccttcaataatttacaaaagaagacactcaagtggcttataaatagggggagaaaactcaataaccaagcacaggaaaataaaaaccatatcaatataccattacacacccactagattggtagaagtgtgatagtaagtgtttgtgaggatgtggaacaataagtgctctcacacacagcatataggagtgtagtaaaaccagttaaaaaaacaagtttggccgggtgcggtggctcacgcctgtaatccagcactttgggaggctgaggtgggcggatcacgaggtcaggagtttgagaccagcctgaccaacatggtgaaaccctgtctctactaaaaatacaaaaattagccgggcatggtggtgcgcgcctgtaatcccagctactcaggagtctgaggcaggggaatcgcttgaacccaggaggtggaggttgcagtgagcctagatcgcgccactgcactccagcctgggccatggaatgaaactctgtctcaaaaaaaaacaaaaaaaccccacgagtttgtcattacctggtgaagttgaacatgaacatatcccacaacctggaaattacacttctaaatatagtcccaagaaaacttttgcacatgcgcactaggatacatgtacaagaacgtattgtagtagccccaaactgtaaacaagtcaatgaatcccagtactaaattgtaaaattatgcagtgtaatattgcacagcagtgaaaatgaagaaactacaggaacacacattaacatggataaatatcagatacataatatttagttaagggaatacatgccttatgattcaaaaacagataaaatgtactatgtaatgctgggcatggtggctgacgcctgtaatcctagcactttgggaggccgaggtgggcggatcacttgaggtcaggagttccagaccagcctggccaccatggcgaaaccctgtctctactaaaaatacaaaaattagctgggtgtggtggcacgtgcctgtaattccagctactcgggaggctgaggcaggagaatcgcttgaacctgggaggcggaagttgcagtcagctgagatcgtgccactgtactccagcctgggtgatagagccatctcaaaacaaaacaaaacaaataaaaaaacaattaatatgtaatttaaacatgcataggtagtaaagcttttttaaaagtaatgtgattttttgccagccacaagagtggttgatagacataatctgttagaggcatgcaggggcttccaaggtgttgacaatgttctataaatttggggatttttttttttgttttgaaaaagggtcttgctttgttgcccaggctagagttcaggggtgtgatcatagctcaccacaacctcaaactcttgaattcctgagttcaagcagtcctcccacctcagcctccagaggacaaatgtgaactagatgtttattgtgcagttttggcagagttaatatttttaatttttttcattaaaaaattattatattttagagactaggtcttgccctgttaacccaggctggagtgcagtggcacgatctcagctcactgcaatctctgcctcccaggttcaagtgattgtcgtgcctcagcctccccagtagctgggattacaggtgtgagccactgtgcttggccttttgtgtggttttaacagagttgtttaatgttttataaattgagtgtatatttcttatatgttattgtatatgaaatatttcacaatagaacattttaaaaatacattttgtgccaggcgtggtggctcacgcctgtaatcccagtactttgggaggctgaggtgggtggatcacaaggtcaggagatcaagaccatcctggctaacgcggtgaaaccccttctctactaaaaataaaaaaaaattagccaggcgtgttggcaggcgcctgtagtcccagctactcaggagggctgaggcaggagaatggcatgaacccaggaggcggagcttgcagtgagccgagatcgcgccactgcactccagcctgggcaacagagcgagactctgtctcagaaaaaaaaagaaaaaagaaaaaagaaaatacatattgtgaggtctaatggggaagagcaatgatggaacatcgttgattagccacaatttttttttttttttactttttagtttagagatggctgttcatgggcacaatcacagtgcactgcagcctctaactcctgggttcaagtgaccctcttgattcagcttcctaagtagctgggactactatgcccagctccacagatattttaaattatctcatatgtacagtgagtccaggtgcatggaacatagaggctgctaagatatttatggaccaggtgtggtggctcacgcctgtaatcccagcactttgggagcccgaggcaggtggatcacctgaggtcaggagttcaagaccaacctggccaacatggcaaaagcccgtttctactaaagatacaaaaattagctgggcatggtggcgggtccctgtaatcccagatacttgggaggctgaagcaggagaatcacttgaaccagggaggcataggttgcagtgagccaagatcacgccactccactccagcctgggcaacagagcaagactccgtctcaaaaaaaaaaaaaaaaaaagatatttgtggaaagaagggagtaatgtgaaatcagtgaaatcagaacctattattaatattatggtgcttatgattaagttaggggtttaaataagacataaccatgagaagataacatatgctcttataaggactttttcataattataggcagtaagtgctataaaaaaattctgtgaagaaagtggtatttatgaatgatatgataaataatgaatgatatgatggctttatgtcttatttttatgtcagattttccaggtgccctgatcctgttaatgccatcatttccttacctgttgtttatttttctttcaaaatacaaccacatatcatttatgaatgatatgataaatacttggggatatctagcagaggaattggtattcgaagaagtacttgactaatataataataatgttaattgctaacatttattgaacatttaatacaccctgttgagtacttaatgtatattaactcactgagttatcttcttaagaaccatattttttaaaaggctattagcggctgggcgtggtagctgatgcctataatcccagcactgtgggaggctgaggcgggtagatcatgaggtcaggagtacaagaccagcctggtcaagatggtgaaaccccgtctctactaaaaatacaaaaattagccgggcatggtggtgggctcctgtaatcccagctacttgggaggctgaggcgaggtattgcttgaacctgggaggcggaggttgcagtgagctgagattgcaccactgcactccagcttgggcgacagagcaagattgtgcctcaaaaaaacaaacaaacaaaaacaaaataacaacaaaaaaacgctattagcttgatcttgtagatgaggaagtgagagttagaggggtaggcaaagtaattgtccatggttacacagctagtaagtggcaaagttgggaatactggcagttagacctcagagcttttgctccagaccactgtagtttatggtctctttgtggttatatttacaaagaaaaataaataacaggtaaggaaatgatggcattaacaggatcagggcacctggaaaatctgacataaaaataagacataaagctagtaaagatgatttggagccagatttttttttttttttttgagatggagtctcgctctgtcactcaggccggaatgcagtggcacagtctcggctcactgcaacctccacctcctaggttcaagtgattttcctgctttaccctcctgagtaactgggattacagcacgtgccatcatgcccagctaatttttgtatttttagtagagatggggtttcaccatgttggctaggctggtcttgaactcctgacctcaagtgttccacccatctctacctcctaaagtgctgggattacaggtgtgagccactgtgcctggccagaaatgtcatctaattcctaagtttgcctttctagttaaaatctttattggggcaggaaaaacaacagtgttcatatttcataagttatcttctcttttggattagaaagatacaagaatcaccataaatgaagatgtgatattttaaaaattaggtagatttcattttcttttctttctttctctctcttttttttttttttttttttttgagacagagtctcactctgtcacacaggctggagtgcagtggcatgatctgggctcactgcaacctccgcctcctgggttcaagccattctcctgcctcagcctcctgagtagctgggattaagatgcaacgccaccatggctggctaatttttgtatttttagtagagacatgttggtcaggctggtcttgaactcctgacctcaagtgatccgccagcctcagcttccaaagtgttagaattacaggtgtgagccaccacgcccagctattagatttcattttctaaaagaacatgaaaagtcgagatgagatagatatagaggatattttaactaattttttacatccacatggtagataatcttcagctatatagtgctttttaaaaaagtccagtatgaagccacatgtggtagctcacgcctgtaatcccaacactttaggaggccaaggtaggtggatcagttgaggtcaggagttcaaaaccagcctggccaacatggtgaaaccccgtctctaccaaaaaataaaaatttagctgtgtgtgatggtgcatgcctgtagtcccagctactcaggaggctgatgtgggagaatctcttgaacctgagtggcagacgttgcagtgagctgagatggcaccaccatactccagcctgggcaacagagtgagacactatctcagaaaaaaaaaaaaaaagaagaccagtatgagttagtaagtgcttcatagtagtgacattgtattcaacaggtgaaacaactggtcatttagtacgtagtttattttcttgggtgggtcaagaacttgtttgtgatttcaaacccagtcccttacaatattagaagtaaatacattctcactcttagactcctgaaacagacacataaattctcagagttctaagtctattcattttggtcttttttttttttttttttttttttgagacagagtcttgccaggctggagtgcagtggcgcgatctttgctcacttcaacctccgcctcccaggttcaagcgattctcctgcctcagcctcccaagtagctgggactacaggcatgtgctgccactcccagctaatttttgtatttttagtagagacaggattttaccatgttggccaagatggtcttgatctcttgacctcgtgatccgcctgccttggcctcccaaagttctgggattacaggcgtgagccactgcgcctggcctcattttggtgtttctaagaaggcagagagctgactttcattgccttgggccttcataacacaggggaatttgggcaaaaggggatgttagtttctattgttataaaaatttttgaggtagctatgtgaaatttggcaagtcatagtgacaaggcttccttcagattataaaggttagaaaagtccgttcatctccaaaatgccagacataaaggtacatggatactttaatataatactaagaacatacaatagagttttaaggagttaaggcacagtggttatggtaatgttgatccaaatatagtattttgtttcctttttagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccaggtgagtcttctctcttccattctattgcataaggatgatctttccataccattcctttaaaagaatcaacttcattgagttaacatttatatacaataaattgcactcgtttaaagtatataacgcgatgagttttgataaatgtaatcactcatgaaactaccgccatgatcaagataacaaaacatttcagctacctctgaaagttttcttgtgcctccttgcagttcatctctcattccacccctggccccattttctggaattttatatgaatgaaatcatgctgaatgtaattttttctgcctgacttctttcacccagcataattattttgggattcatccatattagtgagtgtatcatattgttccttttttagtgccaaagtattcttttgtttatacatttttttgtttgtgtgtttgatatggggtctcactctgagatggggtgtcattcaacctctgtctcactcgaggttggagtgcagggcgtaatcttgactcactgtaacctttgcctcacattgatcctcccacctcaggctcaattgatcctcccacctcaggctccccagtagctgggaccacaggcatgtcccaccacacccagctaattttcatatttttggtagaagtggggtttcactattttgtccagtctggtccggaactcctaagctcaggcagtctactcgccttggcctcctaaagtgctgggattacagatgtgagccactgcacccagccattgtttatacatttaaaatgctattttgtttattcatctgttgaaacatattgaggttatttccagttttgggctattatgagtgaaactaacatcataatttgtatgtaagtatttgtgtggtcatatgtctttatttctcttggataaatacctgggagtaacatacgtgggttatatggtaggtatatgtttaactctatcagaaattaccaaacaggttgggcattgtggctcatgcctgtaatcctagcactttgggaggctgaggcagaaggatcgcttgagcctaggagtttgagaccagtgtgggcaacatagggagaccttgtctgtacataaaataaagtaaaaaagctgggtatgaagattgcataagcctgggagatctgggctgcagtgagctgtggttgtgccactgcactccagcctgagtggcagagtgaaaccttgtctcaaaaaaaaaaaccaaagcaaacaaaaaaaaaacagttttaaattttagctaatccaggccaggcgtggtggctcacacctgtaatccccgcaacactttgggagcctaaggcaggtggatcacctgaggtcaggagttcaagactagcctggccaacgtagtgaaaccccatctctactaaaaatacaaaattagccgggtgtgtggtggtacatgcctgtaatcccagctactcaagaggctgaggcaggagaatcacttgaacctgggaagtggaggttgtggtgagttgagatcgcaccattgcattccagcctgggcaacaagagtgaaactctgtctcaaaaaataaaaataaaaataaataaataaaataaaatacattttagccaatccaatatcattgtgtgtgtttttgttttgttttgttttgtttttttgtttttgagatggagtcttgctctgtcccaggctggagtgcagtggcatgaccttggctcaccacaatctccttgtcgcaggttcaagcgattctcctgttcagcctcccatgttgctgggactgcaggtgcacaccaccacgcctggctaatttttgtatttgtatttttagtaaagacgaggttacaccatgttggccaggctggtctcaaactcctgacctcaggtgatccacctgcctcgcctcccaaagttctgggattacaggtgtgagccactgcacccggcctgctctcttcttttcttggttaatcttgctaatagtctatcaattttatttagcttttcaaagaaccagctttttgtttcatttatcttttgtatttttttgtttcaatttcatttagttctgctctgatcttagttatttcctttcttctgctgggtttgggtttggtttgttcttgtttctctagttccttgaggtgtgaccttagattgtcttttgtggtctttcagactttttgatgtaggcatttagggctatgaactttcctcttggcatcaccttagctgtatcccagcggttttgataggttgtgtcattactgtcattcgattagaagaatttttaatttctatcttgatttcatttttgactcaatgctcattcaggagcaggttatttaatttccatgtatttgcatggttttgaaggttccttttggagttgatgtccagttttattccactgtggtctgagagtgcttgatataatttcaattttcttaaatttattgaggctcattttatggcctatcatatggtctgtcttggagaaagttccatgtgctgttgaataggatgtgtattctgtggttgttagatgaaatgttgtgtatatatctgttaaatccatttgttccaaggtatagtttaaattcactgtttctttgttgactttctgtcttgatgacctgtctattgctgtcagcggagtattgaagtccccactattattgtgttgctgtctgtcttatttcttaggtttattagtaaatgttttataaatttgggagctccattgttaggtgcatatatgtttaggactgtgatattttcctgttggacaaggccttttaccattatataatgtccctctttgtctcttttaactgctgttgctttaaagtttgtttcgtctgatatgagagtatctaccccagctcgcttttggtgtccatttgcatgaaatgcctttttccacccctttatgtgagtccttgtatgttaggtgagtctactgaagacagcagatagttggttgattagttcttatccattctgcagttctttatcttttaagtggagcatttaggccatttacattcagtgttagtattgaaatgcaaggtactgttgtattcatcatgctttttgttgcctgtgtactttgggtttttgtttgtatgtttgtttttgctttttaacttgtgttttagttttataggtcctgtgtgatttatgctttaaggaagttctgggccaggcacagtggctcacacctgtaatcccagcattttgggaggccaaggtgggcggatcacctgaggtcaggagttcaagaccagcctgcccaacatagtgaaaccctgtctctactaaaaacacaaaaattagctgggcatggtcgtgggcacctgtagtcccagctactcggtaggctgaggcatgagaattgcttgaacctgggaggcagaggttgcagtgagctgagatcatgccactgcactccagcctgggcaacagagcaagactccatctcaaaaaaaggaaataaaaaaaaaaaaaagaggttctgttttgatgtgtctccaggatttgtttcaagatttagagctccatttagcagttcttatagtggtggcttggtaatggcaaattctctcagcatttgtttgtctgaaaatgactgtatctttccttcatatatgattcttagtttcactggatacaacattcttggctgataattgttttgtttgaggaggctgaagatagggccacaatcctttctaggttgtagggtttctgctgagaaatctgctattaatttgataggtttttctttataggttacctggtgcttctgtctcacagctcttaagattctttcctttgtcttaactttgggtaacctgatgacagtgtgctaggcaaaggtctttttgcgatgaatttcccaggtgtcctttgtgcttcttgtatttgcatgtctaggtctctagcaaggccggggaatttttccttgattatctccccaaataccaaatatgttttctaagcttttagaattgtcttcttcctcaggaacaccgattattcttaggtttggttgtttattgtaatcccagacatcctggaggctttgttcatatcttcttattctttttctttgtctttgttggattgggttaatttgaagaccttgtcctcgagctctgaatttctttcttctacttgttcaattctattgctgagactttccagagcatttcacatatctaaaagtgtgtccaaaatttcctgaattttttattgttttttctttaagctatttatttatgtgaatatttctcccttcacttcttgtatcatttttttttttttatttccttgcattgggcttcgcctttctctggtccctccctgattagcttaatagctaacctcctgaattctttttcaggtaaaccagggatttcttcttggtttggatcaattgctggtgaacttatgtgatttttggggggtgttgacgagccttcttttgttatattaccaaagttggttttctgattccttcttagcctcccaagtagctgggaatgcaggtgtgtgccaccacatctggctaatttttgtatttgttggtagagacagtttcaccatattggccaggctggtttcaaagtcctggcctcaagtgatccacctacctaagcctcccaaagtgccaggggataacaggcatgagccaccgcacccagccagtgatttgcttcactttgtagtaaatctgtatttgactctaaaacaattcatctatgtattcaggaaaaaaaaaatttttttaagttatgatgaatctttttctaacacaaaatttttcttcttagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtggtaagtataaatctattattattacgtgactacccttcttatctctactagtgcttatttcctttaaagttttttccctgatattaatatagttgtataagtttaatttttttggtatttccctggtgtaacttttactattcctttagtttcaatcttttgcatcattgatttagctatctttcataaaatagtccacaaagcatatagctgttttaatagtcaatatgagtgtttctcttatctgtaatacttttttatttattgtgattttttaaaacagctttattaagacataattcatgatatggtttggatctgtgtccctgcccaaatctcatgttgaattgtaatccccagtgtgggagctggggcctggtgggaggtggttggatcatggaggcaggttgtcatggtttaacaccatctgccttagtactgttttcacaatagtgagttcttgtgagatctggttgtttaaaagtgtgtggcacccccctccccgacccccgctgtagccatataagactctcctgcttccccttagccttcttctatgattgaaagtttcctgaggcctctcaggaagccaagcagatgccagcattgtgcttcctgtacagcttgcagaattgtgagccagttgaacctcttttctttgtaagttgcccagtctcaggtatttctttatagcaatgtgagaatggactaatacaattcatgtaccataaaattcaaccagcaaattacagaattcatgagtttctggtatattcacagggttgtactaacatcaccacaatctaaatacagaatcttttcatcagcccaaaatgaaatccgcatctttttcccctaccctagccccaggcaaccactaatctactttctcactctgtagatttatttattccagatttttcatataaatgaaataatatgtgattttaactattgaggccacaccaacctctctctttactgaatttaaacatttagtctctgctacatggttagaactttatactttttacagtgttctttaattgtgtcatgtatgtaaatcttctttccataatggcaataaaccaattgagaataaagaccatttgttcaaacattcatttatttattcaaaatatttagagtgcccttttctttataatccaagagccataatataacaaatactttatttgatttggacaaatatttcttcagccagagccttactttgaccctgttggcttgtgttatttttcctgaagttcattaaaactaattttctctggtatattttaatttctcacatttaatattctataactttatttttagaaaacagtatattctgattagtattaatttgaacatgtttagtattctatttagcatgatttttcggtttccttcctctttttctgttttccattggatctactttctttaatttcctctaatactttgaattatacacttaccttataaatggttatctataaatttttaacattcatacttgacctcagatgataaatttatttactctcctttgggataatacaaagtttttttttttttttttttttgagacagagtttcgctcttgttgcccaggctggagtgcaatggtgtgatctcggctcaccgcaacctccgcctcctgggttcaagcgattctcctgcctcagcctcctgagtagctgggattacgggcatgcaccaccacacccgactaattttgtatttttagtagagacagggtttctccatgttggtcaggctggtctcgaactcttgacgtcaggtgatccacccgccacagccttccaaagtgctgggattataggcatgagccactgcacccggccgggataatacaaagatcttagaatgcttttagtttgatcatcccctttttttgatgttgacaccatcctctttctgtcatacatgtaattattaattccttttctgtatccatactgttcttatatcccccaaactagttataattattattatttgaatagttaatacttgttcagatttatttacaggttggccagttgtgttgcttatctttattttctccatctaatttcttcccctggattcaatttatttcttcctgaactctatcctgttggtgttgtttatatgactgttttagtctcatcttattctggaatgacaggttaattggatgtgagattctagattgacagttattcctccttggctcttgtttactattgagaagtatggtattaatttgacattcttttccctctcattgcttatattttatctttcttatcagtctttttctttgtttatactgcattttgcatattgcttaaaaatatgtatgttgcttaaaaatgcctcctataccacacaattataaataaattctactacatattttctaacaaccttataattttatttcttacatttccctcttttatacatttgaaacctatttttatgtatggtgtaaggtggtgttttaggccatttttgtgttgctgtaaagaaatacctggccagggccgggcacggtggctcacgcctataatcccagcactttgggaggctgaggtggacggatcacgaggtcaggagattgagaccatcctggctaacacagtgaaaacccgtctctactaaaaatacaaaaaattagccaggcgtggtggtgggcacctgtagtcccagtgactcgggaggctgaggcgggagaatggcgtgaacccgggaggtggagcttgcagtgagccgagatcgcgccactgcactctagcctgggcgacagagcaagactccctctcaaaaaaaaaaaaaaagaaaaagaaatacctggccaggagtagtggctcatgcctgtaatcccagcacttttggaggccaacgcgtgtggatcacttgaggccaggagtttaagaccagcctggccaacatagcgaaaccccatctctactaaaaatacaaaaaaaagctgggtgtggtggcacacacctgtaatcccagctgctcgggaggctgaaacagaagaatcccttgaacttgggaggtggaggttgcagtgagctgagatcaagccactatgctacagcctgagtgaaaaagaaaaaaaaaacaaaagaaatacctgaggctgagtaatttataaagaaaaggggtttaatttagcttgtgcttctgcaggttgtacaggcatggctccaagatatgctcttgatgaggacctcaggaagcttgcaatcatggcagaaggcaaaggaggagtagatgtgtcacatagtgagggcagaaacgagagagaggaggtgccatatacttttaaacaaccagatctcacatgaacttagagtgaagactcactcttcaacaggagatgatgctaagctattcatgagggatctgcacccatgatcagacacttcccacccccaacactagcggttacatttcaacatgagatttggaggagacaaacatctgaaccatatcaggtggcaacttaacttaaaaaaacaacactgaactcaaactcctgatgccatattgggaagaagagtttattttgagatctgtattttttagtgcccttatggagtggggtgaatgttgctggtgttgctctgaagactctggaccctaaattaggaacggattcagataaggaacactggaaaaatatccataaacaagttattcaaaggtaatagtacctattcagtttcttaatgccttaatagtcagtcttaagaataaatatcacggacaaaaatcaagtagttgatccttgctttttgtgagataaataactctaggcttctgaaaaccactaaattcagacttatacatagctttctttttgggggcatttttcaaaaagaaaaagtacttattatttcacaactcatatatttgagagtaataaaagcatagtgattatgagcatggactttggacccaggttgtccaggtttgaaacctgcttcatcatttattagtgatatgatattgggaaattacttaaaatatcagaagttgtttacttatcttcgaaatggggataattatagaacctactttacataatagccttatggagagtaaataagttaatactacatgtaaaatgctagaaccatgccaagaacttattaaatgttcatcatttgagtagatgaaacattaagctaatgcagatgatcagaaatcaatatggttttcttataaatgaagcatctgactccatatatattagccttaacagcacacaggattattcttcatggtttagtcaagagtcaagttacatattagtagaagttatagaacttaaaaattggctgggcggggtggctcacgcctgtaattccagcgctttgggaggccaaggcgggtggatcacctgaggtcagcagttcgagaccagcctgaacaacatggtaaaaccccatctcttctaaaaatacaaaaattagctcggtgtggtgatgggcgcctgtaatcccaggtacttgggaggctgaggcaggagaatcactggaacccaggaggcagaggttgcagtcagccaagacagcgccattgcactccagcctgggcaacaagagtgaaactccatctcaaaaaaaaaaaaaaaaaaaagaacttaaaaatcacttttggatattcacagcttggaatattgaacttaacaaaaaccacaagtctactgtatgtatacttaaaacaaccctacaaaaatgtgtaagaggccaggcatggtggctcacgcctataatcccaatactttgggaggccaaggtgggcagatcacctgaggtcaggagttcgagaccagcctggccaacatggtgaaaaccgtctctactaaaaaaaaaaaaaaaaaaaaaaaacaaaaattagccagctgtggttgtgcgtgcctgtaatcccagctacttgggaggctgaggcacaagaattgcttgaacctaggaggcagaggttgcagtgagccaatattgtgccagtgcaatccagcctgggcaacagagcaagactctgtctcagaaaaaagataaataaataaaataataggctgggcgcagtggcttatgcctgtaatcccagcattttggaaggcctaggtgggctgatcatgaggtcaggagatcaagaccatcctggccaatatggtgaaactccgtctctactaaaatacaaaaaaaaaaaaaaaaaaaattagccgggtgtggtggtgtgcccctgtaatcccagctactcaggaggctgcggcaggagaatcgcctgaacctgggaggcggaggttgcagtgagccaagatcacaccagtgcactccagcctggcaacagagcaagactctgtttcaaagaaaacaaacaaataaataaataaaataaaataataaaacaaaaatgtgtaagaattagggcagagactaaaaagtcataatataacaagtgatcatgggtgagtttttattctcttaaatgccttttagttttaaaagtttatattattttatttttggttataaaaagtaacatggcaatgtgtatgagtacagagctacagtttgggaagatgaaaacatttgagagaggatagtagtaatgactgcacagcagtgttaatgcacttaatgccactgaactgtaattgttaagatgataaattttaccgtagttaaaaaagcagttaaggctgggtgcagtggctcacatctgtaatcccaaccctttgggaggctgaggtaggaggattgtttgaggccaggagtttcagatcagctggggcaacagagtgagatcatgtctccacaaaaaattttaaaaaattagccaggcgtggtatgtctgtagtcccagctactggggtggttgaggcaggaagatcacttgagcccaggcgttttaggctcaactcaaactcgcagaggtatgatcacaccactgcacactagcctggacagcagagaaaaatcctgtctctaaaaaaaaaaataaataaaataaaataaattaaaaaattaactagttgtagtgttgcatacctgtagtcttagctacctgggagattgagatgggaggattacttgagcccaggaatgcaagattgcaatgaacaacgatagtccactgcattccaacctgggcaacagagtgagacctcatctcttaaaaaaaaaacaaaaaacaacaacaacaatattaaaagtatatagccacgaattgttgtctgaaattcagactgtccgactcacaggacataataggttttcacctagcattaagtttatctagcatggtgaaaggataccaggaagaaaacacagtatagcatatcagtatcttctttagaaggtatttcttttcttttttttttatttgagatggggtcttgctctgtcgccaggctggagtgcagtggtgtggtctctgcactccgcctcccgggttcaagcaattctcctgcctcagcctcctgagtagctgggactacaagcacgcgccaccatgctcagctaatttttgtatttttagtagaaacggggtttcaccatgttggccaggagtcttaatctcttgacctcatgatctgcccaccttggcctcccaaagtgctgggattacacaggaaaaatgggagccagttatatcattgggccactacactaaacccagaacactaacctcctatgagattataaacatctttaccacgtaagctcctattaatatgttacaccatactgtaatttgcagctgaaaaaatgtctaactgatatcaagcctcaaaattgttactcatattactgtctatcacttcctattttccctttcctcagatgctagtatctcctttagggcagtagcaaaagtataaaaatgaaattactttggtactggtnnnnnnnnnnnnnnnnnnnnnnnnnnnnnnnnnnnnnnnnnnnnncaacagtattgcaatgcttaggtgtagcttctaggccctatcactgcttggggcacactcagttacacagaaggaagctgacatgggggcagacttccccagcacaggaaagcggctgcctttagttctcaacagttttgttttttgtttttttttaactgcaaaagtgggaaattctcaacagttcttaatgcacttcctgtcacatagccctcagggtctgcatacttgatcccagtactgctagtcctgatacaatgcacaaatcaatggtttcataaaatccagtgctgataacctagttctatgatagttaatagtccacatttatcttaactaatttttatatctagaaaactatgttgcctgaactcaaactcaaggttatcttcccagttacttctggctttttcgaaagggctcaaatccactgttaaccctttacccttggtacctttccatgacctcagattattatctttgtatcatatattcttcagagttcatttgacaaacatttcttcaatattttataaatagaaaagacaagttagtacatctacaaccactagactctataagacacagtaggtaaacagaatccttcacaatgttttggtaattcttaaccaactagactgtttttttcccccctctatcatttactatcacttgcgtcttattaaaggtattgatacacgcattcaatcacatgttttatctctttctctctctcttttttttttttttttttttgagacagagtcttgctctgttgcccaggctggagtgcagtggggcaattttggctcactgcaacctccgcctcctgggttcaagcgattctcatgcctcggcctcttgagtagctgggactacaggagcgtaccaccacacctggctagtttttatatttttagtacagatggggtttcaccatgttggtcaaactggtctccaactcctgacctcaggtgatctgcccgcctcagcctcctgaagccaccacgcagtttttatatttctaaagcaaatgtatttctttttttggccaaactatttccataagtatcacatcaattgaaagttttaggtcaatttaccaaaatatcttttactttgaaaatcattattggtatgttttattttcttaaattctcttaagggaacctacaaatgctttgtttcaccaaaaagctttgaatgagaggttaaattaatccctagaaaacacaatatgtattaatattacagtatcttttcctgtccttctcaacaaaactgtcccttatgcccatatattttcagctataggggccaggagaccagtctccaataaatgcagggatctaactggtctggaggcacatccataccccccacccactaaggaacttgttttaaccgatagcggtttccaagtgttatggagcagcccatctacctcccatagggctgtcacagtgttggtctttatctacccagtcactaataattgtaccacagagaatggtagttcttttttttctttctttctttttttttttttttttgagacacagtctggctctgtcatccaggctggagtgtagtggcatgatcttggcttactgcaacctctgactcccaggctcaagccatcctcacacctcagcctcctgagtagctaggaatacaggtgcatgccaccatgcctggccactttttgtatttttggtagtgatggggtttcaccatgttgcccaggctggtctcaaactcctgagctaaagcaatctgcccaccttggcctcccaaagtgttgggattacaggtgtgagccactgtactcgggcagttcctttttaatttgagacacttgctttaagggaacaaggattaagatcacatttcccattgaagtcctgtgtgatttgaataccaaatattccaatgtgtttcagatcagtacttatcactattggtcctctcaactctgcagtatctaaaattaaattatttgcctcttgatcatttagcagaggatctataattataaataatcctcagggtgctgctaatatttatctaaaaactactcagctctttttacacaacagcttctgatttgctgttgtctaaccaccaattgcagaggaatgacatcatgatttaataggatgtccttacttgttcccaagagggcatttggtttacaatgtgtatcagtttttgtcttaaagtaccatccttgaaactatttcttctatttgctccctttaccctttcttttacaccagcaattttattttcatcaggatggttaataacaactaaaggattatgtttttagctattctcaactttcttctgtttctcaatctattttattaatacctgagaggataaatctgtcatccagattcaactggtgagatttgtccccagtaatctactgtagagctttcttttcttcaactcatagacagtatgctgtcaatcaagtgccaggcagaccctctttccctttccttttacttacccccggagtcttggccgtacagaattgagggtctaaaagtacttttgtcatcaaaagtattgcatggcctctgatagtggccctgattttggactgatagtcaaatcataggacactactgtaggaacagtccaggcccaacctgctgtgttcaggtggtatatatatatatatatatatatatatataatatatatatatgccttatcttggcaaccaagtgtgttatgtgcattcttggggctttaaaacggggtagttgtaagacctcctgatatgaatgatatatgctggacagtctttgcttcttgtcctgtatcctttctaaaagttaaataaacttagtgctaaattaaaccctctttgtccagtgaagttgactgtcaatccaaacctgagaccactatttgtagcaatgcaaatatataataaatattaattgtaggaaataaggaaattcagacaggcataaagaagactcacctgtaagcctgtcttgtaaaaataatcactattaataacttggtaggttgatgcagctctaaagtttgtataaaaatttatattttttacaagccagagataagaaaatgcataatgtttagtattgtgctattttcctttgaaaatgtatcatgaatattttccatattcatttattattgatttagtgatatattcttaggaaagatatatacacacagcttacaactgtataaatttacattggcaagctagtaacaattttttttttttttgagacggagtctcactctgtcacccaggctggagtgcaatggtatagtctaggctcactgcaacctctgcccaccaggttcaagtgattctcctacctcagcctctccagtagctgggactacaggcatataccaccacacctggctaagttttgtatttttagtagagatggggtttcgctgtgttggccagtgttggccaggctggtctcgaacttctgacctcgtgatccacccacctcggcctcccaaagttctgggattacagatgtgagccattgcccctggccactagtaacaattttaaatggtccaagagatttatatggtaactttcaaggtgattagtttctatgttgcatatttaagcaacaatacaaaaaatattaaaagctagtttcatcttgagtggcacatttgtcctagtattctgcctttatgatttaaaaaaagggtaaattaatttttacttaaaaaaagtaggctgggcacggtggctcacacctataataccagcactccaggaaactgaggcgagcagatcgcttgagctcagaagtttgaaaccagcctgggcaacatggcgaaaccctgtatctacaaagaacacaaaaattagccaggcatggtggctcatgcctgtactgtcaagtagctacttgggaagctgaggagggaggatcgcataagcccaggaggtggaggttgcagtgagccatgatcacacacaactgccctccggcctgggcaaggaagcaagaccctgtctcaaaaaataataataataatcaataaaaaagtaataaagtatgtagtgaagttttattagaccagtatagaaagttttgttgcctgtttataaattctgtaagaaatctatgggaaaattctaatacaattgcattgacatgtagataactttaaaatggatgcttgaagaatattatgttttctctgggttgacttattatgaatttgattttcttactttctacaactgtagtgcctatgaaattatcaagctgaaggggtatacctcttgggctattggactgtctgtgatggatctggtaggatccattttgaaaaatcttaggagagtgcacccagtttccaccatggttaaggtaggcttaaattaaatcttcatttatcattctttcctttaatatttattgggtcactactatatgccaggcagtgtacaagatgttgaggatataatagtgaataaaaaatacaaagaccttgacctcaggtcaggtcaaaaaaatacagataccttgacctaaggaagggaatcctgaaagagaaccaggtttgaagatcacatttacagttttggacacagttttgagccctggcatataaacagtgtgaagccaactcaaactagcttatgcaaaaagaaaatttattggcttatgtaactgaaatgccaaggaggcctgattctggtactcagacaatattatgagagctgtcttttctctccattctcttggctcatctttttcctctattggcttccaactcatgcagactttttccatggggcaacaaagatgggtcacagtagctgcaggcttagatcctataatacctctggctgagaaccacttgcgtagactgaggaaattaagacaagtgtaatagctatttttaggaatttggttgtgaaggtaaggaaaatcagggcaagaagtttgtttgtttgtttgttacacagataagatgcttatagtaaagatcaagtaccaagggagaggatgaagacagaagtggtaagcagagggggatgcagtccagagcatagttgtaggcattacccctaaaaggaggaggggcaggagttaacaaaaagagaatgtgtactgatgcatgtagatttgtatatttgacattggaagcatctgatgacttctctatttttttttttttttttgagacggagtctcactctgtcacccaggctggagtgcagtcatgcgatcttggctcactgcaagctccacctcccaggttcacactattctcctgcctcagcctcccaagtagctgggactataggcacccaccaccacacccggctaattttttttgtatttttagtagagacagggtttcactgtgttaaccaggatggtcttgatctcctgacctcgtaatctgcctgcctcagcctcccaaattgctgggattacaggcgtgagccaccacggcctgtcgatttctctatttttagtgaaaggagatagtgaaaggagtaggataacgggagtgggagcagaaggtttcataagtgaaaaaagtctagagagtggaaagaaagggaattttggttggattattcatatgtatattgaagttaacaaggataatggcagaaattgagatagacagggaagactgtgagccatgtgtcagtctgtgaatgagattgaataactaggaggttagtccttacaaagggaagaagagctgaattagatgatcttcaaaaaatagggagaatatgttttgtttttataagaccaggggattaatgatttggaagaacggggcaggtgcagtggctcacgcctgtaatcccagtactttgggaggctgaggccggtggatcacttgacgtcaggagtttgagaccagctggtcaacatggtgaaaccctgcctctactaaaaatacaaaaattagctgagtatggtggtgcacgcctgtagtcctagctacttgggcagctgagacaagagaattgcttgaacccaggaggtacaagctgcagtgagccaagattgtgtcactgcactccagcctgggcaacagaatgagactctgtctcaaaaaaaaaaaaaaaaaaaaagatttggaagaggcaataaagagtacacaatggataccacacaccccttcttttctgaggctgcagaacctatgggagaataagcaactgcctctctaggactctggagaaagagtcagggaagtgtcaaatgagtaatcagtgaagaaactgagtaatatgggaatttaatagcctttaccgaacaagtcaatggacattatattttaatttaattttaatgttttggggagggatgaagtcttactctgttgcccaggctggagtgcagtggcgcaatctcagctcactgcaacctctgcctcctgggttcaagcgattcttgtgcctcagcctcctaagtagctgggattacaggcacgtgccaccacgcctggctattttttgtatttttagtagagaaggggttttgtgctgctgccaggctggtcttgaactcgtgacctgaagcgatccaaccacctcggcttcccaaagtgctgggattacaggcgtgagccaccgcgccctgctgagttatattttatagggaacatttaaacatttgacgttacaagcagagtcatttgtatattcttattttttctttctttcccacttacttcacttttactacttcacattttcaccaaatcaaggtgtgcagagtttatttcacattaatgtattaattggattttttttttttttgtcaaatagggaattctctttaaacaatctctgtatttcacagctggtccaagagcaaatgagaacaaattctaatatatccaggggaaattatcactaaccaggcataaagcttaaagggaagagggtaggctgaggaggctagtggcaggtcacagttagcacacagggccaggcttggtcccaggattcaggcaggagcccttgttcccagcccacccagcagtcctcagatggcatgatgggtggacatgaattctcgaattccagtctgaggtgcctcttctagagagaagagagatgacaggaggtaaagggaaacaaattctggaaataaccagtagggaagcagagggacttcttcccctgccaccatcagaggccttgcctctgattacacccatggaagctcatgttaaagcttcaaatgtcacagaggtggcaacagaatgatcaaggatcagagagggagttggagaccaacctgggcaacataacaagactccatctctataaaaaatgaaaagaaaaatagccaggcatggtggtgtgtgctacttgggaggctgcagtgggaggattgcttaagcccaggaggtccaggcaacattgagctatgactgcaccactgcactccagcctgggtgacacagcgagacactgtctcctaaaaaaaaaaaaaaaaaaaaaaaaaaaaaaaaagaggatagggaagtgaattgcgaatttcagtatgactgtggctggagcctggctgaatagaatgtgggttgacagtctgaaaagacagtggctttccatagctaggcagatgccaaagtggaaggaatgtaagtagttcttggcggggcaccctcagggatgacacttggctgatctgatggtgcttatgagggtgagtgtaaagtggctaccaaaatgagggagctggactatggtagaggaggtaaccagagaatccctctgtggggagaagttactagagcaaaacaggaacaaggggcacaccttgtgctcctgagtagagccccagagatggtgagagggaagaatggctgaatagtgcccatgggctctgcagcatggaaagctgtgaggcactgctccagagtcaaggagcctcccctcttccttcaacgccattcctggtaactgtttataatcagtcctggagaagaacaatgccctcccttctcccacaaccccagactcagccccaaagagaggggtaaagagtgatgagtggtaggaggcagggaagtgtgagggatctactgggtgtctttttttttttttaactgggtgtcttttaacattttttaaattttaattttttgggggtatattgagttttcctatcttccaagaccagggaggatagtatggaggtggtggaggctggtacctatgcatgtagatgttatgtgagttgcccaggttgtaataggctctggcagctgcttctcggccttggctgcaggaatggagggaattttggggcttctgatgggaggttccaggggcccaggatagggcagtgccatggggctgcacctgtttcatggccctatccatgatgggaggtcccagatagaactcaggcggaggtagtggataggagtacagaagggcaggagtgcattccattgcagctggtgatgagaggcacaggccccaccgggcatgtaagagcatctataggctccactgggggtttacctctggaggcttaaaatgccacccgtagcacccattgtccaaactcaatgatgctccctgctgtaaaggtatgaagcagagccttcccagtcacctcctgcttcactgttgcctcgatgtagtttggactacacacaagttacttgattctcatagtactccttttgataaaatggcatcatgaaagaccgcatggcatcctttcccgtggaccaaaagatgacctggtaagggataaggtaaattgtatgtttctgggtccttctaaaggcctctggcatcttcttcatgtcactgaatgtaagttccacatggttataggacataaggatgctcttgcttttgctgaccatcactctgccaccctctgagcgattcttgttgaatgctttagtctctcctgtatactctcattttgatgcccttttgcatagctgcttttccatatcaggttatttgaacaatatcttatcttgcctttcagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctgtgacataactctagtctctcaagattagaacgagcaaatggtaaagagattttcctctttaagaatcatttatagctctattctaatgatacccaatctgtacaggtgtaagttatacttctgaggtatgtcacatatgttagagtgccttcagatgtagtagaatatgtataatcactataatacagagctttgattcttttcacaaaccaagccctttttctagtattacaattttatcttgtactttcatccgttagagtaccagcatattcacttcattacattagcgtcatatgtttatgtataatcattataaatgtggccgggcactgcagcctgggtgacagagtgaggctctgtctcaaaaaaaatcattataaatgcttatttttaagaccatatatatcaaaaagaaataaaaagctgagtgctgtggctcatggctgtaatcccagtgctttgggagggtgaggcaagaggatcacatgagtccaggagtttgagaccagccttggcaacatagcaacaccccatctctacaaaaataaagaaattagatgtggtggcctgcatctgtagtccagctacttgggagactgagaccagtagataacttgagcccaggagttcaaggctatgattgtgccactgcactccagcctgggccacagaggaagactcagactcaaaagaagaagaagaacacagaagaaaagcagaaacaagaagaagatacagatgtaactttacgatgtaaaaaatctaaataagattgtattcaactctgcaagtattatactagtcatataaactcaaatagttgatttggtgtctcaattgaaatatcacctggggagcttatgccatcctcagttatttgtgcagcagactattactatgcttgctatggtatagttatgaaatcagtatgacattatctctgccctcaagtatccacagtgagtatttagggtacctcaacgaattgatttttgactaatttttttttcctttttgagatggagtctcactctgtcacctaggctagagtgcagtgacacgatctgtgctcactacaacctccacctcctgggttcaagtgattcttctgcctcagcctcccaagtagctgggattacaggcacccaccaccacgcctggctaatttttttatttttagtagagacagggtttcaccatgttggccaggctggtcttgaactcctgacctcaagtgagctgcccacctcagcctcctaaagtactgggattacaggtgtgagcaactgcgcccggctgattattgactaatgtttgataatagtcattaatagctccctgttggtgtctaaaggtgaaaatgcttctactgatttatatagtatatagatacatatgaagtatttccttgattccacaagaaatttaaggcagctataggaactatacaataaaacaaaaactaagaaatcagtatcaaggtaatttacaattttttttctttttttagacaaggtcttgttctgtcacccaggctggagctggagtgcagcgggtaattgtggctcgctgcagcctcgaactccagggctcatcagatcctcccacctcagcctcctgagtagctgagactacaggcacatgccaccacgccctgcagattttcgtattttttggagacagggtttcaccatgttgcccaggctggtcctcaactcctgggctcaagcagtcctcctgcctcggccccccaaagtgctgggattataggcatgagccaccactcctggtcaatttacaaattaagactagaactggaccaatgggaaagatcagaaggtagatatgcagcccctgaggactcgcatgactagtgaaggctgactcatttggtcagagagtcatggcttaccctctgagtctgttattcttgctctcttgatagctttcattctggtcatctactcctgatcatgattagtgtcccattattttatt

SEQ ID NO: 17124 - DNA, 42954 bp, Human; identical to SEQ ID NO: 17123
  misc_feature (1)...(42954): n = A,T,C or G

SEQ ID NO: 17125 - DNA, 6913 bp, Human
cctttaaaaagtagttatcctgaggcctatattcatagcattctgaaagaaagaaaagaaaagaggaaagaaagagagaggaaggaaggaaggagaaagagagaggaaggaaggagaaagagagaggaaggaagggaggaagagaagaagggaggaagaaaagaaggaaggaaggagggagggagggaagggagggagggaaagaggaagaaaggagggaaagaaggaaggaagagagagaggaaggaaggaggaagagagaggaaggaaggaggaagacagagagggagtaaggaaggaaggaaggagaaagagagaggaaggaagaaatgaaggaaggaaggaaagaaagaaaaaataaaagagtgaaaacggactggagaagaagaaaccacagttgctgctatatccaccagcctctctgcatgtcctggcctcagccctgctgggctctggtactgaccacttccttccttcctaatttcctaattgactaggccagctgagcagggcttttctgtgctgaggaggtaaatctctggatatctagactgaggggtggaaggagccttccagggcacacatgagacatggcaggggtaggctgctagttttattttgttttcttttagacacagggtcttgctctgttaaccaggctggagtgcagtggcgtgattatagctcactgcagccttgacctcctgggtctcccacaatccttccgcttcagcctcttgagtagctgggactgcaggtgcacactaccacacccggtccatttatttttatatttcgtagagacaagatcttacagttttgcacagagtgatcttaaactcttgaccccaagtgatcctcctgccttggcctccaaaagcattgggattataggagtgagccactgtgctggacctagtctgtcagctttgaagctttagatatgaactcagagggacttcatttcagaggcatctgccatgtggcccagcagagcccatcctgaggaaatgactggtagagtcaggagctggcttcaaagctgccctcacttcacaccttccagcagcccaggtgccgccatcacggggctcccactctcaactccgcagcctcagccccctcaatgctgaggagcagagctggtctcctgccctgacagctgccaggcacatcttgttccctcaggttgcacaactgggataaatgacccgggatgaagaaaccactggcatccaggaacttgtcttagaccgttttgtaggggaaatgacctgcagggactttccccagggaccacatccagcttttcttccctcccaagaaaccagcagggaaggctcagtataaatagcagccaccgctccctggcaggcagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacattggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttctcctttcatttcagcaccatgaagcttctcacgggcctggttttctgctccttggtcctgagtgtcagcagccgaagcttcttttcgttccttggcgaggcttttgatggtaaggcttcagaaggtttgcaggatttctgaagagaaacatcgccctggacctgataaactggggaaaatgatgctttcggaaggctgcttttgaaccacagagttgctagtgtctgcgttgctgaggcctgccaggaactagggtttgctgggttgcctgtctcgagtctttcagagctgctgggaatatcccctttccccgtagtgcagcttctcaggatgtgttaagtggatggatcacatttcagaagccgctgcaaggtgtatcaaaaacacatctcctgagccgtaagggacggggcatccagtaacaacgcacacggggtatttttgggcttccttaagatttgagccgctgccttaggttgtgctgcccaatgtgcctggggagctgctaaacagattagagtcgaggattgttgtcagttactcagagaaagaacaatcatcctttccaggagcacctgagctgtttgttttgcgtagaagatgcaaaataaggcctgcaatgggtataaaatgtccctcagcataaatcgcataggagtatgactaaggctgttgactcttctgtcttctttctccttcctccttcgatttcctagttggataatgtacagggctctttagcctcgctctgtcaggggctcccttcctggtttgttctgtttccattcttccttctccagccttcttgacaagagctgggaactaacgtgcctcaagcccccacaaggaccacagcattttctcatttagtttcagaatgactctgtgacgcaatcttcctctcttggaaggtgagaaagctgatcttggaaggtgagaaagctgagacttagagcagctgaagccaatgcccagggacttactgccagtcagcaggtggcagggcagaggtttgagcccggctgtgcttgaggtcagggctcttgccaggtagacgcatcactgaccacctcctagaggttgatggttatgaatctcaggcacaccttggcatcacctgaaatacccatgccttcaactccccagcagagtctgcagaaactggcctggggtgtggcctgggcactgggactttcagtttctctctgggtgattagaaagtgcagccaaggctcacgcctgtaattccagcactttgggaggccaaggtggatgaatcacttgaggtcatgagttccggagcagcctggccaacatggtgaaaccccgtctctactaaaaatactaaaatgtagccaggcgtggtggcaggcacctgtaatcccagctactcaggaggctgaagcacgagaatcacttgaacccgagaagcagaggttgcagtgactagagatcgcaccagtgtcctccaacctgggtgacagagcgagactccatctaaaaaaaatgaaaaagaaagtgcagccaaggcagagcaccactgccctattgcttcctcaagcaacccacagcatcagtacagcctactaagaaagtatttagggacttttatgctcctaacagtcactggaactcacgtcacaatgacgtgtattccatttgcaagaatatatactttaggtcggggtgcggtggctcacgcctgtaatcccagcactttgggaggccaaggcagggggatcacgaggtcaggagttcgagaccagcctgaccaacatggtgaaatccccgtctctactaaaaatacaaaaattagccaggcgtgatggcgcatgcctgtaatctcagctactcaggaggctgaggcagaagaatctcttgaacctgggaggtggaggttgcgatgagctgagatagcaccactgcactccagcctgggcgacagaactttagtagtcagggcagaagtactctgtgtctgccacctttctcagcatcagtattccatgtcactacctcattcatacacactcctggatcttatcataggcagcttcattctatagcagtggctcttcaccagggcacttgaagaagccaactaggataaaggaatgtgcttctcaacccatggtatccaaggctgctatgatcacaggctgaaagcttgaagtcagtggaagatttgtccttcctcattcccctctaaggtgttgttggagtctttatgttctcctgatgtcccttctgcctttcctttcctttccaggggctcgggacatgtggagagcctactctgacatgagagaagccaattacatcggctcagacaaatacttccatgctcgggggaactatgatgctgccaaaaggggacctgggggtgcctgggctgcagaagtgatcaggtaactggagctcctgggacgttagggctgggtgagcagagcttgcctgccttggacagtcaggagggagacgagctccttgtggagaagttagaggctgcggcccctcctcctcttgccctctctctgcctctgtgctcagtgtgaggtctgagtggatggtaggagtgagtgattcctcatcctccctctctgggtgctgttcatccagcctaggggtgcccagcctggctgaatggggtggtgcccagtgttttcatccctccttccttggcctttctgggctcctctctgagccctcccttggaacagggagaatgggagggtgggctattgctcactggcctgattattaatctccttcttgcctgccttgattacagcgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtggaatttgtggaaactgtgtgttatactttgtggtatagactgcctgtttagtatgaaggggcgatccatgcacatctaagtgaacgtggaggctgggtgggtgggagacgactcctgggcacacagggcatcctgggcatccctgaggcaaggacatgatgagttcagtggccacccccacaggatcccaggggcttcagcagatcccaccccttaccccatgtgagcagctgcccagtgagtctgtaggaacccgagccacattcccagtgagttcaactgcaccccggcacgttttgctagcacctcaatggagagctccttgcttgcagcttaggcttgtggcacccagcaaaagcttcctgccacccagtggctacagccacacactctccagcaagatttaatctcagccttgtgaggagccctttcccaaatttatttctttctgtgttttttatcccttagtagctaatctcatgttagccattaataactctctatgttaaacccttccttttgtatctgcggctacattgatcaattgtctcacaccgctcacccaccccctctccctggtcatgcagaggcctcaccagtcattttattgctattcccaggcctctgtgtgcccagatctcttcactgccctgtcagttgtgtcctgtccccttctcgacctcctggccttgtcctcaatgatgtttctatgaggctttggaaagcctcatcccaagagtcctggcaactgatacattagtctcaccaacactagcccctactcctgatctcattttaaaattttattttcttattttattattattatttttagggacatcaccctgcttctgactgacccaatttttaaagtttctctttattctccttaaagaatggctctcccatttgtttccctcatctttcttttcactgacttagaattcaggtccagacaaaaattccacttccttgaagagccttcccagtagccatgaaccacactctggggcagagtttgtggctcccaagcactttgttcacacctgctcgttcatctttaccccctcctctcagaattggttttgtatgtcagttcccctgctggactggaagcccctgtaacataactagcatttgaacagttcataaaaacactttcatttctattgtcctgtgtaactgttcacaagatacattagtctcactcattgtcgtttgacaatgtttattgttctaaagagaaagcgagatatgtaggtagacacaacacaataagagcctcaatacaggcacacactggtggcagtccaaactctgctggaatatggaaggccagtgaatagtaactagaatcgctgccatcttttacactgcaattgcaagactgtgtcctatactttacatgctttatcggattgacactgcagagaagcctttgatgttctcggttggataaacaggtttagaggtatgtgttcaggccttctccaaggtcacacatgtaacaggtgcagagccaagactgcaggctggtttgtctgactccagaacctgtgatacactgaacaaggccaagagattcagcagtggagacctcctctcttcttcaggaagatagggaacatggtaagagcagtgaattccataagcatgggaccccgttatacttcattttttgtaaaattagttccttgatcagaagcaacgcctttgggtctctcgctattgagttaagtgtggatgtgccactctccctagtaccccagagtgtagttggaggcttgcctagagattagaggttgaggatccttcagtagttcctataccaagccataagttgtgctgcatctgcaggtagggtcagggagctccgctgaacagatgtggaa

SEQ ID NO: 17126 - DNA, 23975 bp, Human
tttaatacactttaggggttttataataaattaatgaaactgaaatcaccttgatacaaaacaatactgacattttatatcataaagcaacttttccacatgtttgctattgtaagaaatatgttaaccatcttgtaaaatgcctaattcctagggcaagaaaaattcttagccagaggtatttagaatgtctatttcattacttgaacattttctctttttttgaaaactggaaaatttgggacatattccccattacttgagataatacttattgagtacttagtgtaggttagcaactgttctaagagttttatgtaaattataactatttaattctcataagtttatatatgtttaatcctccttataatcatgagagtggtgttaattatcctccctccaagtttgcaaataaagaggttgatacatataaagattataacttgcctagatggatttgcagaaagatttattactagcaatttgttatattattttgcatctcttttattgtttacattttcacgctttaggacaacgtcgcccatactctgtgtttgataagaaaagtcaatctttgagtggtaattgaatgggtaagaaacgtttctgaaagttttcacatccctaaaaacattttgagaatgcttatctgaggccatccctgaatttttagccccagagccaccaatttggaattttctgtgtatacttaagtttaccttaagaaatggtcacttcctttgaagtggaaaatctcttaagatctcctgcttctcatccataaatcctttctcagcagagactcatggatgggctagaagctatattcagtcatctttagaagcacatgggatattgatcaaaggggtggggtggtgggaaggtgaggggtggttgagtgtactccttgggtgtcatggctgggatctcagtgtcccttcttttctgcttatttgtacttattgagaagtctgtcttccattttctccttccccatgaacaagtgtgtgaattatttggaggcaagttgtcttgtttttaaatttttactgccctaactttgactgtggtgcttcacacatgtgaatgcgcttgggttgaaattttattcgttttaccattagtaattatttgaatcaaagaaaaatccacataattattcagtttaactggccatttagttttatagcatttgaaatagaaattgtttttagttctagagactaatttggcataatttaaaaatcttggtagttttggaaacttgaacccaatgaattcataaatgttagttaaattttgaattatgtatctctaactcttcttggtacctgaaatatcctagtttcttccgtgaggaaaatctcagaatagcacgccatgttatgatgttttaaaacgagtgagaattttggatgttatgagttctggtagctgtttggtaacttagttttatattagaaaggttaagtagcatgcccgaggtcatacactgataaacatgaggccaatgattagatatgtctgacttcacattccacatatttccttacactgttttgcagtgtaaataggtggttaagaagataccaaagtagatctctggttcatcttctgagaagcagaactagaattctcctggctagcagttatccatctagtgcatatgtatctagagctggccaggcctttagtttacaaaataaatagaaagccttgtccccactctggaggagcttgctgccttgttagaaggtgagatatgttcgaatagaacatttggggaaaccatttgagacctggtataatgaagtgctaagattgtgggcaaggtggggaggaggtaggccttcctgactagtttaggctacaatagttgggaagactgcaagaagccagcaggcttcagtcatgccctaaaagagcgattggtttagaaaaaaaacaaaagggaactactaacatgtattctattctaggcaggtgtcaggcaaagttgtatcttattttggtctcactagattcttgcaaagcttatctgcatatccaggttttataaaaggttaagaaactgaagctcctagaagtaaatgagcccttagttatcaaatattgtctgcattgtgcaacttcttttttagcccgtagtctttgttttcatactttagttttagagaattactccaaattcatcatgattgaagacaataaggagaacaaagaccattccttagaaaggggaagagcaagtctcattttttccttaaagaatgaagttggaggacttataaaagccctgaaaatctttcaggtaagcattttctgtatttttgcacagaattcttctagaaatgaatctctaaaactatatttaaaatatagggcaacatagcaagaccctatctcttaaaaaaaaacaaatttagctgggtgtggtggtggactcctgtagttccagctacctgggaggctggggtgggaggattgcttcagtccgggagtccagggttacagtgagtgagctatgatcacaccactgcactctagcctaggtatcagagtgagattttctctctatatatatatctatatttatatatagataaaatatataaatatataatttttatatattatatatataaattattgtaaactcttcagagatggagtacaaacatttgttaagaacttacatttctaaaatagtgctgaattctaacaagggatacaaacaatttacagaagaggagatacaaatagctacttcgagaaatgggggagaaaagattcactttatagattttagagaagcaaattttaattttattttaataaaatattaaaattttatcaatatataatcatatattattaattatatacttgagatttaatgatatagtcatagtatatttaatgatattattttcatgtagcaaagattctataatgacagtgtctcctattgtcagaacttcattgcattggaggtacattaccctccaatgcacctttggcacaaggataaatttgtgtaccatgtagggaaactatctggtaatatgtattatgagccttaaaatgttcatatttttgacccgtaattctaatttcataaatctgtcttaaaaatatggatcagtcaggcagaacacgaatatttattgagtccttactatgtgtcaggtaccacaccagacactaaggatgtggagctggacaaagtaaacacagtgcctgtcctcacagagtatgtaatctagtggggaaggcaacattaaacaaacaactgcagtaagtgaataatcactatgtgtaaagtgacatgaaacagaaataccagatattctgacagcattgaacttgggggacctaactgagtttaagggctcagggacacacaaagatttattgtttataggaactaaaaattataaataagccacttgtcctaatataggggatgttgaattgtgatagcagaacaccactgtggttaagctctggtctccagagacaggccacctggattcatatccttgctctgtcagttattacctgggtgatcgtgggcaaattgattaatctctccacacttcatgatttatgtccataaaatgagaactctacctacctcatagggtcattgtgagcattagtagagttaatatctctaaaatgcttaggatggtacagtacaaagtaagtgaacaatagatgttagctatgttaataatcatatgacatactattatatagctgtttgcaaagaatatttcaaagaattaaaaatcttaaatatagatagtctagaagagcttgtaatgaaaagcatcagttttcttacctaacacataccatattctcagtcccactccctagaggcaacctcttttaactatttctggtcgttagtttttttggtggtgagtttatgaaatctaaacattgctcttatatgtcttttcaagttatcaacttcacactatattcatttactttctattatgaacaatgatactgataccacctccctcccttccctctcccagtccttccaaatctgatacttttattattacttttagctattctattgattacctttgggtctttaaataaaatacctgtatgtcttcttccatcagctttttttaaatttaatttttaatcgaagaataattgtgcatagcttaaaaacaactcaacctgtactataaaacatatttttaaaaaagtagtgttttgctccatctctcttcattccaaagttccatttaatttttttgcaaccttgtgtgcagaagcttgagttaatcacactcattaaatcacgtgtacactatcatcgttgatttgtgcaacctcttcctgttttatttcattcttgaattctatctccatttctctcttctgatagagagctgctctcatgtttgatatgtacattgaattactttgtctgcactttagaatatgtagtctttgtgtgtgcgtatattagtaatttatataatcatattgtgctataaagattctttttcccatccagcactgtgtttttaagacctatgcacgctgctgtgtgaacatctcattcattcttctaactgctacatggtgttctctgggtgtgtctccacctgcctagtggagacaacctagttatcccctgcctagtggaggcaaccattttcaactctttaaactatttttctaatatttacttccacacttataagttatatgcttattctgcttctacttcttgatttctagaattataggtaattatctattgattttcaacaatgaagtaaaaatttaggtttcttgacacaactccccttccgatggcctcttcaacttcttttccactcgtcttcccaatgtatttgtgtcccggtttttggctctgtcaatctttagtgtctttattattaagattatgtaaatattgtttgaagaagagccttagtatccacctttgtgactcttcctttcttgggcaacaggattacagcatagtgtttaagcacatggactgtggagctggacagactagatttgaattccggctctgacacttgtcacctgtgtgcttctggccaaactgcttaacctctctatgcctctgtttctgtaactgaaatgtctgatagggaatgtttcacttactacttctactttatctgaattttccagaccgtatttttcttccagatgaacttggaaattatttaattacatttcctcaccaaattccattgagattttaatttaggaatgattgacatttttgcatctttttttttctccaaagacatagtttagctttatatttattcaagtcatcatttagaaaatatttacaaatgcattattaatgtaaaaatttataagaaatagatgaaatgaaactcttctttacacctgatcaatcccaatatattttgtaactgacttctattgattctgtgataaattatatgttcccagataaaccctgcctattctaattttctaacatcctctatcactcactcctctttcttgttagctcatgttccctgataatatttttttttttttttttgagaaagggtctcactttgtcacccaggctggagtgcagtggcacaatcacagctcactgtagccttaacctcctggtctcaagtgaccctcccacctcagtatcccgagtagctgggactactggtgtgcgccactacgcctggctaatttattattttttgtagagacagggtcttgctatgtggtccaggctggtcctgaactcctgggctcaagtgattcttccaccttggcctcccagagtgttggaattacaggcgtgagccaccacgcctggcctattctatctattctttaagattcatttaagttcccacctgctccatgaaactttctactctctcttaagtcgtaatgcttttccctttgctgagcacctgcatccgaacactctttactttattttcttaatcttccatgtgttcaccaactagattctaaattcctttatgtcttccctttatattcttcgcagcccttacctagttacacaggtgttcattaagttattttaggatgcactggttagtattggagattatctgctctaaccttctcattgttttagatgaaaaaactatagggtgattagtgctcatgtttcattatcatgtccccagcactcttcctcagctacccaaattggtaagagaacataccctcctcccacacttatacacagagcacccccatcttaggctgacttgggagaggtcagaagaggagatctggttcagctgttactaagattgtagcttaagagatttgaggtattaaatactctgtgctcaagctgttcatctaatttaattaaatggatttttgaaagggaaactcttctttctccaggactaacattggtatcactttttgaaaactagcttttatttatgagaattttcaaaagattcctcttacccaggaaacttaataatattttgatttgaattctgattaattctgacatctgaaggacctctagtgtgtgttattttattggtttctggaggatgggatgaattttgaaaagttttctaatacataatttttaagaaggaattattttgttgttggcagcactaaaaacagtctttttccctttgctgttctgagaagtgtgaatctgatttttagtggtaattaaagtagcctgctcaaagactattaacatttgaggcagttacatgaaatcttttccctgtgctttacacaggagaagcatgtgaatctgttacatatcgagtcccgaaaatcaaaaagaagaaactcagaatttgagatttttgttgactgtgacatcaacagagaacaattgaatgatatttttcatctgctgaagtctcataccaatgttctctctgtgaatctaccagataattttactttgaaggaagatggtaagttcaaaatgtgaaaatactacttagaagatgaaacacctaatgtgtgtccagccttatatttatcttgaagacattaaaataataaaacacaagctctccaaattgcttacagtctgatagtgaagggaacacaaaatatagttgctccagataccaaagaaaaattataaagcaacatttgatcaagtgtaagagaaatgaaaaagaaaatcttgagtataagaaacagctgggtgtggtggctcatgcctgtaatccccgcactttggcaagccgaggcagactcacttgagtccaggagttcaggaccatcctgggcaacatggagagacccagtctgtgcaaaaaatacaaaaactagccaggtgtggtggcatgcatctatggtcccagctactctggaggctgaggtgggaggatcacctgagcccaggaggttgaggctgtagagctgagccgagattgtaccactgcactcccgtttgggtgacagaacaagaccctgtcaaaaaaaaaaaaagaaaggaaagagagaaagaaagaaagaaagaaaaaagaaagaaaaagaaagaaaagaaagaaagaaagaaaaagaaagacagacaatttggcataatcagaaattgataattgattatctctcaatttccaaatcatcaacatttcttgatttgacaaacctataattcacaatccctgagcacttagtaagtctcataagacttgtcatctagcagatagtaaatgaatatttaaatttgttgagaatgttgacagttgctcacaactatgaaatgacacacaatatgtatagcaggggactcgtccgtggcctgttaggaaccaggctgcacagcagcaggtgggcagcaggcccggcgatccttaccgcctgagctccgtctaggagcgtaaaccctattgtgaactgcgagtgcgagggatctaggttgtgtgcttcttatgagaatccaatgcctgatgaaaccatctcccacctccccgtctttccttcttggaaaaattgtcttccacaaaaccactccctggtgccaaaaacaggaacaactgatgtacagcattccttccaaaagcaaatgggaaacaataaagccttttgaagtttcagatactcaggtagcaaagataaaggttaagatctctactggtaaaaaaaaaatccttggagttcactcgaggcaaaagacaaatagataatttaggtacattttatatatggtactcaatctaaaataatctcttcagattatgtccacaatatttgaggtgtaatcaggactgctattcatctgctatgtgttcgtacagctatataattattaaaatactgatatatctccacttctggctggcagagagctacttccccaagtcccttgagggctcctcaccatgcctgaagcctctgttgctccagatactgtccccccaagaagtcccatacccatcattaacaactaaagggttaacaccttgcagagcagaagcctaggactctgctgatgtctattttgagtgattactgctccttttgtatttgttgttaaatcccttgaatatcactcctggatatgttagaaagagcaatatgctggggcaagaagagctgagttctagtcctctgtattccaaaaggagtgagttaccttggataaattacctctctggagtttgattacctcatctgtaaaatgcagaggtgtatagatgacgagatagttcagttgatatttagggtataccaaccttgtgacagatatttctactaaaaaatagggatacaaaaagatatagtctccaccctacagttgtttccagtctttcatgtaagacagacatataaacaggtacattataataaaacatagtaaaagcctttagagagaaacataacatcacaggaacccaggggacagataattagctgtacctacagggtgagggaaggctttgcggaatgagaagatctcattagatttgggtcttgaaggatgtgacggatattctcaggaaaacagaagggtagggtggggcagggaatgggagtggaatagctattccaggcagaaaagtagcatttataaaaccccatagtcttatgagggcttgcgtgtctgaggaatggtgagaagatcaaggtggcaaagacaaatgatttctaagatcttttccatcggccaaaataaatgaagtttttattaagtttgtaccttggtctgtaaataaagttgtgcatctttattctgcttttgttgaataactaaatatgtagcttaagcatttttaaaactttcagtctgtttctaaagtacagtatttctccaaaacttagacatcaacctgaagactcaaaaaaaaattaaagctcagaaattttgaataaattttactttttagaaatagggcaatttacctaactcatataaatcttgccttgatgtacaagctaaaattaaaactctcatccaactgaatttaattttatcttctttattgtcttgtttaagattatctcttcaacttttactggtttttattttattttattttaaattttacaggtatggaaactgttccttggtttccaaagaagatttctgacctggaccattgtgccaacagagttctgatgtatggatctgaactagatgcagaccatcctgtaagtattttctttttttttaagagcaagtcttgctctgctgtccagactggagtgcagtggcacgatctcggcttactgcaacctctgcttcttgggttcaagtgattctcctgccttagcctcccaagtagctgggatcacaggtgcccacaaccacacccagctaatttttgtatttttagtagagatggggtttcaccatgttggccaggctggtctcaaactcctgacctcaggtgatccacctgccttggtctcccaaagtgctgggataacaggcataaactatcacccagtaagtatgtttaataaatatttttataaaaacaatttaaagcaaactaaaaattaagggcaacttttttagagaaagtgttttttctagactaaatgagacattgttttaatcaagatttcaacaagcgggccgggtgcagtggctcgcgcctgtaagcccagcactttgggaggccgatgcgggtggatcacgaggtcaggagatcgagatcatcctggctaacatagtgagaccccgtctctactaaaaatacaaaaaaattagccgggcgtggtggcgggcgcctgtagtcccagctactcgggaggctgaagcaggagaatggcgtgaacctgggaggtggagcttgcagtgagccgagatcacacgaccgcactccagcctgggcaacagagtgagactctgtctcaaaaaaaaaaaaaaaaaaaaaaaaagatttcaacaagtgttagtagacctccatattggtggaattgagactaactgcctgaaaaacatgtagcttcatttgttccaaaatatctgtcccatgcccagcattcctattattaagagctattcaaaaggttatactaaaacgaagacagcatctgcaatcagtttttatttaaatgagcatgggttattggaaagggagataaataaaagtgggccagagaaagacttgccccccacactgcccaccatgattggtttattaggcagttgatgaactaggaagttgtttcctgagaaaattgtacagtacaggcaagagttggagaattagtaaatctagagcatttctgggaggggaggagagaagagagtgcaattgtgaagttaaactgaccagagctttaatgtagcttctctcatgtgttagctgtgtgaatgtgacctttttatactaccttagacagccactagatgatctgtccaattattctataatcttattgaataactattgcaattaattgcagtacttgccggaaaggagcatgtagtctagttgaaaagctaaagcacacatatgtaaataaacacacacaagataaaatgtaaaaagtgcactaggtgaaaattttgcttcatgaaaaaattgcctcaaaatacacataagagagcaaacacttctagctgaagagatcagagaaaggcgacatttcaattgggccttaaaagatttcaggagataagagatggaaaggaagaacaattcaggagggaacaatatgagcaaaggttcagaggcaagaaaatctggggcatgtttatggaaaggtgagtacatcagttttactgatctactaagtcctgctgattttcacctcctaggtatttcttaaatgtgttccttattcatccctactaccacatcccttaaactggtctcccttcttttagccttgtcaccttcaaacacctcctccttatcctcattagaatgacctaaaacctcaatatgactattattcatcttctctcttaaaaatcaccaatggctcctaggtacatacttaaaagaattgaaaatatatgttcctacaaaaacatatacacaaatgattgtagcagccttattcataatagcaaaaaagtggaaacaacccaaacatccattaactgataaatggatgaagcatggtatatttatataagcaaatattattggccataaaaagagatggaatactggtatgtgctacaacatagatgaaccttgaaaacattatgatgaatgaaagaagctagtgacaaaaggtcccatattgtatgattccttttatatgaaatgtctagaatagaaaaatacatagaaatagacagtggattactggttgccaggagctgaggagggttggggtggagttggagagtgattgctaatgagcatggtgtttctttttgggtgacagaatctttctgaaattagatgatggagatggttgtttaactctgtgactatctaaaaaccactgaatggttattttatggtatgtgaattatacctcaataaagttatttaaaaaacaccagtgggttcccattacccaaggctaaactccaagctccttaatggacctttaatttgcagacaccaactagtttcaacatgctctgccttactctccaagtttgagcaacatggggttgcttatattttcttaggcacaacatgctgtttttgtttgtttgtttgtttgtttgttttaatcactgtgctatttccactcttcttttgtgtcttagctcgagagtcatcactgggaagccttccctgaaccacacaatcgtcttaagtgtgcatgccgttctgtacaatatgatgagacatttattgtatcattttacaataacaggttcatgtaaactcctttaagccccagactgtgctttgttcatatctgtttttccagattttagcacaaatcatagtaaatctgtgctacctcatagatctgtattaaagagatgagtctcattctctcttttcagatgtccccttctttcccattatttgcatttttttctcctgggctttgatttttgatttttttttttttcaagatagagtctccctctattgcctaggctgggatgcagcagcaccatcatacctcactgcagcctagaattcctgggctgaagccatcctcctgcctcaccttcctgaggagctgggacaacaggcatgcaccatcacacttggctagttataattgttattttaaattttttttgtacagacagggtctccctttgttgcccaggctggtctcaaactcctgggctcaagtgattctccttcgtaggtctcccaaagtgttgagattacaggcctgagccaccatgctcagccattttgtctaaaaaaattttttttcatgagtataaattctaatgttactattttgtctgctttttaaatcatcattgtttctgcaaatggcaaatatatttgcattttgtgataaaatctaaggctagattcagttaagtcactatttcaaatattaattactttttattattaattactattacaggtaaatataacaagatatagtcaaatgattaaggaaaaaacccctcacccttggaaaagagccatgtatttaactgggatggtggtttacttattctttaaactgttttatctttgtaggcacaattccatctttgtatccattatatcttttatctttgtagctactggagtataaagctgtcatgtaacattgactttaaaataaaaatgatcataaatctctaaataatgcttgctcatagtatcaattatgtagccctttaatataatagctctagtaataatgaaatgtttcccaaatatcatttgtcaagtattttttagtatggatatttaaaaacatatctttaattatcagggcttcaaagacaatgtctaccgtaaacgtcgaaagtattttgcggacttggctatgaactataaacagtaagtatatttaaaaaaatatagtcaactttgagataataaaataagtgaatagaataaattgtgttcatttggtaagtagaaagtgaaataagtgccactatttattaaatgctaattcaaaacaactccttccctttatctcattagtggagaccccattccaaaggttgaattcactgaagaggagattaagacctggggaaccgtattccaagagctcaacaaactctacccaacccatgcttgcagagagtatctcaaaaacttacctttgctttctaaatattgtggatatcgggaggataatatcccacaattggaagatgtctccaactttttaaaaggtaataagctaattaattttttgtaagggagttgctgaactctgttttgatcatgacagcattttttttttttttttttttttgagacagagtctctctttctgttgcccaggctggagtacagtgatgccatcttggctcactgcagcctctgtcactgcagcctctgcctcctgggttcaagcgattctcttgccatggcctcccaaagtgctgggactacaggcacctgccaccacaccctgctaatttttgtatttttagtagggatggggtttcgccatgttggccaggctggtcttgaacttctgacctcaagtgatccaccctcctcagcctcccaaagtgctggaattacaggcgtgagccaccacacccgacaatgacagcatttttaataggggaataaagcgtagtgatatgggaggtcagaattttcccgtactctgtcctggtgtattggatccaggattgggcaccacattgaaggataatcataacctgcagccaaggtagaggaaagtgagcagaattataaggggatttgaaattgcatcacatataaaatttgaagaactcttagggtgtttaacctagagatttaggggctgttatagctttatttaaatatttgaaagccatctttataacagagggattactgtgcgactctaaagtaaaggactgttggatagaaacttcaagcttttggcctagaatagagaatatcttgttaaagagtgatttgaaaatagaataggctgatgagatggttagttcctcatccgtgggggtgttcatgcaaaagctccacacccattatttggtagaggagattcaaacatcttggagaaggttgaagacattttccacattaagattttataattttagcaagaaaaaagatggtgctagtagaggcataaacaaagggtaaggacaattttgttccttttagttctttatatttgtttgatccaggcctctttacttttttctagctagtataggaagtaaaatgatcagtgatctatcttcaagggtttacaatatttaagaagtataaattttcccttttatctcagtagataatctcagcagattaccatagtggagaaaacaaagcagttatgctgtgactcaagagagtttagtttatttccatcgtggtctgaaattgctgtctttgagtttctctcatagacttaaaaaaatctacatatctatttaactccttaacagtattcaacaactatacacaaaactagaagaaataaacaggaaagagcaatacagtttctacaagggaagaaattatgtaagtggtttctataaaaactaaacttttgagaaatagtgattaaggatgatagagaaccaatgcacataacattgctggacttacaaagatggacaaatatatgctacggaagttgtaacatcaaatttgcatgagatttggaggaaacgctttgtaatgcacacaaaactgaaagctgatctcttagggtctggagcctgggctggctgcagaatgtgctgctgaaaatgcttcaaggtcaaataccaaagagaaatcaaaactaacagaaagttcaagcaaaagttggaaggggatatctgcactattaaatatggtagacactagaaacatttggttgtttaaaatttaaataactaaaataaatgtaaatcaagagtttggttcctcagtcacactaaccacatttcaaatgctcaatggctacatgtggctagtagttgccttaccggacagcacagatatggaacatttctatcactatggaaatttttaccggacagtgcagtctgcccatcagaatgggagcatccaaatacaacacagctggatggaagtggaataccagagttgtgagggtttggaatgaaggccaagattagggcttacaggggtctcctgaaccactgaatcctagtggcaggcctcttttacagtatgcatgcagtcttggctgttgggagatggaagggcactatccagtttagataaaagaaagggactactttacaagagatggtactggctaaaaatggcacagcttcaaaaatcgttctgatttaaatgaatacatcttgttaatgattttttacaaaaagaagattatctaggagatagtataaccccttaagggagacagcaaggtgttgtatggcatgaggaaatctgagttttcattctgcctttatcaactaatgtgtggacttgggcacattattgagtctctgagcctccatttcatagttgtcacaataaggagaaacatccttaagtcatgctgtaaatgtgaaaggagatgtgatatgtaaaaggtctaactcattgcctggccatagcaagtgcttaataataattagttccccttaatatgcatatgataaattatagtttccatgccttccatcaacgtgttacttggtgccactagcagaactaaaatgctgcagtcaggggtctattctggtaaagattttctttgttttctcctttgctttgcagagcgtacaggtttttccatccgtcctgtggctggttacttatcaccaagagatttcttatcaggtttagcctttcgagtttttcactgcactcaatatgtgagacacagttcagatcccttctataccccagagccgtaagtacttctatttcagccaggaattcatcaaatggttatttataataatggcatctaccttatgggttcttttttttttttttttttttttttggtgtgcgaggattaaataaattagcacatgtgaagcatttagaatggtacctggcatgaaatacatgttccatgctctatatgtgttagccattatgattattaattgacaacctattaggtgctagctgctattctgagcatagggaatgtaacactgaaaaaaatcagacacaaatttctgcctgcataaagcttgtattccagtgggggaaacagataataaacaaacaagtaaatgtatgcaaatgttgcatcgagtggtgttgagtcccatggagaaaaataaagctgagaaagggggatggaggaaagtgtaggtgggtgggagtgtgtgtgtgtgttgctgttttgaaaagggtgatcagggaaggccttgctgagaaggtgatatctgagcagagatctgatttgggtgtgtatgtggtggggttgggtgttgggggttgtggttttgggagtggcatgtggatgtccataggtatctgatgtgcacttatatgtgtgagtctgagtggccaaggttttgaaccaaaattgtttctttatttgattagtgtcctttgtgatccattactaaagtattatcacccgatcattagaataaaatattggatttcgatttgattgaatggttgattataaacgtatgttaagcactgcagcgtgacaaacttgtacctctctttcagagatacctgccatgaactcttaggtcatgtcccgcttttggctgaacctagttttgcccaattctcccaagaaattggcttggcttctcttggcgcttcagaggaggctgttcaaaaactggcaacggtataaatctggaattagctatattttcacctggggtagggtgtatgagtatctgtgtagtttaaaagtacatattcagaatgaccattagaaaatttgtctttgcttggaggttgcagtgagccgagattgtgccactgcactccagcctgggcaacagagagagactctgtcagaaaagaaaagaaaagagaggaaaggataaaaaagagaaaagaaagagaagagaagagtaaagaaaggaaaagaaaatttgtttttgctcataatctttaattcaaataacattaaagaaggatgtaaaattttaaggtttatcaaaaggagacatgagctttaaaaaaggtagagaaaaacaagattacaataataggttatctatcttttattttccaataaaaaggataggtttccttaaaattatgctaaagtgtttttgagtactaggtacaagacactgtgctggaaatacaaagatgagtaaggcctggtttctacctttaaggagcttatatactgtttgaggagacagttatgtcaaatgagatagcctatagcaaagttcacattgctctgggagcatagagaacctggggaaggtttcctgggagaaggacatctggattagctgatggaaaatgagtgatgtgctcagcaaggaaggaagaaatgcatctcaggatgagggcacacaaggaaagacaaggtggtgcttggtgtgtctggggaaacagcaagaagctggagcagagtgtccaagagtgagggaggcagcgtgaaatagaatagtgcttctaaaactgtggtttggggacctctggggtccctgagactcttttatggggtccttgaggtcaaaatcatgcctagataaaagatccattcaaagcacacagtggattttaatgtaacaggcagttcattgacataattcagattccacattgccgttgaacttttgagaaactctatccacttgttgagtcttcatgcagagtaaaaggagaatatccacaactatccaaaaagactgttaagatattcaatgcttttctaactagataaccgcatgaagctgatgtaactcatgtactcaaacagtatatcccaaaaggttaactacagaagcagacacgagactccatctgtcttctagccagacattaaaaaggtttataacattgtgaaacaatgctacttttcttagttttttgttttgtataatatagttatttgtattaaaacattctttgttaccataaaatgagtttattaaattttaaaatgaattagcaagcattttcctctcagttttaatttttaatatggctaatatagctagtgataacctacacatacacgcacaacaaaagctttggggtcctctaatttttaatagtacgtaaaagtcatcagaacagaagtttgagaagtactggtttagaatgaggtcagattgtagaaagacttgtgaactagactgggattttggactttattctagggtattttgggtcagtgactaagaattgtaatttgttttaagttgaattcgtcagtgtgtgagaataatattgatgttcttttgcagtgctactttttcactgtggagtttggtctatgtaaacaagatggacagctaagagtctttggtgctggcttactttcttctatcagtgaactcaaagtaagagttgcaaatctttgtatataaccatattcacctaacataattgataaaacctgaaatagtttttgcttttgaacaagagcttactatggaacatacttggggatgtcactaatcattacctgaatgtatttttctctatttcccaattatatattatatcatataatccaaatatgtgtgtgtgtatatgtatagatagatagatagataaaataagaattttataagggcatttatggggaacagcaagctacttcttttgctggagtatactgtgggttgaatagagctgtggaaaataagtttggaattgtaggttggagccattgcattagtaatacacacacacatgaaatattttgatatatttctgatatatatgaaatggtatgtgtatattttaagtaaaaactgttttaaaatctttgcttacaaagtcttgctgtttcctcatcatttctgatatgctagcaataacttctataatttctagggaattctttgagatttattatttattcaatgaataaataaactcaagtttgttgagtaatgaatgtgtatgaaacaccatccaaggtactgtcttgctttcagggagcacttgatggtgggtatataagtcatacataggaataactagtgttgggtagaaagtaggtgccataatacaggaataaataaataaagatccttgggtgccttttacacaaagaagagaggaagaacaaagccatggagaggatcttgggggtatttacagggaagggcaagccattttttttgctggagtgtactgtgggttgaatagagctataggaaataagtttggaattgtagattggggccattgcattagtaatatgtttagaggtgagccaattatggaagttgcatgatctatgaaaaatagatattattctttgattcactgactctttgtcttctagcatgcactttctggacatgccaaagtaaagccctttgatcccaagattacctgcaaacaggaatgtcttatcacaacttttcaagatgtctactttgtatctgaaagttttgaagatgcaaaggagaagatgaggtacagtatatcttcttcacgccttcattttcttcagggaaagatcagccccattatggtaacaagtcacagaagtaagcagctagataatttgaagcccacaaggagccttctgtctgtaacacatcttcctttcataacaagtatctagagtatgttgtatataaggattttgcatagttgcaaatatgaatcagatacattgagaaattgttttctttccaattcttccagtcagagagtttagtagtctaatagggaaaatagatgatatgcaaattactgtataacaacatggaaaatgacaagagccttggagagatacagatgaaacattgttctgcattttattcaagagcaattcatttcaggtggacaaacagggtaaccttaatgttatttgagaaaggacttgaaggataggtaatatttagatatattaagttttagactgagagttagcatgaaaaaaggtcaggatgttgagaaatataggagatatgtacaatgtaatcaaagctacgctttattaatcagctaagtgtgtggttaagaaaggaggatattggaggcagagaaactttttagaagattcttggaacacttcaggcgaaaataaatgcctgaactaagacagaagtagtaggaaaagaaaagacttttgaaggagaatcaatgagacaacatttagtggaagcagtcatgaggtcacattgtgatgatggagatcgataggggttgaagtcatagtccttgtctttcagagaaaccattagttggggagttaggccattcatgaaaccaaataataatactagcagggattcctctagcataaatgtcaactttttagaaaagggggtcccctctgtagaccaggtggattatgagttggatttcagctgctactgatgtatagttgtcctcagcttcacatttatccctaggagtcctggacatgattgttcctgggggtgccaaatgagaggttcaaacagtgatttgataaaggaggcagaactttaatgcttgaaaaaggggcagaatttaggtcatttgaaaggggcctagagggaaacattctaagcagaaaaaatctaacatgtgcaggaggtaggaccattcctagtctattttggggtgtgtgagtatgtgtgtgtgtgtgttatatgttatataaacacacaggttacatatgtgagtaggtatagttatataaggcatgactgagggatctgttactatgtggttaagtgttgtaatgaaacagttttacgtctactgataaaactacagtagttggtctccttactgtagtcaagagatgtatacagtaataaatgattaagaaatccatctatgggatctttccctagtaataccagggatttacaactactttataatgtaaagtacttataactattttataactacttcaggtttcccacttgtgtgggattccaggggacctctgcaaatgtagtgtagagaagtaggtcagattggttgtacacatatctaacaagaatttgttttttgcctagtatgtgaaatatattctgttgtttgtttagttttcatcattcactccctagaaattgattgtctcctatttgttttcttaaatagagaatttaccaaaacaattaagcgtccatttggagtgaagtataatccatatacacggagtattcagatcctgaaagacaccaagagcataaccagtgccatgaatgagctgcagcatgatctcgatgttgtcagtgatgcccttgctaaggtcagcaggaagccgagtatctaacagtagccagtcatccaggaacatttgagcatcaattcggaggtctgggccatctcttgctttccttgaacacctgatcctggagggacagcatcttctggccaaacaatattatcgaattccactacttaaggaatcactagtctttgaaaatttgtacctggatattctatttaccacttatttttttgtttagttttatttctttttttttttggtagcagctttaatgagacaatttatataccatacaagccactgaccacccatttttaatagagaagttgtttgacccaatagatagatctaatctcagcctaactctattttccccaatcctccttgagtaaaatgaccctttaggatcgcttagaataacttgaggagtattatggcgctgactcatattgttacctaagatccccttatttctaaagtatctgttacttattgctgaatttgtgccaagctcaatcacattcacactaaaatttaacaggagaccctgctgtctttgttgctagcatgagcaaaagtatagaggcctttgcacatggaggatacctagtaaagagcaagtagtctagtttcaagtgtagtatcttgtagggaaatgggagtagctaagcctggaaaggttgaatggggcataatcattaagactaggctaaaaattcgagactttattttttaggcattagggagccccttcccaagtgactatcttccttgaaactttgttttctttcaatgacatcacacgatactggttttattctggactatctatcctactcatgggtccaagggaaacttagtagagatgcgacttgcatggggctgtactcagacatgtggtcctaggtattataatgggattgtccccagattaacaggaagcattgttatcaaaggaagagttcaaactgagatagataagagaagcacaaagtaaaagatagaaaaaacagtgctgagtactttatttctaaggtataaggtgaggccataaacagaaaggtatgcaatgagagtagaggctgcagaaaaggggaggaaatagaatgtcagaaaggtcaagaagagtggtttaggactgagactgtaagtaatgtaaggattgccaaggaatggtttttatgcagagtcagctgtgtagcacagggagtaagcagtcctgttataaatgggtgaagctgaactccaaaatacaaacttatgtctctttaatttgcccctttcctccctctagtcactaaatgaagatgttcttcaagtttctgtctttgcacttctactctttttgccatctcttcatggggaatgtcacccagatacatgacttcagttcttattttgaatgactcctctatttgcagttataaccctgacatctttcttgaatttttttgccccttaattccaacgaactcctggatgtctatgtagatgtctcataatttaggccaatgctgtacaacttcatgtggcatcatccacatagaatgaataggggttgttcaatatgacagccctgccaagcatctcaaattgaacaggtctataaaggaactcagaatcacttgaatatcacagtccatcagcttcctttcccagtaatttaatttccattaatggtatattaaacatcgtattttcaatcatttttaggtttagtcagctacttaaaaataggctttttcttcacataaataaattgtataccatttaatgtgttttatttcaacagactaatagatcttttaacacttcttagtcctcaaaataaattattaaaaactttgtatttcatgtcatattatataaggaaatagaattttgaagaataattcatgctgttttaaatttttacattgtacattttaatagctaatcaactcttaagtatacatttgatggtaaatagatgctagctaatctagaatcatttgaaatattgattatctgatttatagtttggttgcaaggaaatctactgt

SEQ ID NO: 17127 - DNA, 228896 bp, Human
  misc_feature (1)...(228896): n = A,T,C or G
gagaaaagttctttttggtctgatactgttgtgaattgtcatcagtgctttctgtactttgtaaatattacatgctgacattttcttgtgggcattttggaagaccttcccaccttcttatttcttgggatttcttgatgtaggtaaatgtatctctctgggctgttaaattcatttccctcaccctcaaggaatctagtgatcgactgtcctgtgggtgtcacttcacccttccagaaattctcttggacaaggtctaagaccatcccccagccagtttgctcaggtatgggaaatactcacatgggaaatggacagtttttattttgaaaaactgtgggtgtgaaagacctccccaaagcatcagtttgtctttgctcagctattagagcagatatccagccacaagcccttgtatttctcagaacggattggacagaagcctgtctgggtcctaaatctagagggatgcataccaagctctctcagggacccaggtaaagtaactttccttagacctgagatgggttgagacccacaccacattgataattgtggccacatatcctactagaattctctctggcctctcaacctttttcgtagactgaaagtcatacactggtttctagacagttgctttgcaagacctgctttggtggtcttgaaccttactttatgatataggagtaactggcacttgttgctcagccaaaactgagcggtgaaggatcccatttttacatcctgttacacatgcttcaaagaaatggtcagcacaaaaaagcccactcataagacagtcagtaagcatggtatagctcctgcacattcagatccctagagaatgaagagctgttttatctctccaaagtttgcttttttcttggtatggtcatcgacgttctccagatgccacaggttggagagataaaggtgaggggctgccctcaagtggtcttacaggcagaaactcctaaaagtggatggagtgaaagaacaggaaaggacagtgtaagagctcattggagacacttcccagaagcccaggggtgaagggcagtgagtgctggaggcccgtgtcagcagaggggccaagtgctaccgaatgtgaatgtggatgatcatctttaatgtgaccctatgtgttctgtattcccggtacgcggtgccatattttccttcagataaattgaacttaattaactcccatcagcaacacgacgctgtctgagaaaagccattttatatggaaatgttcgttgggtgacgattatccagtattattaatagaatgagctcagggccgtgcccggagcgccgaggctgccccggcaggagtcgacgctaaccagcctcccccattcagcgtcgcgaggcgcgggttcccgctccgtgccaggtgcagagggcgacaccggcgacgtgccactccactcgcctcccaaggcgccccctcagatgtttgcgaacgcacaccaaagcgggctcaagacaattgcgcctgagacgccgggcaggaccctgccctacccctcaggctccatttcctgttcccgcaaatggtgatgccatcgctgccctgtcagcccctctgggctgtcgtgggcctccaaggagacaaaaacgcgaaggagctttgtgaactgtggcgcgcagtgcacctgcatgaaacatgaaattatgactaaaaataaagagtacgagggggtaggagcgagaggctgagaggcccagcgagacaggaggctgcgggcggagacgctgcgagcgccgccggggcgggctgactgggaggcggctccggggctgtcgtccggccccgcccaccactgatccccagtggcccgagggcccggccgcaccctctctcccggcctgcgggccgcttcccaccacagaccccgccccgcgccctacccatcacgcgtccccggtccggctccggcgctcacctacccccggcaggcgccgcccccgtgccgtccctcccggaagcgccggcggagcgtcctcgcatggagcgcgagcccagcgcctcggaggccgcccccgcggcggccgcgctcttcgcctgggtacgtgactccgcccccgggccggtgcaggccctgaggggcgccgagatgtgggagctgctggccgcggcgtgggcagttcaggggctgggcggctgaggtccgagccgggctctgggttgaaggatcctgggctgggagcggagggggagcggaggaggagcgggcgggcggggaaggaagggtcttcgcggtcgacttaggggcctgccggctggcggggtcagggccggaggggctgtggcgccgcgggaagaacctgcctcggggcagagcgtctggttccgcgagagccctccagcccgaatagcgcctggaagacagcgcggagggctcggtggagaggatcgcccggtcccagagctccgtggggccacctgtgccccccacactcctgatgcctggaggagggagaccctgtcccagcctggcgaaagcatcctttagatgtgaggcctgcggtgtttggccgcgcacaaggcacagaccctgcctatttgctgacactctgctgtgaccggttcttgcatgtgttgggggagttgggctgctgttggtttgacgggagcattgggagagacagggtcatcttgatgtgtgtctgggagagaggagggttcatgcacaggagcgtggcaggtggccgaccagcatgcacgggaacaagcagtcgctgcgtcttgtgcttcttcatagcacgtatcacaattgtaatgatgtgtataatttattattaacgtcagtctctctggctggaaagtaagtgtggtaagagtgggtgctgtgcctgtcttgttcacggtgcctctcttggtgtctggcacattgtaggtccccagtaaatactcgttgacgaatgaatgaacgagcatctgtgtgcctacccatgtgctggtgttggggaaatacacatgagtgaaatacacgagtgaaggacttccagctcttgtgttgggggagagcaaaattataacctgtattgctgttaaaatcagtattagttgtccaatttttaaagaagtaatgatcagtacaaggcggcaattgttgaatgtggggctgcaatttggcaggagggagagcatggcgtgacctgcggtagtctggctggctgggcgtctttgaggtggcccgggagctgggggtggagttggggattgaatgtgtgctgtctctggctttttccaggcaggagactggcgtctgtgtggacagaggaaacagaaatattgtttcagtacagacaaagccgaatattaaaggttgtaaaatatgtttaataggttgttgacacccttctgctgtgtttggaggactggtagtgtgtttttcctgctgtataatctgaaactgtgggggtgtgttggtcggctagggctaccataacaaaataccacacaacagaggcttaaacaacagaaatttattttctcacagttccagaggctagaaggccaagatcaaggtgtgagtaggtttggtttctcccgaggcctctctctggcttgcagatggccgccttctcactgtgtcctcacatggcttttttcactgtgtcctcacatggccttttctgtgtgcgtgagcatccgtggtgtctcttcttttaaggacaccagtcatattggattagggccccacccttatgacctcatttaaccttaattgcccctttaaaggccttctttccaaatacagtaaggtactaaaggttagggcttcaacacgtgaattttgggggaataaagttcggttcacaggaaggggatttaccttgttaggggtgtgtgtgtgtgtgtgtgtgtgtgtgtgtatgtgtgcatgtgcacgtgtgatatgtctggagtgtttgtgaggaagaaaggcaaacaacagttgtaataggttgtgttaaatttcccttcgtcttgctttatcctggatttagggcctctcacagtgttacaaaaattggtaccgtaatttgaacctcagagtgcccatgtgtcatgttacttttctcccaggtgttcagcagccttgcacccctggtaatgggacagccacggagatctcagggctgaccaagaaatcctgtgcatatatgctctatattccccttcatgctgagcaagtctttcatagggtcttacattcattcgccatataaatatatgtacatcttctttgggccagcacagtttcagatgcaggggaaacagcagtgagcaaagcagagttcctgccctcctggagtttagtttctggcaggggtggtgtacagtaaacaagtagtcatatataatgtaacatcaagaagtggcatgaagaaaaataaagcagaaaatgagtgatatggggatgctcttttagataaagtcatacagttaaccacctgtcaggtaagctctgggctgcttcactgtatgtcctttttttattttttctaagagacacagtaaggtatagtaaaaggtgcagggcatcagactttttgcctacccagatataactatggaaagttacttaacctctctgagccttagtttcttcctctgtgaaatgggagtaataatgtccttcttagttgttgtgaggattaaaggtgaatgcacagtatggagagaagcactcagtaattggtagctaatattgccccctgtgggcttctgggacttatgcccctgctatggcttactcttccatctttgagtccttgcagcccaggatggctgtgaaatagactacaaggggaaggattatgtatgtatgtatgtaagtatgtatatatgtatttgttgtaattattttacatcacctttcctcattcaggtgtcttcaaaaacaaacatatttaaaagattttacttctcatctccaggaagaaccagctaggagtaggtacttgaataaattataaagatttctgaaatcttagtaagattctctctgcaggtccacaatcccttgtcttcaattctgaatacaaaaagctctgaaaacccaaaacttactggacataaggccatttatagtctttggccacttcttatgaatatttgtactttgtaatgcagaaatattattgttttgcttatgggctgctgtccctggaccttgcatcagtatatatgacatatgtactgtattacttttctaaaagctgtaaaattctgaatctgaaatacatctgactgtaagcatttcagattagggattatggaccctttttgtataataataataataatagacatattgcctgtcaaggggaaatctgtccccttactggaatctcaccatgtgaatcttggagtcacatagcactgtacttggaaagggctttagagatcattgccagcctctttcactgtacaaatgaaataatgacgtgccttgctttaaggcaagaaatccttagccagctttgattccagagtcattgttggttttcccatcatgggtgtggggaggagaaacaagaactaattccaggatgttgccctcccattttgatgccatttctctctcatttttttctttccttagcttccctaggtagttagcttttatcagaaggaacccctgtgctgtctccaaaaggcagtacctgggggctggagcataagaagggaaagatgaggaatattactggctgagttgtggatgcctaggactcttctcatatcgaaatcatggtgttctgaggatggggcctccatctaaatatgggagcatataacagccgttaagaatgagcctaacaggtcatttcctctttggtcagtttcccacttgacaaaggaagggtaagatttacattcccaaatgctccagagtccttctggtgagcgaattattattatttttcttttcagattttggggaagggatttgaggagggaagaaaggagatggggtaagagtgtttctaagtctgaaactctctctgtcctgagctgttcccgtggttactcaaggacaaggggagacagttttgcccacagctccagagacacagataacaaaggaatgaccttcatttttcttcaggttggaccctgtaggggtctgtgagcagcttctcctggaactttgtttggattctgtgtccatatttataatttatttgaaacacgctggatagtgttctcatttgggggctgaagttcagctagggaaagcagtgaggtggcatgggtgcaggaggagggggtaaggagagatacgagatacacctgccaacgactcgtagcccagaactctctctagagaagagaagcccctcctcctcaagaggctgtcttgttctcagtcagaagaaccttgatttaggagatggcctctcttttcctggccattctaagaggaaaggccattttaccccattacctccagagggttgggctaggccaaggacctcataggactcatgtccccttcagccatggctagcattgctgctttgccttctggggcctgaggtagaaaaaagtgtggtttcttcagctgctgcaggaggccaagcagggcatttgtcctttgccccagtaaattaagcctgccagggtgcctacctaggaactttcctggacatgaatttcctccactgttatggtcatgagtctctttctaatgggattacagatcaggggtggggagacagtgttacctgttgttttctggtgcttgttattatatatttgaataaacagtgctgtgagtatttgccgtgaaggagctaaaaatttttttttaaaaaagaatgagcctaataaatctcatctgttacagggtctgagagatacgtcagggtgagagagacagagacaggtaaatagacattgacagttgtggttcccacactttttcatccttggcttattcatccctagggtgcaaatagctatgggcaacttggcctcggccataaggaagatgtgctgttgccccagcaactgaatgacttctgtaaacccaggagtgtcaggaggatcacaggaggagggggccactctgcagttgtcacaggtaatttccttcaaaagtagatagtcactcattttcttatttagacgttttcccctggatatgatattgccatctttcagccttttgtattttgcagaggaaaataatgtatttttgtgaaacatttttgtgaaagagccaaattaccatcagaagatcctagattttcagggctagaaggacttcagagatcttctaggccacccctttcccccaccccctccattatacaaatgaaactcagaaaggaacactgattgcttaacatcacaaggcaaagtagtggcagagttacaatgtatattttacaccataggaattagaagtctttgtaattagattggatattccttgagagcaaaaactgtgtgttccccttaatcttcccttactgtatctaggatagcacttaacaagtagtacaagtgctacaatgttgtaaaggggggcatattgcatctggttgagaacatgagctctggaatcaaatctctgggttcagatcctggttctgtgacttattatctatgtggccttgggcaaatagccacagtttctgaatctgttacatgaggataataatggtgggtgaagagaaccagtgagttagcagggctccattccgactgtcatgggtcgttggtgcttttccctttatggacctcttcctttgtaaagaaaaaaattatattttacaactgtgttggtataaagatggatattaatagaatccactccagatttagtgttatgtatgcattgttactatattatctttttctcatttaaaaataactaaaaattaagccactctgtgggcctctgaaagcattgtgggccctagacactgtgcctaaaggataagtccgctctgcacaaaaagctcttaaaacagtacctggcacgttctcaatgttgaataaatgttgttggctttttgttccagtagatgctcagtttggtgattgattgaccactgcgccaagacttgaagtttctctgtaggtattagtttgaggcccttggccttgtgttgtttggctccagaatacatgaacatacacagcttattaacttggatggcaaaaaaagttattggtctgagagtccaaataattagtgaaatctttttgttcattttgcagttgtgttttttcctgtgcacgctatcactgatgcctttatattttgcagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacaggtgagttcactcctaggtagatttttgtcaccacaaaggctttgggtgagaacagtatgatgatggtgactgcagattaaatgaaagcctctttgtgtttaaaaagcacacataaggcctggtgcggtggctcacaattgtaattccagcactttgggaggccaaggcaggtgtatcacttgaggtcaggagttcgagaccaccctggccaacatggtaaaaccccgtctctactaaaaatacaaaaattagccaggcgtggtaccccacgcctatagtcccagctactctgtagtcccagctatttgggaggccgaggcaggcgaatcacttgatcctgggaggtggaggttgcagtgaactgagattgcgccactgcaccccagcctgagcaacagagcaataatccatctcagaataaataaaaataaataaaaagcacacacaaattttccctctggttgtcaaggaaagttgtggactaccttttctaaggagagtttaacggtaaaggagactgggattggggtggaaaacttttgtcagagagtagggaatagactagatcacctttggtggccacttcctgtcccaaaagttcatgatagctgtgtgcttggggtagctggccagtggccagcagtggcagcagagggttacttacagggaatgtggtaggagaatatgaggcaatagtggttgccaaagcagtgatggcagctttttcacactgtgggatttttttttttctaaatgtgttaggcagatctgtttggtctttgtgaagccaggtagcaggataggatatggccagagggttattagagtaatgcacttgggaacagccagcagtagttaccttgtcagctgacgtctgttcccttgaagcagttttgacctctctgttcagctttgctctgtctagctggccattctggatttaaaggaccatctgtggtttctgaccaggctccctctttgccacggtcctttggcaagggcatcttctgtcactctcctgtcataaacccttgtggattctcccagacatagctcagattcctagctttttagcgttggccttctgtaactgttccctagctatctttgtgctgtgtctcttattctccacactcctcatacttttctttctggtcataccaagcagtatatgttcttctgtctgtctggaccagcccctcttgtctatctgatggactcgaatcccagctttaaaaccctgctcaagtgtcaccatcctcctctgtggaggggttctgtaatatgtgttgaatttgatggtgattattagaatctaaacaataactatcatttataaggtgtttattgtgagcctatgttttggattgtaaggagtcagtagataatgctctttcctgctcacatttggagccagttgtgagaaaagcacagagaagtcagtattggagattaaaaactattggcttttcactggtaaaggctaaattggaggacagtattaattatgaggccagtggtcctaatattcttctggtccaaacttacccccaaatctctaggctttccccacagggaaatgcttcctatgtgtcagcctagaatgactgagagggaggtgccaagccacacatgtcctgtcccatctcctaaactcaccagttggttacatgaccactgtcccctagaaagcagtgaggatggggaagggcagggagaaaagctggagtgttgttttactaatggaaattttgtcacatggaaacatgaaaaatgaaaaattactatcctcccatcccaatacgaggcactgagttaagtgttctacacagataatctgttattaatgagagaatagaatagacaatctgtgtagagtgcttaacctggtgcccagtgttttcattcctagaggaataaaagcagggaatatggtctgaatgcactgaagcacttcccctcatcccctttgcatctctcaccctgcagcatttacccattggtcacagacatcttacttcatagatttgcaatttaagtatttgtattttgcagaaaatggtcaagttctatcatgtggatccaactcctttggccagttaggagttcctcatggacctcgaagatgtgtggttccccaggccattgaggtgaggacagttaatatttagcttgcccatgacctgttaaagtgtttccaaggtattaacctatctctccccagaataaaaggctgtcaggatccctgagaacccatggagtaggagaatttgagttgaaaaataggtccttctgggaaaaattaagttgggaggtaaacgttgtgaatgaaaacctctgttagttttcatacacttcatatgaagttttgtgaaataaaacaataagagtaatacatctcataaggatattgatgacattttacagttctaaaattagtaataatggaaattatgttagaaataggtccagatagaagtgatttgtcgaaagacactaagctaggcaaatggtataggccagtgctagccagtagaaatataatgtgagccatatgtaatttaaaattttctagtagccctatttaaaaaagaaacaggtgaaagtaatttttaaaataacagcattattgagctgtaattcacataccataaaattaacccctttaaaatgtatatccacagagatgagcaaccaatatcattatcttattttagaacattttcattaccaccaaaagaaactatgtacttaatagcagtcaattcctattctcccttcccctcagcccctggtgagtactaatctactttttgtctctatagatttgcctgttatttcagcatgtcatcagtataaagttattttttgtttttatttttatttttgagatggagtctcactctgttgcccaggctggagtgcagtggcgcgatcccggctcactgcaacctccgcctcccaggttcaagcagttccctgcctcggcctcccgagtagctgggattacaggtgcctggcaccattcccagctaattcagtataaaaattactaacaaggtattttatactgattttgtactaagtctttgaactctggtatgcattttttacttacaatatgtctcagtttagtgtaatcacatttcaagttttcaagagctatgtgtaggtagtggctaccatattggacaaaacaagtgttaaacaggactcttggctctagttcagagctctttacttcagtgcatcatacttaaaatcacccctttttgtgaagtttatattgtaagtgatcataataggaatatagaatttttaaagaaatatgcttgaatcaaaaatgagttttaccacctaagctgtcccactccgatctaatttccctaaactctgattaatagtgggagatgttttttccctagagaaagcttgggtctgcccctgccagcttgctgaactcagttgttggtctgtggactgttatttcgggtcatggttcccatggtatgcacaaagtctaggctctgtagtccctgaaggaagtattatagctcccaattgcaaatagatggccttgtaagcacctacatataagttataattaatttagcttaattatactttatataattaaggaatagaggaacaatggttaaaatatgttggttgacagaatcagagagtaaaaacattttgacaggtgacattctatgcaacaataggagcaatgtgccaaagagaaatttaatagaaattcattcatttatttaatgacaaccattatgtgtaggtactatgtttaggcagtgggagcaaagttgaataagacctgtcctagcagttgagagttttatagtttggtaggacatgataggcacataaatacttaaatgtaataccatgtcagaactatgacagatgcatgtatatccccaaaggagggagttttgagcatctgggggaaggtggggtgagaagaggcttaagctaggtctcaaaagttaaatagaggtttacccgtcttgggataggaggatgctcagagtgggtgcaaaagaagaacattctaggcagaaggaaccatgtaagcaaaggtgcaacggaatgaaacaggagagtttgggatatcgtaagtagtttagtatggttggaatataaggaagaggttgaagttccagggtagagtgggtgggaatggggcaatcagggtggttgtatgtgacacatggtaagaacaacatggtagggaggtcagataggaagatggattgaaggaaggttactgaggaaactcttgctaacaatccaaatgaaacaattgtggctcaaactaaagcagcaacagttgggatggagagtaagaggtggaggtgagtggtgttaaagagactgaagtcacatgtaaagcccttcagttagttttttggggaaaaacaaaagaaaaatataaaggacaatatgttcaaattgtattaacgctaagatttgatcttctcgtaagctaatgtgattgtggactccattgacagaagtatagtttccagaagaaggaaggccaaagctcagccctttctgctgttcagcctgcatctgggatgttgtgttttgttgtggatttggtgcttaggccctgggcataaaggtatataagactcaggtcctgcccttgagggtcctaaagtttagaaagacactgtggacctgtaaataaacaaatgtgataagccttaatggggttatgattatgctatagagttcctttaaaagagaaagattgaacaactagagcatatttagagaagtgaagaccaggaggggaagggaatttgaaatccagtgatggctgatgaatgggggatatttgctttgaagaaaagatcttcattagttatctattgctgtgtaacaaattactgcaaaccttagcagcttaaaacagcaaacatttattatgtcacagtttcggagagtcaggaatttaggaacagcttagctggtctctcatgaagttacagttgagatgttagctgggtctgcttgcaatctccgtggacctgtaaataaacaaatgtggtaaagccctaatggtttcatgttccttgccatgtggacctttctattggacttttcagacatagcatctggtttcccccaggagtgatgagagagagagggagagatgctcagcaggaagccttagtgccttttttcgcctagactctgagtcactcattgctgctttattctctttattaaaagcatgtcactaagtccagcccacacaaggggaggggtattaagctccacatcttgaagggaggagtagcaagaatttgaggacctatttttaaaaccactacaagatgtcttagagaggacatgacaactgtcttcaaatatttggaaagcattgtcagaagctgcaggcagataggtttggttccacctaaagagataaatggaactgtgcaaaaatggaacaggcacctggggaaatggcgatccctatgtcactgggggtaggtgtttggcaggagttggatgaccacttggtggggtgttgttggatggagattggactagatcatgttgggaaactttgagcccttggtaaataaagtcttactggcacacagtcatgctcattcatttatgtatagtctagagctgcttttatgttacaatggcacagctgagtagtgtgacagaaactgtggcctgtaaaacatttactaactgtccctttacagaaaacatttactaactcttggactagatgaccttagaagtgcctcccagccctgagagttgttgtcatatggtattgtgatatggtattttaaaagatatatttttttcttttagggataaatgtagaggtattaatgggtggaaatattggggggagtggttgctttaaaccagtcagacccataatgaggaccgtactgcattgtatttggtataaattacataaaattttgtagatggatggttctgagatctaaatccttttctttattttgacagctccataaagagaaggttgtttgtattgctgctggactgaggcatgcagtagctgctacaggtgatcatcttatctttatttttttatttttatttttaatactttttagagatggggtctcactctgttgcccaggctggagtgcagtggctcgatcatagcttgctgtagccttgaactcctgagcccaagctgtctaactgcctcagcctcctgagtagctagaactataggtgcatgccaccatgccctgctaatttttaagattttttgtagagacagggtctcgctatgttgcccaggctggtcttgaatttctggcctcaagcaatcctcccgccttggccttccaaagtactgggattacaagtgtgagccactgtgcccagcctgccctccgccttttaaaataggtctgtaataagaggaaacttaactttaggagaaaaaccatttaggaaatatttcaaagggtcctgctgcattgtggttctgatgaaaaggagagaacataaggcagaagtcatgtaggaaagacattagcaggtagagaggaaggaaatgaagttttctagctctttgtgttctaggtatgatgctaggtgctatttatttgattactttatttaatcctcacaaccaggaagtgatgcgagttacattttacatgtgaagaaactgaggcacagagttaaagtgcttgtgtaagcttatacagggagtaacgtagagcttggatcagagcctgggatggtttggatcctaaggctcatattttttgcagggaactgcacagccttcctaatggattttattgtttattaatttaaaagctttaagtgagcttgtctcctgtactgtgagtgggtgatgggactgacagtctgtgtgtgagggggacagggaggtggcgtgtgggagaatggtgacccttttatctctccccttttcattttttctgctcttactccttttgaactgaaggacagcactaattggctgtggcagctgaggctcaggtgcttcgtgagtccacttgtggagtggaggaaggagagaggaggtgaggaagagctcaatgcaggactgtgctgatagtcctgggcttagcattgattatacttcaaaaaaaattcaactttttattttgagataattgcagatgcacatgcagctgcaaaaataaaacagaccctgtgtgttctctcccggtttcccctaatggtatcttgcaaaactatagtacaataacataatgaggatattaacattgatacagtcaagatatagaacagttccattaccacaggaatccttcctgttgcctttctatagccacacccatttctacctgcctataaccacttcttagccctaggctaagcactcttctgttctccatctctatgatgttgtcatttcaaaaatgttctataaatggtatcatacagtatataaccttttgaggttggcttttttcattcaacataattccgtagacattcatccaagttgtgtatatcagtaattcattccttttcattgctgagtagtatttgatggtatggatgtaccacagtactaatctgttagggctgccgtaacaaaataccacaaactaggaggctgaaagaacagacatttattttctcaccattctggaggctaaaagtattaagattattgtgttgtcaggattggtttctcgtgagttttttttttttttcctggcctgtaggtgaccaccttcttgctcggttcttgcatggccttttttgggtgtgcctgtggagagggagagatttctgatgtctcttcctttttataaggacaccagtcctattagattaagaccctacacatatgaccccctttaacttttattgcattccatagcccctatctgcaaatctagttacagtgggcattagggtttcaacaatttcaacatctgaattttagggggatacagttcttcccatgactgtatataaatacacacatacacatacacacacacacacacacacatataaacatatatatatataacacacacactcacacatgcatatatatatatatatatatgtatgtatgtatttttaagatagggtccccccctgttgtccaggctggggtacagtggtgtgttcatggttcactgcgacctcaaacttctgggctcaagcgatcctctaggttctgccttccaagtagctgggactacagatatgtgccaccacactcagctaatttttaaatttttattcttgtagagatggggtcttggtatgttgcccaggcttgtcttgaactctcagcctctgacagtcttcctgccttctcctcccaaagtgttgggattacaggtgtgagcctctgtgcccagcctgaatgaggtctacatattgtaattagttgatatgtatcacaagtctttctttctttttttaaaaaattatttttttcttaattttatcatggtaaaatatacgtagtttacagtttattatcttaaccatttttaagtgtataagtacattcatatcattatgcaatcaccaccaccatccatctccagaacattttgtcttgcaaaattgaaactctatacccattaaacaataactccccattccccattccactggcccatggcaatcactattctactttctgtatctatacttttgactactgtaagtctctcatctaagtggaatcatacagtatttgtcttttttgtgactggcgtatatttcacttagcatgatgtcctcaaggttcatccatggagtaggatatatcggcgtttagatactttttaaagtggataatatccattgtatggatatatcacgttttgcttaccattcatctgtcaatggacatttgagttgcttccatgttttagctattgtgaataatgctgctatgaacatgggtgtacaaatatctcttcaagatcctgctttcaattcttttggatgtgtacccagaagtgaaattattagttcatatggtaattctatttttaattttctgaggaactaccatactatttgccacagaggttgtaccattttgtttccaccaggagtgcacgaggttccaatttttccaaaaactcaccaacacttgttattttctggtttttaaaaatagtagcatcaaaatgtgtatgaggtgatatctgttttcatttccctgatggttagcaatgttagcatcttttcatgtttttactggacacttgtatatcttcttggagaaatgtctattcaaatcctttgcactgcaccctcctccctcgctttttttgttgagacagtgtctcattctgttgcccaggctagagtgcagtggcgtgatcttggctcactgcagcctccaccacccaggcgcaagtgatcttcccacctcaggcagctgggactgcaggtgtacaccaccatgcttggctaatttttaaattttttgtagaaatgagatctcactatattgcccaggcttttctcaaactctgggctcaagcaatcctcccatgtcagcctcccaaaatgctgggattacatctttgcccattttttaactgagttgtttcttttggttgttgagtttttggagttctttatatattctggatattcatctcctgtcagctatctgaagtctcttataaagtttttcctctttttttttttcctctcgaagtcaatttgttgaagagattgtaagtttttatttcaacactgtgctttgctcacattgtgctcagtggtcatagcttatttttcacaaaacaggcttgtctgtttatagccttaaaaaggactgctgtttataggatactcccaaaggagcagaaccttaatgttgctgttgggtgatggatcctagtttcacacacctgagtgtagatcaaatatctagaatttcatatttgcatttgtatgaggttcagaacataggtacatgaattagattcagtgggcatgaaagtaaaaggccattccgctgaaatcatggctattaagaagctatcttgcagtcataaatatgtatttacttggcaattaggaatctttgaattcatcttggtgtcgtggaaagggcactacattaggtgttaggaaagctgagtcctggcattttctctgctgttaccttcctgcctgaggagacaaatcgcatcctctcttcagggcctcagttttctcatctactgaatgtgaggaatggatttgatgatcttcaaggttcttttctgctttgtctgggatctgagttgtcttttcaggttaatcatgaataaggtgtcattccactgatttgactctgaaggagtgtcctggaactttttgtaggaagttatgtgatattggaatttgctttgatggtcttagtctgtcctgaagactggatttgtgattggcttggtggtaatccctgggccagttacaggacctcttgaagcaattgagcttctccataacactcatattaactgagaaagaattgggaatttctcatagcagtgaggttcaaagggcaatctagtcttatcctgatgtgcatcttctctgctttctcttccattctgttgggaagcgagtggcatcgtgttccagtgggggactggtttggcatcatgtggacgacggttgtgccctgggcagactcttccattgtttttcacagcaaaggaaccaagcagagtgacaggtaagatgcttctttctttagtcctatatttgttctttgtcaggaagtagagacataaacatgcagaagaggattaaatggatttttgattttgctatttcttggtctctctaactttctctattagttggtctgttagtcttgctggcattgtttgttggcccagtagaagcaaccctctttgctgccagagtttggaaccgattgaggcatagatgcaagtcaggtaggtggagattgaaatggtaactctagaactgttaaaagctaggttggaagacatgattagaggctcactatgactatatattgtcttcaaacccctaattctgaaactcagattgaatttacccaccaagcaccggggtacttgtatagagttggccctactaaacttaacgcctgaccaagaggacatgaggatgtaccctctcttcaggcaggcacaccccaaagagggaacccaggaagaccatgccttgcatggccagttccttctcccaaaaaggaagcaggagtgagtgaggatgtagacagaggggccaggagtgttcccacagggaaatctctctacgcgaaaatacgaggagtaggtaatatgtgttctgcccaaaggtctgttggtcatttggtctgtattttctccttccttttcttccccccacccttcttcccctgtctctctctctctttctttctctctctctgctctccttgtgggcctttctccctctgtatacagcaccatgtctccatttcctcctcttctcccttttctgctttctcactcttctactttgtgaccgagtttacccaggcttggctgtaggaaaaacttgtataggagacttgtaactacttcttctgttgcctggaacaaatcagggatttttgaggatggtgggaaggggtgggggaagaataggaaagggtgggttgcagtgggagtgatgtaattgggtgttgagatcattctaatttttctaagtcctggaggtgttctctttcagctaggggtgggcttagcttccctgaaacccatgggttgagctggggaaggtcctcttagaaaggagaaggagcattggatgtgggacaggtagtccacttcacatgacattagaaacatgtataatgtaaacttggacttctcaaacatttttgtcttcttcatcaaggtattcacttctccccaggcatatcctgccttctcatttctctgtgcttatgggaaaactgttacctctgcccgaaatgccttttcctttgtgttccctctgggaaaaattctaagaatttttttttttttttttttttttttgagacagagtctcactctgtcgcccaggctggagtgcagtggcgcgatctcagctcactgctaggtccgcctcccgggttcacgccatcctcctgcctcagcctcccgagtagctgggactactggcgcctgccaccacgcctggctaatttttttgtatttttagtagagacagggttttcaccgtgttaaccaggatggtctcgatctcctgacctcgtcatccacccgtctcggcctcccaaagtgctagacctagctcagatacacctttctcagtaaagaccttttcttttctagtgttcactgcattaacttcacatgcatggatagcacagtatactgttattatgaattgtctgtatgttttctcatatgctgaagattatgaacttttaaagggtggaagcggtgtgtcattttgctctatattttagcacaggacctgttattagagggaaaaaatgttttttattttatttcatttaaacaacctgtttggcatctgtttgggtggggcacagcttacattcagagttggttttgggggagttccctgatgagacattagaatggatcatcagcttccagtcctcaaagtctttcacttttcgtcctcccgttctcacctcattgccaaaagttctggagctggaacccgggctgtcccctcctcacctggccattaggggcccagtacttcctctctggtgaacatgggtgaaaacatctgctttgtcctgttatcattccagaggacacttgaaggtgtgagggccattttattacaacagttattaattaaaaagaagtgtcagaaaaaaaagttacagaataagtctgcgtctatctgcatgctagactgcatgtcatcacaggctagctccacttttagcagtgtaattaaggaaggaaaagtgctgaatttggagaaagaagcccagttcagaatctggttctgattgtgtattcttaggaggcttggggttatttaagtgcctgcgtttgataacagctgagtgtatgagatgtcattgctctagacccactcaactgctggagttaggaaatagacacacagacacacacacatgcacacacatttttacatacacacacctatgtctatttatctgtctctactagaaatcatgaatttacactgatttttccaattactatccaatattacacggttgattatagcctttccccttttcatatctatacctttcctcccctctttgatagtgatgaatctggctcctttatcctgaatgtatttacttgattgttcaatctcctggcatgttaccaggctccctacaatgccagccatcttcttggccagtgctgctgactcaggcctgcctgcactggctgagtctctcccacgcccaggtggtactggctgagtgccccctctctgcccagtttgttctgttataaatgtaattcagaagaacattttttcttttgtaggtctagagaattctaaagcaatgtgtgttcttgctggctcagaccactcagcttcattaacaggtaggtaccagctctttcacggtttaacatgccattcaggattctgtatgtgactgcctgaagtggtgatattgaaatacagagggaatgtcatagactttggagctagaattctgatgctaccactggtatgctcttaggcaaattacttttcctttctgagaccatcttcttgtctgtaaaagactttgtgggcagttacgagaattaaatataatacatataaatcatgaatagcagacataggctcacttccatttcgtctgagtttgctttcttaactatacaataaggataataatgtcttcctctcagggtaatggtggttgtcaaatcatgtaatcaacagtaaatttatatataacatatatggataacacagtgtaatataattatgaattctttgtagttttctgatatacctacgattatgagggtagaagctgctctcttatccatctaatctattttggtgtgtattgtaactgtctaagctctctacctgtgtatactctctagttgtctaatctcaaagtaacctgttttatccatctatatctttctaatccatttatcagtctccatttgtgtatctatctactctgtttacctaagtatctatttatctttaatctttgtaatatctaatctgtgtgtctatatatctaactctagatatatagttttgtaaatattttatattgttatatgtttctctaatttatctacttcatctctttgatctatctgtttttctgtcttaactgtttttttatcctacactatatctctctctttggctgcgcattcatccttccatttgaaacaccgagccaatacagtataaactgtctagtgacttttccttccaaggcaatgcagcattttcttgaaagtgacagtaatcccttctctttggcccacattgccctgacccctgctggtagactggagactatacatctgagagatttataatattttgtttggtaagacctctcacagagttgaatgtattctattttttaagcaaagaggagggacttccgtacttagtgttttatgtggaaattcaggtgtgcccataatatatgtaaattaatggtggtatgcattcttcgacatcaaatttgcaatgcagcccagctgagaagttgttatttcaagagcacgggagccataatatgaaagtttaaatgctttgcaaattctgagctgcagataatttgtcatttaatgaatttaaaacaaacatctaataaaaaagcacctacttttaacttgtgtctcacattaggtagatttatatattaatatttgttaaaagtgttgagttgaaatgaatgccaactataagggactccagtgggtatccagttcctcccttccttttacagaagaaggactagagaccttagggtgagaagtgatgtgttcgtgccccacagtcaatgagggatggagaaggcattcttttctgagaataaaagtagactacgaggtgtttctgttttgttctaattaatttgaaatgactgatggtatgtaaacctagagcttgtctaattgtttgccaacttcaacttcttaaaaattcttgttggtagtaaatttgttatttcatatgtagggcacttttattatggtgttatttatatataaatgttgaatattttaattaagatgtattttaaatataagaaattaaatttcttttaaagtatacaaagaatttaagtttcatttaaagtatacaatttagtaatttttaatatattcacaaagtgaaatggtttttgatattttgaaaatgagctaaagattatggagattaatagccctgctggacactgtggctcacacctgtaatcccagcactttggaggctgaggcagatggaatacttgaggtcaggagttcaagaccagcctggccactggtctactaaaaaatggagtttttttgtagaaaccccatttctaccaaaaaattcaaaattagctgggtgtggtggcacgtgcctgtaatcccagctacttgggaggctgaggcaggagaattgcatgaacccgggtgacggaggttgcagtgagccgagatcacaccactgtactccagcctgggtgacagagcaagactccgtctcaaaaaaaaaaaagattaatagccctctctttcttcatctagttcaagctgttacacattggattttgttcaatgctctttagacactttctctggagtggttgtagattatataactatttggcattgcagcagaatttaattttacctgctgaggcaacagcataatgatcctcatctggaagacagtttgactttcaaaaagatggtttagagctactaagataagtgaagttgtttacacaggcttcatcgtcagtggcatctttgtagctcagcagtccacttaatggattgatactttgctgagggggcttctttgctatcttgtaagagatcttcatactttgcacaccctgatgaagtccaggaggttgacctctctctgggaatggaatacaccaaattcacttcatagaactgcagaatgtcaatgttgcagggtcaccccagtgacaaaaaggtttcactgatttatactccctcattttggagttgaggaaacagacctagaatgtgaagtgatgtgcccagtgtcaaacagtgatcgggtaacagatggaacttgaactggagacttctgaaccttagtctgaagccccttaatgatactgtttgactttctgtcagttttttggaatatactagactgccctagggcaagcaatactatcaagttttattgggaagctacaaaatgcagtgaaagcagaagacctggcttctagtccctatttgactccttattagccatgtgatcctgaaaagtaatttaatatcttccagccttgattaatttatcttctagaacagtgctaatagaaatataatatgagccatagttcaaaaagtaaaaagaaacaggtgggattaattttaataatatatctacttaacccagtatatccaaaatattatttcaacatgtaacccatatcaaattataaggagccacactcttttttgcactaagtctttgcagtccattgtgtgagagagtagcatttcacttacaatgtatctcagtttgggctagccacatttcaagtgtttaatagccacatgtaggtggtgaactactgtattgggtagtacagctgtagatccttagattataagggttggaaaagctgaggagtcacaaattgacaagccataggctaaattattgcccatggcctcattttgtatggctttcatttacaaaatatttttgaatgtgaatgccttttagataggcacgtactctctggcttgccacagtcacctgccagtcattcttgttaccagtgtcatcagtcatattgtctgcccttctagaccaacagccttcccttccaattttcagctggtgaaactaagtcttagagaggaagtgatttgtccaaggtcaatagctagttagcagatccaggaatagaagccagagtcacttgactctgaatttgttctctttctgttaaatcacaatgtcagtcagtcactttcctgcttatatcacaggattattgtgaggttaaaacaaactgaagtgctatccagatgcgattctatagcattatattttctgctggacagggcatgcagtgaaataatcttatgtttaaaaaatttaagcttaaataatgtatcttttaacctgttattttgaaaatttaaagcatttttttcatacaaaaggtataggcatatattttaaaaacgtagaaaatagagaaatgtgtctcatacacatggtagatgttgcataaatatttgttgaatgaaaaagtgaagagaaaaccacacatttttatttcttaagctactaagaacatttggccttgttttttatgtatagaatttttgaaaatcttgtaataagttattatggtgtacacaaattttgtaacctgcttggctccactcaaccttgtagtctaagtataaaacaacttcttttaaccacttattttttagacttctgttattttccatcattttggactaatgttccctcacctcttttgttacccttctgtttgtttaagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacaggtgagacagtagcagagaacttacggttggtaagagcagctgggggacagctgtctaagcagccatgagtgcttggggttaagcctttttactgatgaaagcttaaagatcagagatggggatactgggatctagttctgccaccagccagatatgtggcttttcctctcagagtcacaggtttgtacccaaaaaggcaagcctgggttaagttaactccttccggtcctaagagcccatgaggttttgagaagggatccattgcagcaagcatcatccagaaatttgtccagcttgttgggaagttcttactttgtcatagctatttgcatgtctaagtctaaattaaaagcatcagaaaatgttaagtgaaagataaatatctaaagattgaggtaggaacattattttgattcatagctggcatggaattctgatttaaacttttgttgacctaataaactatgtgtattggttcagacatctcatatattccctcagatgttaccacatcatgccatacagcttttggcatcttcatcttttcttgaatcttcgtttatttctcatctttcccttagggcagttctactttcctggccttcatattgttgactttgtcctcagattttgttttttcatggcctctattcatccctgccttcctgcctgttgatttcacagagttccccagccaatttgaaattcccaagatctgttatcatgtcaaagtattctgagcttcaggggttctcaggagttcccttgcctactcctgtcctgcttgctagctacacacacatctctagactcccaaatatctagtgactcttatttcagaagtttctggcttttgcaggttttcaggtcagcttcagctatccttggtaagtcacatatactacgcatttctatacacaaatgtagacttatgagcagtcatacctatgatgcttttaattggtcttttaaaacatttcatgatcattttgcaatagaggcctgtataacaaaggtgtataataaactttccatattaccgctttagaggatgctctaagcaaagtgtgtcattcattaggaggaaggtcgtcactttcctcaaagagattcagattgcttgaagattgggcttatctacagaaccttttcctaaagagactcactgagcatagtagctgggttttgtatgtttgtaattgttgatatctctcttttgtttcagataatgagctctgtgaaggaagccaccagattagtcttgctcacttctgtatctccaatgcctatcaaagaatttactcattttcctgcatcaaactctttatagttaaaagagactacacatacacaaatgcatacaaggcagggtagatagctaggatttctgacctctttcctgggacttagatgttcatgaacagaaagcttctttgtctctttggattctggtgtccaaccaaataggttaatgtttattaggcacctattgagcaatgtgttaagccttggggaaatggaggagaaaagacataggccatatcttcccactagaatatgtagataggtgtaagcctaagaatatagagatggaaaactttatcatccatgcatcatacaaatagtgagggtctttttatgtaccatgccttgtactagatgtaaatcttgcccttaaggagtccactgtccactaggggtgatagacctgtgataaaattttactacattccagtatgagatgtgcaacaatacagctaagtacaaagggcaaaagtcgcatagaaattagcagtagtcttgagtgattgggtgttcacaggtaggcatttcatggttagtcagtcttccaagaattgcagtacattaaaatacacttactaccaaatggtggtgaatttggttgtctgtcagtaaaccctttaactagtcaggtagttgactaatgaaagacataaagatgttgcttctttgattttagctttgaagcattctagctgatgcgattcccacatctgggccagcagcccagcccttggggtgggaggttggaacccatgtctctgacactgtctgagtcaccccagctgctctggagctcagcgtcaggtttctgcctcctttcaagagcatgattttttggtaacgtttcagctatttacttagcttgttaattcagattgcttgtttttgtacattgccactttctcctttatcctaaggccagaatggttaaacctgggatgtttgaatgtcctggtttttgtactgaattttgggtaaatgggagtttcctgttatatgattcaccaattttgtgttccttctagcagcagtggaggcccgtgctctggcccagtgtcgttgagaagaaacacccagggcttctatttaatcagactcagcactcacattaatgggaataagatttcctcacagggtcaggagcagctcattagtggaacaaggagttatttgactgtagttgttttcacaagctccggtggtgaattgttcctggaatgaacttgcaggccacatcagcacagaggctgctctcagtgtcattctgggaggcattagttgtgtgatattgattaaaaaagagtttatgcacagacactattggcgtctaatgggtagaggccagggatgctgctgaacatcctacaatgcaagggccgtctcctataacaaagaagtatctagcttcaaatgttaatagtgtcaagattgagaaacactgctcaatactggacatccccagtggtaggtgcttagctaaggcagttcacatggtatcagaataactttatagattgtctgtatgggaatctgggatgtgttctctgccctcccctctcaggagtctgtctgatgcctgcctgcagtgtttgtgatggaaaaatacttttctctgttagtcagaggcacttggaaagagtccaagagaacctgttctaatctgggagagttggcaagggtacctgtgtctcaggctcatggtgctgcattctagaaacctttcccaagctgcttaatgttcccgatcattgttctcaggaacttcatgggactcctgggtgactttatccaggctcagtgacctgcaggtgtctcatctgagattcatggtttcctggctggaggtgcttttaatgagagttggatggcagatctgggtgccttcctagtttgttgaccttgattaagtcactttacctgtttaggcctcagtttcctcaactctgaagtctggtattaaaacctgcctgcattctacatagggctgctatgatgttcaagtgaacgaatctgtgaaagatcccaactattgtaaaatgcatacataagtgatggctgcctggggtatgtaagtaaattaaagacttagtagttgcttttagaaagacttctgtttccacagggataatgccaccttgagactactagcctgaaagctcatgagctggccagggatgccatactcaatatcaaactctgacagcaaagttttctaaagtcttttacttgcatgcagtaggcaagtggctctttcatattatcaacaacttggaagattttcgtggcctaatttgtaatattacctattaaaattcaggatactcatcccaatttgtaattgtgtacatctctttgtattcttatttgtttaatgtctagactgtaaattacatgagagcagtgtctgttttgttcatggccatatccccagcatctggcacaggcctgatacataacagatgatcagtaactaagtgctgaatgaataagtaaatggcaaggtagagaaaaacctgggctttgaagtcagatagaccaaggcttgaatcttagctctcttaacctactgattgtgtgactgtgggcagctccacctctctctgtctccattgtcaccaccctagttcagcccactgtcacctcttaactaaatcctgcagtagcctttaactggtgttctggtcttcccatatttactccttgatatagtttggatgtgtgtccccacccaaatctcatgttgaaatgtaatccccagtgttggaggtggggcctgatgggaggtgattggatcattggggtacatttctcatgaatggtttagtaccattcttcttggtactgtccttgccattgtgagtgagttctcatgagatctggttgtttaaaagtgtgtaccatttccctcttgctgccttgcgcctgctcttgtcagatgatgtccaagctcccgcttcctcttccaccatgattgtacgcttccagaggcctccccagaagctaatgctcgaactatgcttcctgtacagcctacagaaccataagccaattaaacctcttctctttatcaattacctagtcttaagtattctttataggagtgtgagaatgactaatatcctccctctcccctccaacccattcttcatacctcagttgaaagatctcttcaaacccattgtgttacattcatatggcttcccattgctcttatgatgaaaatataatccttagtggttctacaggtcctatgtaatctgatgtctgctgacctttccagtcccatttctcaccatgctagttcttgatccctatccaatctgcactctggcctttgcttggtcccttgaaagcatcattcatttcccaccatagtgcctttgcacctgatattccctctatttggccacttatccatgcacctcttcttcagtttgacttagctaaatcctttttttttttttttaaagtcttaacccttaacttaggtatctgggagaacttctcttgacattgctgactagtcatttctcctttttttttttttctgttctcatagcaccgtaaacctctcttttgtgctcttttttggtagcattctttgactaatttcctttcccactagactgtaagccccatgaaggcaggagccatgcttgcttttgcctacttaagacatgttggacaaatgaaaaaacccaacttctttgaacttatttccttattaggaaagtggggaaataactgctgacctgatatgaggattaaaagagatgatgtattaaagcatccagcacaggactggctcatatgtcttttaaagacacattagctcccactactcttttggaaactcttgagctctctagagatcacatgctccatttcttctctttatatctctgtggggctggatgtgaatgtctctggatgggtgacaagttgattcagaactctcctgaagagtgcagaaagatcagtgcttacaaatgctggttacaagtgctggttgctgacggtgtgttagaatttcaaagggaattatttacacaagatctaaaccttaatgtggagttggtcagaatgtctagaatccagttgcttttggggtgctggaagctttccctgaatcatgcagtatcccaaagtagccttgtggtcttacaaggaatatggattgaaaaagtgagaacaaatacagggagttctttgacattctttactttcttcagtgttaccttaaagagccaaagagtcttagaagttttagagaatcaatgatggaagaagcaacttcctcactttgcaaatgaaaaaactgaaaccaagcagagagaaagtgactttatggcaactttaagctagaaatctagttctactttccagtgaaattttctcccttccatcggtgtcctcttgatttgtggttatatccttttgattgaggttttttattatttgttttcctaaagaggggaattgtatggtacatatgaaagggactggctgttagctactctttcaagtgtcacagcccaagaaatattttattgcatttgatgtctaagcattagtgaaattcaagcccagccattgattcacactaaactgagtttataaatatacctaatgctgatttttctgttttggggccaagatccttttcagaatagggtgacagtatacattactccatcttctttgggaccatatatcatgaaacttcaaccaagcctggggagattctgacctcatgggctctatttaaagcaggtgctttggaattaatgatgcttgtgctttagaattttgaaaaccccatgagtgaaagtcaaactgagcccaaaggcttgttttgaaatggatactttttgattcttattaaagtcatgagtttttatcctagaatccttagaatgtcagtaatggatggaaacttagagatcatctggccttaattcctcagtttagagatgtgaaaactgaggactaaataggggaggcacagtgagtgaatgaaggagctaggaccagaactcaatcaagtctcatgactctcagtacagtgttctttctgccttgttacattctttccagagatgatgaggaagtgtggacgacttaactagtcaaatccagggacctgaaccaggaatgacagttccttctgtataagaagttctgctttggccaggcatggtggctcacgtctgtaattccaacactttgggaggctgaggcaggtggatctcttgagcccaggagtttgagatcagcctgggcagtatggcaaaactctgtctctacaacaaaatataaaaaaaattatctgggtgtggtggtgcgtgcctgtggtcccagctacttgggaggctggggcaggaggatggcttgagcccaggaggtggaggttgcagtaagctaaggttgcgccactgcagtccagcctgggtgacagagtgaggccctgtctcaaagagaaaaaaaaagaagttctgcttcaagaaaacacttattcttacctgaagagtgcagccatagatttctttaaggatatgtgtgtggagtagaaactgggaaatggttcctgagaagcgagggtcaggaggccattctgggattcacagaagcagctacatgagaatacaacagcaatcataactctcacggaccacctttatcactataaagtactttcacatccatgttctcatatgaagttggcaagatgagtattattatccttacttcacacaagagtccctaattcgttaatggcattgccctgtttcacacagaagggcagagctaaaacttgaatcccatcttttgtccccaagcctgctattctaattccagatcttgtgtttctcagagagctctaactcatcagctaaacttcttttacccttcaaagaaacatctttccccagcttttgacagtgatactacatttcggcaagcaattggaaggaaattcataggtatctttagtcctttagcagatatttgtgaaatgcttatctatatgtatatagtactatgctacagaatacaggggaatataaaatccagaaccacctttaggaagcttgtggttggatgagcaactaaatatttagtagaagaataaaaagattgtggccaagggccgaaggagtgacccagacactgcaggctctaggatttcaggggaaggagaggtcagtgtgggtgaagttggtcagggaagggtgtgaaattgtggttgggctttgggaaggtcacattttaatagatggagagtttgacttgcttctcttgctttctctttgtcctctggcaagacactaaactctctggtccctttcttccatctggccaatacgtttacataataatctttaagggtcattccagctctgaaattctatcctataaaaaataaaactggcctaaagaaatagtcatggatgtattcaaagattaagtataatgccatttactgcagcctaatttataatgacaaaaacaaaggtatggaaacaaataaaattgaagagagattggttaaacaaattgtggcagagccatatgttggaatattatattgtcattaaatagaatgttttagaaggatatttaatgacaggaatacgctcgtggtatagtaagtgaaaagaatgattaaccatactgtaacttctaatttgttgaaagaaaaaaagaatgtttctgtagaaaagactagaaggaaatgggccaggtgggattatgagtgaatttgttttctatgatgaattttgaatattttcaatttgattatagctcctataaatactattttaaagttaataagatcacttacccctcagtgcaagagactggctcctttgccatctattcccatgtatatatgtccttgacaagtcacttgcacgggcctcaattcggaggttgcatggaagagaggcaagatactttagcaggaggcaggagagtggccatctatttttggctcggtcatgagtcagctttgtgactttgggtaagaccctcctgaatatccctgagcctcagtttcttcatctgaagaggggagttggaggtcacaaaaggtcctttaagttgcaaaatatatttgttcctaaagatggataatttctccactattgtggaactggctaagaggcctctttggcttcttgagcctggcctctttcttttctctcccgctcccctgcacttgggctctgctggctgcaggctgatttctttcattcagagttcagggtgaattggagtagaagttgagtgacagggtctctgcgcaggtagggtgtaatgacagcactgaaccactagagggaagcattgtttgattactttcccctttcccattttttagcggctgtgtctgcaggtgaagatcagtcttgatttgcctgggggtttcaaattctagcattttagaattaaaaggacttcgaagatcatccagtaaaaccctagtatgctgcagatgtgcgatgatagaggcctggaaaagcaagcgacctagttaaagtcacacaatgtgctttttcagggtctacactgtaaaggaaggctgcagacagagccaagggtatgatcagttgagtccacaaagaatagacaggtcccatgttgtgcagaaacctaaaggatctacttgtatacttgcattcactgagcgcctctggccaggtgttaagaggcctggagatagagaagaaaagatataaccctgcccggaggagctgctgtctggcagggggaagctcacacaaacacacaatgctaccccaggtgtcttccccactatttggtggtctgcctagtctaggatccaggctgtggtggtggcttggagcctggtttatggaagaccctgcaggtgttcttatgaatgatcacctccaagattagggagatacattggataccccaagtttgtatttccagttaatttctgcaagcagtgctcagcctgttcacgtgccatgccttactatttcttgaggtttgcgaggaatcctggcagttttttccccaccttcaaacagctttgttccttggctctaggctgactttatttttggtttgcaggtacccaccagccctaagcattgtggcaaagtgaaaccgtgtactggcctgggaaccaggcagctctgtgatcttatgcaggttaccttctgtctttgagaagggaggtcatgttctcagctgcagctgtgtcatctctgctagagagatgaagcgttatcattatatttggattttgtgtttggctgtgaatacccattgatctgtggtctagagaagtgtagcatgtgtgcacctgaagcagaagcaggagtcaccctctgaagtgggtgtattcgacaaggggctgggcctgcagggccaccagatggcagcagtaggcagccagctagccttgggatgaggctggtagagtcatcattcggaattagtaaggtcagagctgaaagggcccctggaggtcacccaggccttccctgtttttgtatggatgggagaacctaggcccagaaagggaaagggtcttgcataaggacacaccctgagttaatagctgatagtccttgctcttaacaggaactgatatggatctgacctctagctggctgccccatggagatccaggggacaagggccagtgagccagctgtgggagaggacctggcagtggcagttaactgtctgcctttttcctgatttcttcaagggcctggtcttaatgatttttcaccttctcactcacagcaaaagcaatgtgcacatcttttctgctcgcctctgccctgtccagttctcctcctcagttctctggaccaaggcttcccatcacactgtgcaatggatagaattaggggtcatctcttaagtcctataccccacagatgggcaggcccagggccttgccagagacatgctgaagacatgagttagcacaattggttgaataagaacatttttttttttttaatttccaaggggatcaggttagggcagggagccagtgtttgccaagtacttactatgtactaggtgctctgccaggtactgctctacagcctgagggtaatactgctgtagccccttaaggtagggttcatttcccttcattctaggtgaggattgaggctcagagaggctaagtggcttgtataaagtaccatagctagttagaaagcaaagcagacacttgaatcctgctgtgtttgatatcaaagcttattttatttcatcatgccacttcctctcaaggtgaccttatgggaaatgtagcaattgactatcttattccattcaggctgctataccaagtgatatagactgggtggcttataaacaatagaaacctatgtcttacagttctggaggctgggaagtcctaatcaaaataccagaagatttggtgtctggtgatgacctgcctcctggttcatagactctcacctttttgctgtgcctcacatggcagaagaagtaaaggagctctctggggtttcttttataaggccaatgatcccattcatgagggccctaccttcatgacctcatcacctcccacaggccttgtctccataatattaagggttaggatttcaacatacgaatttgatggggacacaaccattcagtctgtagcagccctttaggctttagggagggggcaacagatattttgtctctccttcctggagaaagcttctgggggagttacggtggtgaactgccagagggaggaggcctttgaagcaggaaagggcaggtatttattggagcaggttagggagtggtggctggtggtataaagcccactgagaaatggttaaatacctttcccctctgtgcctgtgttctagcagttctttcttccaggaatgctcgtctctgtgattcctgcatagctactgcctcacttccattggttcttgtccaaatgtcacctcttacactctattcccttcactgtgttatttttcattatagcagttttcattgcctgaaaccatagtgtcattatatgtttacttatttgttgtcattctctcctaaccgaatgtgagccccacaaggttagggacttggtctgctttattcatccctggatttctccaactatagacgagagactcgagtgctggtggcatgggatgggtagaacttttggatgtggaagtgatgctatttccaatggctgtgttcaggagatacagcctgtagctggccctgccctcttcctaccttcttggagaagcccaggccagagagcctcagctccctgaggctgacagtgatgcctgatgccccagcgttttaagaccagctttgctcctgcctatctgcaaggccttgccttgagaccttggcttccccatctgtccatagtgagtggggtgaccagccatgctgcaagctcaccagatggttctgggaagggtgtagaggtccctggcagagagctcagtttccattcaaagaatcttcctctttcctgatggagattgatttgttccaggagctctctaaaagtaagcatttagttactggcctgtaattttgccatcatttttaggtttttggcagatggcactctgcttgccctttctcaggggaccttgcctatcccatgggtgctctcaataatcacagtgacagccaggcacggtggctcactcatgtaatcccagcactttgggaggccaaggcgggtggatcacgaggtcaggagtttgagaccagcctggccaatatggtgaaatcccatctctgctaaaaaaaaaaaaaaaaaaaaaatgaaaatcagccgaggtggtggtgcatgcctgtagtcccatctactcgggaggctgaggcaagagaatcacttgaaccctggaggcagaggttgcagagagccaagatcacaccactgcactctagcctgggcgacagagtgagtctccgtctcaaaaataaataaataaataatcatagaccagtaccttaaagtgctctcaatgtgagccaaggtgaaagcagcccattctgaggaatattggaggaatcaactcttgcccaatcagagagtgactttttacctcaggaggaagcttaatgtggccaaaagaaccctgaagagctaggtgtaagttctgatttggctatttgttggctgtgtgatcttgggcaagtcattgggcctgaacttcctcacctgtaaaatgagggccttaattcctaatttgtctgcttcacaggggtgtcttatatcctttactcattcacaattcctccctttattccttcactcatttgttcaacaaatatttgttgcataggcagaagtgaggggagggcattccaaacagaaggaatactgcgaaaaaatctatagaagtgggaagtgctctgtggtgtagtttgcttgacctgggccagatgataagacattgggaacttttgggtacaatgagaaggggtccttgttgaggcgttactctgtgagtagtggaggagcagctggaggtttctgtgaggagtggaggtgtgtgagaaacataaacattgaaaggagagaccctgactcggggtgctcttgcagtctcctctgttgaggcctcatgcttgctttctactcatcgctgtggctgaattagaagtcctctgaattcttaggggagcccctttcaggggctcaggtgattttgagaatctatgagatggggagatgggtgggactggagttatctggttcattggcctttcttctgggaagctattgtgagccatatggaaggtcattcaggaaaccatcatgttacctttcatcttgaagcgtttcttaaaggtctaaaaatgagcagctctggggcttctccttatacctctctgaggagatggaggtgtgtgaggaaggggtcactcacatttatcaagggcacatgtatgccaggcattttaccagggctttacaaacatttgtttaatccatatacaaattttgccaagtgaggctcactcccattttacacatgaggaaaccgaagagacataaagagacatgggctcactctacttgggtacttagccttgcttcgctcaatgtgaattgcaggtcaagatcaccttgtcaagtttgggggtgttgtgaggctcaaataagatcatggaaagcactttgtaaactggaaagttactgtgtgcataggcagggagccatcaatagtactactgcttcccagccacattcctacattgagttttgtttgggccactcattcctgagctgatagaagcttctagccattagtttctcttctgcgcactttctcccccagccagccccagagtcagtggctctattcaccacttctctccattaagcccacaaataagagcaatgtccttttttagaatgctaaaactttaaaacgttacagcaccaattaatatcagggtaaactttcttttctgtttgccattttggtgaaaacaatagtaaattgtggaattttaatcctagaagggaccattttatccttatttgaaatttgaggaaacagaagcccagtgagagatgatttgtccccatggtcccacagctaacacgtagcagagccagccaggattagaacccaatgggtcccttgtctaggacccctccactgccccacatgagcccttttatgagagactttggcttctttgtggaggaagaatccagtttaataaatttcattataccagcccctttatgtaacagggctgtttccaggtcctggcagatggtccatagtaacagtgctttgctgatttggttggagctgagcctgtgaaatgaaaaatcctcagtagcagatgcctctcccaggccctggccatggaaaagtcctcctctccaaggaaagtactgtagcttgggtggtaactgtctctggtgggactaagtgtgagcaccctgaaagataatcttaaactgtgtcaagtttttacaaaaggtcacattggtgacttggaggttcttggcagttgagctgctagtagagggtgtttgtattctggggcctgagggacagatgggagcagggagcagagcaggagggagattagtagatgtggaagggaaaggtggccgtcccaccctgggtctgccctggcaacccctccttttccataccatgaggccatggacctctagacaagccatttgaatgtgacaagcatttgtcacaccatctactagccttgacagtggactttaaccccaaacctctcccaaccccctactttggaattactgggactctaagtctcctgattatcttccctttcctggtgggtccttgaacattgtatgttctcctcagtggcctccttcggtgatgctcattattgccactgctcaatgcaagtgccaagtccccaaaccactgacagtggagtggtcattatctccattggcatcttcctgaccatgtccaccgctcagtttcacccttgtagagttctcaaatatggggtgggagaatgttttcccatctttgagtatagctctattaggacccctgtaggtcttttatactaatctctcttgaagaacctgggacagtttcccagggatggggttagactaaatttgagaggcactgtctaaagtcatgtaccaagatgttctcactggttgaccacaaattggcatcctaggataggctccttcccttccctactgctgcctctgggtgaattgcttacccaaagattggggccaacctttgtctcctctattggagatcttaatctgagcttcccatttccccaaagccagtttctctttggaaaccaaggatgcaaatagtatttctagggggttgtgggatgtcttggggtttcagaggtggggtcctggctttctaacataacagtggcagtggatacatggcagtggatgggctttgcagaattcactggctccagtgtatgttctgtctgtccctgatcctgctcctgtgggaccttagggtggtctgcagggggagctgtgttcccatggccaagtgctgggatttttaccaagggaactcaagcagctcctctgcaggtttaggcgtgcttgggaactgcggctttcctttggctgtgctgacactcccaagtcgcattcccagctttagccttcagcttgggtactgtgagtcatcgtcatcagtggaaaacacggcctcatcaacagctgggtgcagtgcttggccttttttctttcctttttttttttgtaacttcacagagatggaaactgctgatgattttgcaacggacaaaaactgaaggtgatgtacagaattagggatggcagttccagatagggagaggaggatctggaggagatggagaaagggatgtttctttcattacccagcccttgggcctcccaaaagccatccctgggatggaggcagtgaggaatcgtggggacatcacctgtctgctcttccctgccaaggagcttaggaagcccatgataattaggtgaggcaggtctcaatggaagcttggaaaagttgacttgtacaggcataccttggagttattgcaggtttggtcccagactacagcaataaagcaaatatccaataaagcgagtcacacaatttttttgtttttccagtgtatataaaagttgtgttatactatactgtatactatacctattaaatgcacaatagcattatgtctataaaacagtgtacatatcttaattaaaacatattttatggctaaaaaatgcaaatcttctgagccttcagtgagttgtgatctttttgctggtggccttttagaagaaggtcttgccttgatgttgatggctgctgactgatcagggatgtggttgctgaagactggagtggctgtgacaattacataaaatgagacaatagtgaaatttgccacatcagttgaactcttcctttcacaagatttctctgtagcatgcaatgctgtttgatagcatttactcatagtagaacttctttcaaatttggagtcagtcctctcaaaccctgctgctgctttgtcaattaagtttataaaatcgcttttgttagcatttcaacagtgttcacagaatcttcaccaggagtagattccatctcaataaatcactttctttgccatccataagaagcaactcctcaaccctacaagtttgatcatgagattgcagcaactcagtcacctctttaggctctacgtataattctagttgtattgctgtttctaccacatgtgcagttacttcttccactgaagccttgaatccctcaaagtcatccatgcgggttggaatcaacttcttccaaactcctgttaatgttatttgacctcttcccatgaatcatgaatgttcttaatggcatctagaatgatgaatcctttccagaatatttttaataactttgcccatatccatcagaggaatcactatctatggcagctatagctttacaaaatgtatttctgaaataataagatttagaagacaaaatgactccttgatccttggactgcaggatggatgttgtattagcaggcatgagaacaacattaatctccatgtacacctctatcagtgctcttgagtgaccagggtcttggtcaatgagcggtaacattttgaaaagactcctttctgagcagtaggtctcaacagtgggcttaaaatattcagtaaaccatgctataaacagatgtgctatcatccaggctctgttgttccatttctggagcacaggcagagtacactgagcataattcttaagtgccctaggatttttggaatggtgaatgagaattggcttcaccttaaagtcaccagctgcattagccctagatagttatcttcttcccatagaaggctgtttggtctacattgaaaagctgttgtgtagtgtagccacctttatcaattttcttagctagatcttctggataacttgctacagcttctgcatcagcacttgctgcttcaccttgcacttttttggaaacagcttcttttcttttctttcttttcttttttttagatggagtctcgctgcgtcgcccagcctggagtgcagtggtgtgatcttggcttactgcaacctccacctcctgggttcaagcgattctcctgcctcagcttcccaagtagctgggattacaggcatgcaccaccacacctggctaagtttttgtattttttgtagagacggggtttcaccatgttagccaggatggtcttgatctcctgacctcgtgatccgcccacctcagcctcccaaggtgctgggattacaggtgtgagccaccatgaccggtcctacagcttctttttttaaacctcatgaaccatcctctgctagcttccatctttttttcctcagttccctcacgtctcttagccttcctacaatggaagagagttaaggccttgctctggtttaggctttggcttaagagaatgttgtggctggtttcaccctttatccagaccactagaactttctctatatcagcaaaaaggccattttgctttcttatcattagggtgtccactagcgaagcacttttaatttcattcaagaacttttcctttgcattcacaacttgcttaacaggtgcaagaggcctagctttttagcctatcttggcttttgacataccttcctccctaagattaatcatttatagcttttgatttaaagtgagagatatgtgactcttcctttcacttgaatacttagaggccatggtagggttattaattggcctaatttcaatattgttgtgtctccggaaatagggaggcctgaggagagggagagagatggaagaagggctggtcggtggagcagtcagaacacaatcgattaagtttgccatcttatatgggcatggttcatgatgccccaaaataattgcagtagtaacatcaatgatcattgattacagatcaccataacagatgtaataataacaatgaaaagtttgaaatattgcaaaaattaccaaaatgtcacacagaacacatgctgttcgaaaaatggcgccaatagacttactggactcagggttgccacaaaccttcaatttgtaaaaaacaaaacaaaaaccgcagttatctgtgaagtgcaataaagtgaagtatgcctatacttttctaagaagctgtggacaagatgtactagaagtcagggcgacctgggttctagtctagtcttacttctaactcactatttgaccttgagtagttaagttgcttttgttttgggccttgttttacccagctagaagcaaatgattgggtaagaagttctctaaggtttcttctggctcagatagtgtatgaggctgaattgaatgtaaagaactttgaaccttattcccataatcctcttgagaatccaaaacctgtagctctttctccagatgaacagtgttgtgctcactgtgtaaggagaatcacatagatatggtactcaccctccaaggacttacagcttgttgtccttctttcctgtccccaccaggcagcagacagagtctactgggaagcaggaaattaggatcctagttctggttctaccaaaacatactgtgtccttgggcagatcattcccctcttttagccttattttcattttctttaaaatcaagggattagacttgctgcttggcttcagctaccctccctcacccctccacccacactcctcgccccccagcctactactagcttttctgtagggtgtgattcttagctgcagaagccctggggtatagtttcctttcttgccgggagggagaaaagcaagattattttttaattatgcagctaagattaggcagcaatctgcattttaaaatgttattaataagaatctaaaactgtgtgaagaagctttagagtttgaatgtgaaatgagttgggaaacatctgtagagtcactggcctcaatcagggatttttctcaggttgccaagcagcttctaggtgtaactagcagtgtgatgtgctgctggaccctggaggaacaggaaaaccaagacctcagccggcacatctcagagcagggactcgtggtccagcctctcatgttggttctttgtaaactggctttagagagtgatagtcataatgttattaacactagcatttaagagtttacaaagtgcatttatgtttattgcctgccttttcatcataggcttgagaggttgcttgagcaagtttcattgcctctgcttgagttggctgggacttgtaagtttaaggttcttccattaggaaaggtgatgtgctgtagaggagaagctcacaaaggaagatgggagctggacactggtcctgggcctccatctccctccccagcactgcctgtctcctttccctactttttatttctctgtagcaattaacgtcatttgccataggtaatgttttgttgttgttgttgtctgtctttcccctcattagatttaagctccatgatgggagggagttttgtctttttttttttttttaaattagagacaggttcttgttctgtcactcaggctggagtgcagtagcatggtcatagctccctgcaaccttgaattcctaggcttaagcaatctttccacctcagcctctggaatagctaggactacaggtgtgcactacctgttcaactagttttttttaaattgtttgtagagacaggatcttgctgtgttgcccaggttggtctcaaactcaagcgatcaaactcaaggctcaagtgatcctcccactttggcctacaaaagtgctaggattaagttttatgtgttctgttcagtgcagtagcccctagcacctaggacagcacctggtgtatagaaagtgctcaataactatttgttcaatattgtgaatgcctggatctgtttctatctatataggctgtgtgacttggaaaattatttgttttccttagttttgttttctctttggagagtaggtttagatggtctctgatatccttggtggtaacagcaatacctacaattcctactgttcaacaaacactgaacaccacctctgggtcaggctctgtgttaggtgctgtggggaatactgagagaataagaaaagatcattgttcttcacccttcagtgggcaaactaagatatgcagtcaaataaccctatgtttggagggatagaaagttgttgaaacagaggtacaagcaccatgccagtggctcctaaaggaagaggtggcttattctgaccaggggataatagggtgctttagggaggcagcagcatttaagctaggccctgaagggggagtaggattccataagtgggacagacaggctgaccagcattgcaggctgacaggtgttgcaggctgaccagcattgtgagctgggggcagagcatggccctaaggcccaggaaggaggaatatgaatatgcttttgacaaaggagcagtcatccaacattgagagaatgtaggtgctttgagagaggcaagggagctactgaacaaactaggactggggcttcctgccatgctcttccctagcctggaggaagaaaccagcctgactccttcttgcttttctctggaaaaccctaaccacatgttgtagatagttctgcactcagtcttggtgttcctcagggtgcagtctgtcttcacttctatcactgctgcccccgatttggtagctaataaagtcagtggtgaaaatggagcagctgtgtggaatacttctatgttttgggaatctgacctttgccatataggtcaaggatggatgaagctcactcactcatcagctgggctctctctgtgcctccagcccacgtgtgtgtccctgtgactctgaacaacctcaggaagtccttgcgaatgttcacttttgaagagccagtgtgaccaagtgaaaagtggagctgaggtcagacagacctgtgcatcccctgcaggacaatgactgagggcactgactctggttgccaggcccctgggtcccatcctagctttgccattgaaagctgctggctctgagccagagacataacctctctctatgcgttaatattttcatctataatttgaggattataatgcctactcagggtatttctgtggattaaaagggataatccatatgaagagtttagcatgaaatagccctcaaaatattagcaattattattgttattattgcagctgtgccacttactagctatgtgatcttggacaagtcatttaacctctgtggtctgtttcttaatctgtaaaatgggattcacaataatcattcagggttgatttaattatgtaacttaatgatagtgcctaaagcagttttatacagagtcagctctcaataaataaattctccccaacctttcaacttttgttcattctctttgcgggcttttttctcccctttttagttaggcagcctgtatttggaaatcttatttctgtattaacttaaaaaaattccaaaccttttattatgtgatattgtttatgatacgactttggaaacttgtgacattttactaaaaaataacaaactatacagtcaagttttaatgtttatttacgctaggaactatatgagtagtctttgatattagagtgcatgctttatttttggacagtggtcagactaaatattccaaaggtgacaataaaattaaattgtataccagtcattttaatactgaagatttttaggcatcataattaaaatgtagatcagggaggtatccaagaggtcatctattgcggttctctcattttatagatgggaaaactgggtgcctaaagcagaagggacctgttcaaggccatgcagcctagaagagaagccaggattaggcctgaatcttaattcaagtcttacgagtcttgagttgaagcttcctctcttctcttttccaactgaatcttgcttcatctttcttctccgttgttccttttactcatttctttttcctacctttaattaatttgttttgtctcgtacattagaggcttctgatgtgcaagccactatgcttgaatcttaaaaaaaaaatcaaaattccatgatagagctttcaatgttctttctcttttttgattatcattagaggcattgaccctaacactttggtaggtgggaattggctgagaagatttaacaaagtggtagaaatgctgtgtggaaccatggaaatccttaataaggctgtgttgttcagtttgggagaatagtagtagtaatggccattcactagttagtatgtgccataggctttatggaaaagtatccttgcagcaatgctgcaagggagatgcttttgttttcattctgcagataagacttagagctgttgagtagtttgctcaagattatggagctagtgaatggtagttttcagtagtggtgagtgagaggtaggtaggttgataggtagggaggtggttggattcatttattctattgttcattcaggcagcagatatttattgagtgcctactttgtgttgggcattattctaggacacaagaatgagtgaaatagccagtccccagtgtcatggagctggctctctggaagaggagacacacattaattaaacagtcctaatgagtgtgcatttataaactgaggtaaatgctcccaggatgaggaacatggtcctctgagattgttgcacagaggaacctgatctgagttgagtagtgggcagagttgaagatgagtaggagttgactaggtgaatggggtcagggtagtagagatagctggggacaaagggaaccagtatggaggctgtattagtctgttctcacgctgctgtgaagaaatgcctgaaactgggtaatttataaagaaaagaggtttaattgactcacagttcctgcatggctggggaggcctcaggaaacttacaatcatgacagaaggcaccccttcatagggcggcagcagagagaatgagagccagcaggggaaatgccagacacttacaaaactatcagatctcatgagaactcactatcatgagaacagcatgggggaaactgaccccatgattcaattacctcccaccaggtccctcccacaacatgtggggattatggggattacagttcaagatgagatttgggtggggacacagccaaaccatatcagaggccttgtggaggagcagcatggcacatgctatacagaaaggagtgtggtgtgactgcttccagcacctgtgctctgagctctctccttgcctgtttcctgctccttgtacaggaagatgatgctaggtgattcttggtcagttagttctgtgtttgactagtccctgggtattatcatcaaatgtcctttttataaagtctctgtccacatggcagaatgaaggatgagttacagaagtcaggttcttaaccttctaaggacacagaatgaataacccagagagtaactggtgcttgtatttgtaaacaggtgaatcataaatataacaaacctataggtagagagcttcctccttttcatgagtatattctagaagaccttgtaacatcctggaatattagagttgagagggactgaagaggtcatgtgaccttttctctgtcttacccatggattttctttttataacatccacctcagtttgctgactccattttgctatcttcagtgacattatattccctttttggacagatactgtcaagaaaatatggatgatcctctaatctatctttctatcacctataggactcccttccctagaacagggtagaaatttctcttccctgaagagctcagacatccctggagctacttctcattgtacctatagctatggctgcagcacctgcagcccttgatggatggtaaaggaagttggcctcttgaatattcatcatccacccaccctacccacagagtatcccctgctctctgtggtttgcatctagtagtctttctccttactctctcccctttcatttatatttgactatttgataacatgtttgccaaacgccccaggagagttaaataatttggtaatgaaataacattttatgattcccattagcgggacccttgatgtagcatctctacaccttcatcatcttcctactcaccttgaaatcctgaaatctcagaatggtgtttatttcctctcctttccttttaaaatcacatctaatggggtgccaagccctgtaaattctttcttctttgttttcctatgacttctattctagtttaggccttgatgcatcctagacttgtgttattgttgttgtttctttcttttcttctcttttcacttgctacctctgtgactttgggtaagtaccttgttccctgtcagtaacatggggatggtaaaagtgcctaactcacagggttgttgcaagaataagcaggatactgtacagagaatgtacttactttaataaatgtaatttaatgtacatactttaataaataaattaatgtgcatatatcggtgatgtgttaaaaaatattttactaatagacgtcaggcgtgttggctcacacctgtaatcccagcactttgggaggctgaggcaggcagatcacttgaggtcaggagttcaagtccagcctggccaacatggcaaaaccctgtctctactaaaaatacaaaaattggccggatggtggtgcatgactgtactcccagctactcaggaggctgaggcgggagaattgcttgaatccaggaggtggaggttacagtgagccaagatcatgccactgcactccagcctggataatgcagtaagactctgtgtcaaaaaaaaatttttttttttttttttttttttttttttttactaatagtaagcaaccaagtttagggatccctggtctggagggtgagatccagatccagccatggcacttctctgtggctggccccagcctggcaatcttgactccctttctagtctccttctcttgtgacccttattcactctcctgccttttgactttttttttttttttttttttttttgagacagagtctccctctgttgcccaggctggagtgcaatggtgccatctcggctcactgcaacctctgcctcccaggttcaagtgattctcccacctcagcctccccagtagctgggactacggtcgtgggccaccacactcagctaatttttgtatttttagtagagacggggtttcaccatgttggtcaggctggtctcaaactcttgacctcaggtgatcctcccaccttggcctcccaaagtgctgggattacaggcgtgagccactgtgcctggccgccttttgattttcgtatctttgctcatcccctcacgctgctcctgcaatatcctcccttggtctcccattttcttttcttatccagaagttcaccttaaatgcctcttgttccctcaagcctgccaggacaattctagttccagaccccttaggtgttctttctccatacttctcatttggcctctgtcgttttctgtggtacgttgatatcttttgcagtctatacttcttggctctgtagttatttctctgtgctaattcttacatggacatgccttataaattgtgtttcacttgctgacttcgttttgagctattttgtcatctctgtcatttatcatttacctggagacacatacctatactttttggatgacattagtgtatctattttttttaatcatagtaatatataatcctttaaggagaagatacgtttgttaaatttgtgatttgaatctccctggatttgacagcacgcatcagcttgatgcagacattcatctacagtgtattaatgagcattttttatatgtggattcattgttttttttttactccagatgacataaaatcatcatccatgtgtttatgcctttatttcagcacttacagtcctgagttctacatgggctcctgggaagaagattattctagtgaggaaagctggatggtacacagagcatatccatttaatctgggttttcgtcttcctcaaacattgtaaaaatggctatttcatcagccaagttttgtcagtttgggacagcagctgtgcaatcattggagataccactggccctggagtcagaagacacaggtttaaatcttgattcgactatttggttgttgattgaactcaaccaaatcatttaactctcatcatttaacctcatctgtaaaataagcttaatactctatatgccatagcattattgtgaggattgagccagcgtcaatgaatgtactgggtacctgggaagaggtcagtaaatgtctgtttaaaagaaaaggaaaaataaaagggtctcttctgtcctgggtgagccttctgatgcagagtttattttgaggagaaatagacaagttcagagtgtgttaaatttaggcttgagactaaagactgaacgttaagtcagcctggtttctggacttgtcttaaccagaatgtctgtggcctccccagagagtatgaggattaattagttaatctttgtaaagtgctttgaaggtgaaaagtgctctgtaagtggaatggctgaattgctattggggatataataatggtggcaccatattctgccagtcttgcctgtctttgacttcaataatcaataacaggaaagctctaagatgttttacttcatgtgaaagaaaggattcaatgtgtgatttctggtaaaattatttctgtagtcttagagataacaacttcctagtttttcccagcagaggaacggtcatttaagcagcaacagtctcatcccctggtttcttgggaatctcctgctgagcaatctggttagaaatcctagccagctcaggtagagggacaatttgccagttttggatgccctatgggtcctgggcacatgggtttttaagaggctaatcttgcagaagtgaaggaagagtgttgagtgattatgcagtgactagtgcttaataaccaatgcagagtaataccatgggctagtagaaagggatgtggcttagctgtgtgaccctgggctagtcacttctctgaaccttaatttttttcacctgccaaatggcggcatagtagtggatgagtacaatgataaaggtggctcacaggagggtgactttcaccctttctggggagagctggggagtcaagaaaggtttcatagaactagtggtacatgtgctggactccaacggtggagccatagtttaccagctaaggagaggtcattcttagcaaaaggaacagcacacaaagagccatgaaggagtacatttgaatggacctactcccagctctcataatatacgaggtaccccaaataccctgtgagctacgcagactttgttccctctttgaggaagcccaaaagtcagattcctgtaaactgcttggtatctaccttagtgtctgctagcaggctgatgctgagaactgtttccctgcagagccttgtatcactgcaatattctgacatttccccatgaatctatggttatttttttagctgacactataaaccatatgttgaatgtggggccagatgaagctttgataccaaacacaaagtatgcagtagtagatttgtctagaatttaatatgcactgctctgtgttttgtctctaaagcaaagtttttctttgttaaaataaacatgtataaagaatttatacaacgcacatggttatgcatatttattgcagagaatctgttaataatctatggctcatcagattttgcatttctgttgaaataacaaatgtggcacttggtacaactgaatgaatttggtgaattttctcttatctaggagaagaaagtccatttctccttttgcaaatctcattttcttttgtcatttttagcactggccagcttcccatgtggtgcatctgggggactaaatgcttttctggctccaaatggttttgccattttttttttcttctctcactcccttccctctagcacacataaacacttgccttaggattgttagaattgctcctttgggtaagagcatagattctgaaaggtccctttatgttacaaggaggggagagcaaatgaagctggccattcattgagctaggccctaagagattgtggagtggagaacttcaaggtggctaaatggggccctgggttgggtgggggagaggagagcctgagaacaggcatctgggcaaagcacaaggagtgtgtggggaagggagggaatggaaggccataaagcatggttgaagtatatccgtagtcatattcatatctatataacatgcaagagcagaaactttagaatgaatctctgcttgaatccagctctggtactcacagcttatttgatcttgggcaagtcatttaacctctctgaaccttagtttccacatctgtaaaaatatgagtgcatgtgccttctttacaggaagataggaaggctcctggtaggtggtactaaaataaatgtcacactttctcttgtaattcattgcctacccatgagagcacagctgtggaatgtagtcttaattcaaataatatttgtttttagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgaggtaggaagtgacttctcacagatgtaatctgtccctttttcttgtctttcagtgaatcatttactgagggcctactgtgtgccaggcgttatggataggtaccatgtaggaatcagaagaggtccttgccctaaggagctcatgctttaatgtggtcaaaagtcagtcacccagataactgtactgcaaggcagactttgtgtagttccttggaggttcaaagtactttggatctactgtgaagagcaagaaatgaattcagggtacagagattggcctaggcttagaaaatgacaaggctggccaggcacggtggctcacgcctgtaatcccagcactttgggaggccgaggtgggcgaactgcctgacgtcaggagttcgagaccagcctggctaacatggtgaaaccccgtctctactaaaaatacaaaaattagctgggcgtggtggcacacacctgtagtcccagctacttgggaggctgaggcaggagaattgcttgaactcaggaggcagaggttgcagtgagctgagatcacaccactgcactccagcctggaggggggtgggggcagagcaagactctgtctcaaaaacaaaaacaaaaaaaacaacaaaaaaagaaaatgacaaggctctgatctgtgctttggaggatgggtcagacttgagcaagcagttgtaagacagaaattttaagtgtgcacaacagcttgaaaagagtcatggaggttggaaagtgaagaaactattttggggactacttggtggttcagtttggctggagcattgggtatctggcaggacagttatgaggtaatatcagaaagatgggctggaacctgatcaagggggcctttaatactgagctaaacattttatactcgtgtttatttttcccagtccagaaaacactgtagttcagttgcttattcaaacccctttgattttctgaaatggcttgaatttctacatttaaggcaggaatcttaatttctccagggtgtgcgtttctgttactaaattttactttactgttacccttaaaaaaaaagaaaaggctagattttttagaagaatgaggatggccacacaggaaatgtgcctctgaacccaagttggcttactgaagggattcagtcttcattcagagtcagtcaaaaaaaattaataagctagtgagacttctgtaattagcatcagactaatgacaaccctcttcatacctagagggcttcccttccccagggccctgcctggcctcctccttccgggtatgtaggacgcttctcaatttctgctttaacatcccagccctggtcttcctgggccttttcgtagtgctgggttaagtgtgtctatctttttttctctctctttctcttgggttgaaaaggaactaaacaataccacaaagacaatttacatgtaataataatgaaactacttaatattatggaagatttccataatcttgccaccctaaaacagctacattcctttttgtgtatacacatctccatacttctacaagttgtaccaatagcatttatgatgttttgttttcaatctttattttatcacagatgctttgtttttttccctcttggtctttaaaatgatcatttaaaatggctatgcagtaaacattacatgattagaaggttctgggatttctcaaaccattctttggatattagacatttagatcatcctttttttttttttttcccaccactagtgaatctctgttgaactgttttcctgaagatatgatcttggggatgcaatgacaagggcaaaggtccggagcatctttatgacttttgatatatttctttagattgtgtttggcagaagttggctctaccagtagtgaataagggaatgcagtatttaaactagtattgtctgcttagtgagttaaggtgctgagagcctgtaaatagtgctttacactctagtttttctttgtctttccaagatcatttaagactttgtggtcaggtagtatagtagtggaggaacagaggattcttagatttttccgagtctctagttctattggcaagataagtataccctttataataatacctaaggtattggtattggtaaggataacatgcaaagttcttgacttagtaggcactcagaaactgttgattccattctcttcttaccgtttgaaattttttaatgccatgtggtagccacagtatgcagcactgtgacagacatgaccagtgcaaaatttagtctaagagcctgacattgatgtgaattttacgtagcttatcaggagtgggcttgagccctgagccccctggcagcttcattttagagctccttccttcctagctccagtctctggggtgctggagtgtagacgctctgatctcatttcaggttcagactccaggctattactctctggtaaattgggtctgggaattgtctccagctgtggatatccaggtctggcctgctaggcatgtatttgctcgaggccaagagagagccaggccaggaggcagctatatgctactaagagtgggttcaccttggagaagacaagagccacactaaactaggtgctaccttggtcatgggcttggccagagaggtgcagagatacctggaggtgcaggaacagtgttggactaggctgatgtttcctgacccttgaggacctgagtgtggcacatagctgaccaactgcctttaattcttcttagttgcctttaatgtccaagggataagcaggaggaggagtgaattgtctggtgtctcagataggatgtctgcaaagaagggtccagaaggatagccaagcaggagaggaaaacacaggtagacagagctagactgtggtataaccatcccttcctgggaaccaaagaaagcaaagaaacacaaagttatttagtgcttattataggccaatatgctaaatgctttgcagatattattttgtcttcatgataaacctgtgtgcaggtgttacaattgctgctttatgaataaggagactaaggctaagaatgggtaaactcaactggcctctactgatcacacaataggtaaacagtgagcctgggtcttgaacttgaagtgcttgaagaaggtcacatactctatagataaagtaaaattgaggtccttctttctatgtgccctttcctgggtggaaccctttgctgggttcttgaaatctgggaataagggtctctaatgccctaagtgtttcaattcttttcttctgagccatgtctcctctctagcctgagaaacactttatttgagattttagaccttgtaggccttcctttaatgtccttacagtggtaaaaacttctgtgtttcattctctgtcagttttaccttagatactgggcctctctaggcactcctggaaaattccagggtgggtagtacagtgatctggattaatcccaccaagcgcatgtcagggcaggatgtatgtgaacaggtttgtttgctgcttgactgcacatgtataccccagcagctctctactttccaagtcagtttcatagctaaggtctctaatccctagctgctaactcaactttggcagacctgggaatgttaactaacctataagttctaggcttcttcaggaccacttcagccttgctctgattctttgccctgcctctattctctgcccttgtttcttgtccccaagccctcctattccagtttacgttgtgggacttggtatgatgctgctgttccttattccctggacctcaagagagtgctcctgctccctgttcaattctttgtgtttccaagatgaaatccctgtctggtcttcccagaacttgcagttcagctttgactgtcatccctatggctgtgcccttattgcctaggactgacctcagtgacactgccttcttggatttcttgcccaccatccccaccactggctgtttgtgtgctgtcccaccttttatgctctcctggatctttctgacatttacctccttcttgacttttgagttcttgcccattccataaacattggttgacacctgtcatgcaccagtgttggccatacagtggaagtggatggggaggtggatacaaggatgaaaaatacacagtctttgccctcaaagaacttccaggtatgtaagttaatatctactgtatagatgaaaagtgctattagaggtatgtacaaaaggccaaaggagcactaaagatggaatggtcaattctgaagacactaacaaaaaagaaatgttatttgaattgggttcttaaaaatgcataggagtttagcaaagatagaaggatatcaggccgagggacaacataaactgaaattgagtctagatcacttttaacttgtgatgcaatcaggatgcctacccattctagtggctgaacctagttttgtaatctggctgcctgtctagcctgtcccatcactgtctgaaggaaaatgaccttcacatacattgtctcattcgatcccagcatgatgctgtgaaataggccagaataggcatggttactcccattttgttattcaggaaactgaggccagagaggctagctaggaattaggagaagatccaaggcaaacagcttgactcccagtgtttctaaggactttctctgggctcagtctgcagccacagtcctgagtcatgttcctggtttaaattctgcccacgtttggttcaggagcaccaaatcccagccagggaactcagtatacacgtgcatgtgtgtgcacatacagtgccattggagcaggagcaggaaatgtggaaataaaagttaaaccagagattgggtaattgtcaagcccaaatgccatcagctctcatttgcagcaggactaaaactgctaaaggatcaacctgtgcacagggtctaagtgcaatctgtcggaatgagtgggaaagaagctatttttagtttgcagagtcactcactcagctgtgttagctgaggtttgagccaggcccctacactttccacagtgttatttctgaaggagaaataccacttgaatgcttgtgtaaaacccattaatgaacctggaagtttccagggcgtctttgtcctacagctccctcggaagactgcctttcctgaatgaccttcctcctttcctatatttaatacatttctaattttaagtttgtgtcaagactgtgggactttggtgccctaaataacacagaaatctaccaccagcaatcagctgagtccggagggctctgacagaattgaacacaacctgaaaaagcattcccaagtggctctctggtaagtacccacagcatcattgctgttcctagagaagcatgaggtctctgagaccatgggcccaggcaggccaaacctttcagttgtagcagggtccagtgttttaaagccctctggaaatgggatagcagtgcttaaaatgggtagtagtgtgcacccaaagatggtttcactggagatttaaaaatctagcacatctgtgctgtagctgctgacatagcagggggagaaataacacaaaacaaacctcaaagtggtggaccggatttgtccccatgaacactcagaagagaggaagagctgtcatgtttgagagagatggtgaaacaagcacttactaccacccactattttcttatttatatttatcatctctcttttctcactaaaatagaaaatccaagagagcaagggccttctctgtcttgttcaaagttgtgatcccagtgtctagaatagtccctggcaccttgtgggtacttagtgaatgtttactgactgaataagtgaaaaatgaatgaaagtaatggttttggaggtatgtacccattttcactgcttcttctcttcttccccatagtctgtgcttctcaatcccaggccagtttgggaataggcatttccatgttttcaggcatttggtcatcagatgccctgcagagccagcacagataggctgtgagcctatatggtgctcagaacagccctgaagtttcttacaaaggctattgatgatgagtctcatagtcctttagcacttcacagtttaccaagtactttcgtgcctattcacctttggcttttcttctttaatccaatagatgcttgagtatgcctatctgtctgaacacagcattagggtaggggaagcagagaagagtggaacagtttctgccttaggagcttgtgagttagtagcagggctaagttccctgtaggacaaacagaatgtgacaaaggctttaagagagtctggcaatgaaaatatgttgatcctgtcccttcccgtgtcttggtgaccctttctttctggcattttcaatccctgtggttttgctgggttctgctgggtgggggtgggggctagggtgggaggttgtgactggaaagccttcctgaattggaaggcttgatgtcaaattagtgctcaagggagcaaaagtaaagtaacaggggaatcttggcaagaacttgaggaggaaagcagaggaagagcagccagatagagactgagtattgacaggagagggagaagggaagccaggtactgctgagtcacagaagccaaggaaacgctaacagggaggtcacggaggttggagatggagtaaagactactggatttggtgactgggaggctgtggcacttgagagagcagcttcagtgggaaggtagaagctaaagcaggagcacagcaaatgagtgagcgggtgatgagaaatagaggctgtgggtgtgagtagcccttccaggagattctggtcaaagagcatgaaaacaagcccagtaccttgaatagagagattggttactgtttgttttgtaagcatggagaaaccagagcacgtcagaaggctgaaagagagatttagagagaggaagaaaactgagtgagtaaagttgcaagaggaaaggagaagaattggagcaaggcccccaagaagatgagagagaggattgaggtcactgtgaaggggccagttctgacaagaagaaaggagaccttttctttctttcagtgctggagtaaagaaacaaggggatatgtgaagagagaagttttgaggtggagaagagagtgctttcattgaactgtgtacctcttttgtcatcaggttttatgttagttttatttatttattcaacagatgtttactttatcctactgtgggccatgcacaggcaccaagaattcacaaataaaagtcaaacttgctgcccaatactgcaatgtggtatttattagtaatgtagtaattattaacatgcctatttctaaatcaaacttgaagttctttgaggacagacattatttatctttgtataattagggcaaggtttggtacaaagtaagtaataatagaattgtgctgaaaaaagtgtgagagctcatgttggttggcttaaatcttcgtggttagattggaaggaaaattatctgctggagtgatgagattagggcagggaggctacctgggagggactagttcactttactctgtaatgggttcttccagcactgtcaggtgactgcctggaaatgggagaaggaagacaccattattggctctgacccctgagtggcgggaagggcagatgctgctgtcctcattctgggggtgaggaaactgaagttgagaaagaaagctgtcactgctcaaagtcacagtacatggcagaacagggacttgaacccggctctcagacccctcatttttctcattgctagccctgaacaccaacagcttcttctctggacagttctcatcagggtgtgaccctgggctctggctttgggtatcactggatggtagtcaggtctaatggagacttggtggccctttacaggctctgcctcagtgtcatatcaggaaaagcaacaaggaaaggaatagcctcagtaagtattgggacagtaagttaattcatgcttctagtaaactcgtgctggctggagttggaggtctgatggacagagtcttaaacgtagagcgtgacttgggttggactttctgttctgtttgtacaatctgtatgattttgggtcattcaaaacctttccaagccttagctttctcattcacaaagtgcacataataatatctgctttatcttgcccatagagttatagaaaaatgcagatagtatatataagggcgtttgtagactgtaatgtgctgtacatgtacaaaaaaagttgttttttaggttcatgacatatgagctgcttcgggtacaggttttgttaaaagtatgggtcagagctgctgttttgtcttaatcgcttgagatcttaggagctacctagaaccaccatggatcttgtaaacacttcttagaactagaaccagtgaagatagtggagcctagatgcttgataatccagccaatctccctgcagcatcagagtatgaattcctgttgaggcagccatcagcattgacagcaaggatatctctggcttgcttttttttcagcagcagaggaaattcatcagcactgatttaaagtcctagtgacctcatatgttactaccatgctctgcagaggtacaaccgccccaggctttgcccagggtcaccctggagctgaccagctgtcttttgttgcatttgaccttgaaaactgggctgtcccagggtgaaagtaaatcatgcagaggtttagagtgaaaacagaaggcaatgaggatttaaaggaggcttcagtggtctgctgagagcaattctaggtctgtgaaggctgaatgagctgcacatgaattggcttgtcaggggactaaaactacctccatttctaccactattcttctagtttggaccctcattatctagtgcctaatacagtgacagcttcttagttggtaagcccttgtctctagtttggtttcaccccagttgcccacaaccagttgccaaagtgatgtactgaaatagaaatctgattgcactatgctctttttctttagactcttagaaaatacagaaaacatttattcccataatacacacttattagatagcgactttctatgtgaaagaaacttagccaagcatttaagatatagtggagattaagacccagcctctattctcaatgggtaggagaaacacacaacccataaactgcacagccagtgtgcaaagaatggagtcattagagtgtaagctccaggactgttgttggccttgttcaccactgtctcctcatcaccttgcatagcacccagcacacagcaggtgctgagcaaatgattgttatagggatgaatgtgtgcccttactttctgacggcttcctatcctgaatgaagtctaaaatctctggattttcataagaagctcttcttgatccagcttctgtcaaaatacccagcctcaccttctaccagtctctccctgtattctgcagtttatctatgcctaaccaataatgcatcaggttttttgatacttctgggtctttgcatgctggttctgcttccctttgcctttggctccttggacaactactacctatttctcagtagctaacaaggatgatgtcttataatcatcttggtattcctgccacctagtcttacaaacatgcctcttcttactttctctgttgagtttttctttgcgtagtgtcattatccaccttccttggctctgttgagcagctgtccctgaagcacttttccaccctccctttacctcccctgcccttgggtttaggcctggaatttgttgggctgttggtggcctggctctgggatgtgatgagccctgacctcccttttgcctttcctaaacactttctccctcctgctttggccacatccagacagctagatctctctcccagttctacttgcacaaaaaccctatgctgagcagggtatgggttttgccagtcccattgcgcagggattggactcagtgtcctggatccttagtcactgtttgggactttgttctgagtggctcattcccctatataaggccatctgcttgattccaagggttgctgttccttggagcttcttgcttggaagctttctgaccaatgggacctccttgctgtttacactgacctgaattaagcctctctttgccaggctccattgggtactttatattggatagctgccttaggagcgagccctgtagttccccatcttccccaaagatgactgccgtctggctccagcctcttctttgcctgaaatgtcctgaaccactgaggccttgcctggtaggcacctcttgaggtagataaagagaaaacattcctcttgtcactttcagggaagcaaaaccacaccattcccttgggatgcagcctttagacccccaagatccccagccagttgttagagggactggtgaattgtgactagaagggggaggttaatctttgtatggttacataattccctttgtgatatagtggttctgtctgtggggacactgccagtggtggccaccacctcctgcatctgaagattactgtttggaagagagctctttttactggatgtctggtgtcatccaagactcagggagactggctatgggtagcagaaatggaaggaatcagagatatctttgcaaaaggagcaactgctacaataattaattgtgaggcctctggcttttcagaggaaccagaagtataagtggaaagcaaagtaggaggtagagtggggtcccactcacaggtgctgggaggctactgtggctcccacaggggcctccccatgtgccacttcaggagacccagctggctagggaaggttgctcatggctgctgaacaaaatgtttatgtcactgtaagcagcactcccaagactggctgaggaaagtccctcgcttcaaaaaggtgattcagtaattttttagtttcttctctgtggttttatttcactgtggtccccactgataagatttcttattaattacgtggggagcatgcatatcatttgacgatcgggtctgcacgagggagcaacaaataggggaaggacttggaagaatcaagagactacactgcggcttgatctttggacagctgcttttacttctctgagtctcagattttgcatctgtcaaatagatataataattcttattggatttagctttgtaagttgtcagaatgatgtcagggatgtgaaagcattttatcaactatgaagcaataaacaaatgtacgttttgtttatagatttcttacattggtttttcggaaacgaatttcttgtagcactttgggaggctgaggcaggtggatcacatgaaaccagcctgggcaacatggcaaaaccctgtctctacaaaaaacacaaacattaggcatggcgatgtgtacctgtagtcctagcctcttgggaggctgagctgggaaatggaggttgcagttagctgagattgtgctactgtactccagcctgggtgatagaacaagactccgtctcagaaaaaaaaaaaaaaaaaagaatggattaggaacaattggattttttaaaagaggtaataataatgttagttcctgtttgtcgaacattgactacatgccatgtattatgctaagcactttataagcatcacttttaattcttaacacattcccatgaagcagtataataatttatccttattttgtagatgagggaaccaaaacctggggaggtaacttatttaaggacaaagctgggaaataccagagctaacatagtggcagcagtgtggactagaggacatacaggtgactggatggtggttttccaggttgaagggcaaagaggtgactgtggcttggtgctcaccccaactcctagaagtccagatgtgccagtcttctggcagagcctgtaacagctcattcttccctcccttggtgtctgggcacaaactagtggaggtaaacagagccacccaagaggctttccttccctagaaaccaccactttaaagctggtacagtaaagcatgcctttgaagacttgagaaaagatgttttaattcctcatgattctttcttgggtttgtgttctgtttctgtttacagtggcgggaagtatgagttttggagtatctcattcctagcccccttacctgcacatccaaaatgtaccactttacaaggctcagattagagcttgcccagtggaatcttttctggacaacttcagttgccatttcaagtatgagctacttgaggataggcaccatatcttgattgtggctgtaactttagtgcatgacacagtgcctatcagaaagcaaatggttgggatttgttattgaattgaacggaaatcttaactcagagtttgaatcacctattagtatttgattgtattgtaacatctgattatcccatgtgtggtggtcttccagaggaaagtatatgttgctactgagtgggcactgtatcttaagattttttgtgtgtcttaccctgttaggcagggaatgaggggctaagtcacatagcaggcacttggagaagccttgggggctccatctccatctactctgaagcaggcttggagagatctgtcatgagatagctgtattggttgctaacagagttataatgtattagttctggagggagagaaacaaaaacagaatgctgactcctccagtagtctcagcatgaggggcatagaaatataggcatctttttcaatctgcattgctccattcctcagacacctattttagggtgagagcacagaggcgtgcaaatggtgcatttccctttgcacccctcaaggtgaaatttctgctgttgcatggggacttttgggagcagttctgtagttactgctgtataatgcatttatcattctgctcccctggcacattttgtaaagctgcataatttccccgtgccttacaacactcactagctccatgatgatgatctatctggtggccacagcctccctcatcagggtctgtgatgcagtggaaagagcaatgtatttgctaataatgacagcaggtagcatacaccaagtcccagtagatgccagattctctcctaagcactttctaggcaccatctctttaatcctcatgacagtcttgcagagtagggattattattcttccgtttgcagttgaagagagtgagactcagtggtggtcgttagtccaaggtcacgtgattagtaaatgacaaagttgctagtaaaaccctgatcctactgcaaaacctatgctactgcataccaggattccattttcatctctgatattgactccctgtgggacctaggaccagagactttgctttctctgagcctcactttcctaatctgtataatgagaagcagttccaagggttcttccaaagttctaaggccaataccattctagttggctagagctcttaatcacctggagaccaatttcttttcacctttgagtttttgttttttgttttttgtttttttgaggtggagttttactcttgttgcccaggctggagtgcagtggtgtgatctcggctcactgcaacctctgcctcctgggttcaagcaattctcctgcctcagcctcgtgagtagctgggattacaggtgcgtgccactgtgcccagctaattattttgtttgtttgtttgtttttgcttttgtttttgttttttagtagagatggggtttctccatgttggtcagtctggtgttgaactcctgaccccaggtaatccgcctgccttagcctcccaaagtgctgggtttatttgttttgttttatagtggcaggctagctgctgtgtattagttccacaacaataacattaaaatcaggcaagtaagagaatgcatagtataaaattgtatggatcagtgctgtccagtagaactttctaggataatggaaaaggtctgtatcagtctaatacaatagctaataaccacatgtggctacttagcacttgaaatatggttaaagtaaccgactgactgaatttttaattttatttaattttaattcagatttcagtagccacatgtggctagtagccaccacactggacagtgcaggtatagatagtgtaataatataaaactaaatagagcatagattcttctatgttccaaccaaggcttctaatttccatttgatttttccagaggtgtaatacctgatgtattattatatttgtattgtgctttcagcacactcaaacatacattattaaatcattgtgtttcctacctaggcggcatatagaaaagatggtttgtgctatgtatgtttttcagataaggaaagttaggcacagaacaattcaatatactcctagcagctgagaaaagtgctaattgtgtatcaaatatgagtaagtggcttatttaaggccatttttggagcagtagaattaggactggaaacttatatcttctgatttccagcctaagtttcctctagttttcttatcactgatatggcaagcatagaatagagagactttgttcatgagatcattcttttaatgttaggcaggaaggccttttcttttcattttatacttttctgtactatttgatcttttaattctgtgtcggtatcatcttaattataataatgaagtagatatttggaaaagttttatgaaatgttatgaggctgtataatatagctgttcctgttttgtaaatgtgagatctgccatgctaatcaaacagagagaagcgggtttttcatgcgggatctgtgctcagaagagaattgaatctcatctcaattccatttctggtagtggtgcagtagtttctatcagaccagtcctcctacagaaatcaactataaactcagacaaaatgtgaaaaaaactacctgaaggaaatggagagtgaccaaaagcaggcacattcttcacaagtgtcaaggtcctggaagttaagactgaggaactgttccaggttgaaagattctaaagagacatagcaactaaatgaaatgtacagttgtgaactggatccttttgttgtaaaggacattactggggcaattggtagaacctaaattagagtctgaagcttcttgaaagttacatatcagtgtttattttttagttttgatggttgaattgttatgtagacagtgatgtcaattttggtggcaaacacactgacatattagaataatggggcatcaagtttggcaacttgatcagagacagtttagaaaaaaataaaggccgggcacggtggctgacacctgtaatcccagcactttgggaggccgaggcgggcggatcatgaggtcaggagatggagaccatcctggctaacacgacgaaaccccgtctctactaaaaatataaaaaattagctgggcatggtggcacgtgcctgtagtctcagctacttggaaggctgaggcaggagaaccgcttgaacctgggaggtggaggttgcagtgagctgagatcgcaccactgcactctagcctgggcaacagagccagactctgtctcaaaaaacaaacaaataaaccaaaaaacaaatagagggaaggggatatagcgagcaaagctagtgaaacgttgagatttgggaatatgagttaattgtaaacaggagttctttgtgtggttctttcaacttttatctaggtttgaatttacttcaaaataaaaagatttgaaaaacttcgaacaataatgaaagtagagcacatcagtgtttgtgggatgcagctaaagcagtactttgagggaaatttatatctttaaatgaatatattagaaaagaaaaaggactaaattcaactgcttaaggttctacctttagaagttggaaaaagagtaaaaataaacctgaagtaaatagaaagaagaaaataataaaggaaagaacagaagttaatgaaatagaaaggagagaaaaataaaagttcaaaagcaattctttgaaaatatcaacagaattgataaagccctacctggactatcaggaaaaacaaggtcacaaaatgcaaatattagaaatgaaagtaggtatgtcactacagattatgtagacattaaaggagactaaggaaatattacaaataactttatgcctataaattcagcaacttagataaaatggattaatttttgaaaaactacagtgtacaaaaacacaagaggaaattgaaatagaaaatcagaatatctgtatgtctagtaaagaaatcaatttattatcaaaaacttttccacaaagaactctttaggcctaggtggtttctctaataaactttatcagatatttaagtaaggaaatagtactatttttacacaaactcagaaaataaaggaggggacacttccaaatttatgaagtcagcataattctgataccaaagacattacaaaaaagaaaattattgattagtatcccttatgaacataaacacaaaaatctgcaacaaaatattagcaaatcaaatccattaatatttaaaaaggataatatatcatgaccaaactatgttatctcaggaatgaaagcttgctttttcacttgaaaatcaatttaattcatcatgtattaacaaaataaaggagaaaaaccataataataacttcaacagttgtggaaaaatcattgacaaaatttaacatttatttgtgataaaaacttagcaaattagaaatggaagggaatttctgcagtttaataaggggcacttataaagcactaacatgataattgatggtgaaaaatttaatgtattccttcttagatcagaatgaggcaagtatgtcctctcaccatttttattcactattatactggatggaggttctagccagtgccataaagcaagaaaaagcaataaaaggcttaaaatcagaaaagaagaggtaaatctgtttctattcacagatgatatgattgttgaattataaaatctaacaaatctataaaataactattagaaccaaaatggcaatttagcaaggtacaaaatcaacgttcaaaaatcaactttttttttatatagcagcatcaaagaattggaaaatttttaaaaagcagtttttttacgattataattttacagttatatcaaaaagtacaaaatatttaggtataaacttaacaaaaacgtgcaagacttgtacataaaaactacaaaacactgctgggagaagttaaagacccaattaattggagagagatatcacactcacagattggaaaactcaatgttgttaacttgtcaggtcttcccaagttgacttgtagatttaaagcaaccccaatcaaaatctcaagagacttttttgggggttgaagttgataagctgattctgacatttatatggaaacataaaaggctgtgactatccaaagtaatcttggaaaagaagaatgaagttgcaagatccacctaacccgacttcaaatttgctataaatctacaaggtctcagcaacaacaaaaaccaaacagcccaattttaaaaaagggcaaaggacttgaatggacatttctctaaagataatatacaaatgaccaagattatgtgaaaagttgctcaacatccctaatcattagagaagtacaaatcaaaaccacaatgagataccacccaacacctattagaagggctactataccaaacagaaaataagaagtgatggccagaatgtagagaaattggaacccttgtgcactattggtgggaacgtaaaatagtgcagctgctgtggaaaacagcatgacagttcctcagagcattaaaaatagaattaccatatgatccagtaattccacttctggatatatatccaaaagagttgaaagcagaatcgtgaagatatatatgcatacccatgtacatagcaccactattcacaatacccagaaagtggaagcaacccaagtgtccatcaaaggatagacgataaacaaaatgtgatatatacatgcaatggaatatcattccgtcttaaaaaggaagggaatcctgacatatactacaacatagatgaaccttgaggaccttaagataagcaaaataagctagtcacaaaaagacagatactgtatgatcctgggatgggtacagagttttagttttgcaagatgaaaagagttctggagatggatggtggtgatggttgtagaacaatgcgaatatacttcacaccactgaactgtacacttaaaaatggttaagatggtaaattttatgttatgtatatttgccacaattttaaaaattggaggaaagactcatcagcatatgtgaaggacacttgtatctacaacttattttaaaatacatttaaaaagattggtgaatagagagagggatggctagatttgtgattaaagcaaatacagaaaaatgttaactatagaatctaggtagtaggaatatgagtgttcattgtacaattatttaagcttttctgtatgtttaagcttttctgtatgtttaagcttttctgtgtgtttaaaaatgtttataataaatattggtggagaaaccaaattgtgaggaaacagaaaacttatttgtaatgcttttggccacaattcagcagaagtacagtgactcggagcctgccttgagcagtgggtggtctgaccttgggcggtggttcatatctcagcctttgcacttactttctccagtgtaagactgaaggaacactagaaaggggccgtaagactgatcatcaagccggtcatggtggcgtgtccccgtggtctcagctactcgggaagctgaggcaggaggatctcttgagcctgggagttaaaggctgcagtgagcgatgatcataccactgcactccagcctggacaacagagtgagagagagagaaaaaaagactgatcaccatttttcaaagaaatggttgtgtgtgggtttgggcagagcatgggaaactgacattgagggcttccttacctagcattctacatgtacactgtcttgtttatttctgccattagtaataataagttatgtacatgttattgtctctgttttacagttgggtgggcggtggtgggggatgcggtcactggaactcaaagaggctaagtatgctgcatagctgagcagggccttcaacccagataatcttgactcaccatgcaccgtcttttcctctatcccagatggccttgttagcatcctgggatattgatgtcttgcccacaaggagaggaatgtttagagtgcaaggtggcttgggttttctttgacccctcttttttggtctgaaacgtgctattctaacttccctgttgaacccaccatactggactcagttcatttgctagacctcttcccattcagctttcttcttctttgttagactggaggtggaaaggaggaaccaggctagatagtatactgcctgttttattagaaaggtttttctggggctctttcctctgtaataaacatgtttaattccaaataaaacaagtaactaactgttccttctgattttcaaatattgctgaaaatattggtgacattcttgcttgcatgtccttttgatgtctgagcattcattagactgagaaagggactgacaaccctattaccaaagaggttttctaagaggaatggccaagtctagaatagaacagccatctgctgccagttggacagggtcccacggagctatggatttgacccaaaggctggcctttgctttgtgtttgcacttttgggatatcccttgtgtcattgctcccttctggctcattggctctccctttcccccaagggctgccccatctgtcaggagtcatgctgcctgtgatgcctaggcatacctggtgatccagaggaagcatactgtattcatgcagtgaggtggcacctcagcttctctgtgctgaaatgcccaaattaattcaccattcttagcagtcttcccagctgagaagactcatggcatttcagagtgttccagtgcaacaggtggggctcaggggagttagatttttctgtccacactcaaatactcttgcctgatttaccttgatatttcattatcttggaagccatcagaccggggagggagctgaagacaggttggtgagtgaatagaagtctgaataatgaagtctactttcctttttaaattagaaagcaaataacttatgtttccaggattgtcatctgacttgtttactattaatgcttttctattcttatgtcttttctctaccccaaccttcccctcttgttctccttgttctgccactcttgtcttcctactcctgctccactttctaatcttttaacatttcttttctgataatatgaaaatgtggaatggtaggaaaaatataacacaccagacttcttcacccctttcctaggtgatagagtcaccatcttaaatagagtccagaataaacattctttcattcagaatttattacatttattatgctctatcctataatagttctctgatgagaggaaatctgtagccaggctaaggaggaccaagaagccaaggtagcaattgatttttttctaacacccatttgtccattgctccagcctcttctgatacccatgaagtatctctacctctctcctctggtgaggaatatggatattcacttgtatcatagatctacttagcattagatgctatttcacttcctgtataaaattttgggtctagagtacccaatatacccatatgttccaaggatgtcctgtctttttctgtttgcttgctgtcagttactcctaactacaagtatgaacttcatatttcctcatgtctcagtcactgacaacttaataactaaagtgtcctgcagtcttgggcaaagagaaccataggaggtagaagagtctggggtccttcctaatatcaggggtctggggtcctcctaatatcaggggtctagggtccctgaggagctagggattctgtaatgtaacacatggaattggaagcccggacacttgggttctaaacctagcttgctgataacttgctgtatggctttcagcaagtcactttgcctctcacttttcctgtctcaactttaggtgcttgcagggatataggtataagttaagatgctcatattatattgtgaccaagccaaatccctactatattgtcttttaaaatacttggtgggccaaacccaatggtgggtcaagaataaaatgtctgatggttgtatttgacagtctgactcctcctttcctttcccatggtatatatgggaccacagctgcaaagtgaagcctttggaccactttaggtcctcagagaagtccatgagcacagtgtcctagaaccagtagcagaggtcctagcaatatgtttgctggacagaggggcttttactacttgtggtgttagaagctggtaatggcatagtggccaagctggtgatggcatagtggccactgactgctagggttgttcccctggaggatctctatttcttggccactgactacttgctttatccccaatagtatgtaccactgagcatcagggtactaggcaggaaggatggggtaacatatcctgtgggtagagatatttcacagggggctgtagaattccaggtctctaaagtctaacctaatcaggggccatgtggtcacatactgctagcttgaactctctccccaaagattccattttaggatagttcttactgttagaaagttcatctttatattgtttttttgtctacctctgtgaggtaggtaggacaggaatttttaaaaataatattaaatttcatgttatagaaagtgtgcatgcttattgtagaattgtggaacaccaaaatcatctgtaatttcacaacttagggaaaaccacttataccattgtaatacattttattttatttattattattattatttttgagggaaggtctttctctgtcacccagactggagtccagtggcacgatctcagctcactgcaacctctgcctcctgggttgaagcaattctcatgcctcagcctcccaagtagctgggactataggcacgcaccaccacgcctggctgttttttgtatttctttgttagtagagatggaatttggttatgttggccaagctaatcttgaactcctggcttctaatgatccacccaccttggcttcccaaagtgttgggattataggcgtgagccaccatgcccggcccattgtagtacattttaaatatttttttctacacgtattttttaaaaatatgagacattatagatagtatgtttgctttatattcatatttccacctacaattatattaggaacatttatctatattattaaatattataaagtaactatttaacatttaaaaataatattgtattatttgaatatgccataatttatgtgattatttttggaaatttaggttgttcccaggtttttgctaccaaaaattatgctatgatcagcatctttgtgcttaaatctttggtcaaatctctgattattttctcaggaaggatttctaggattaggattcctggatgaaaagatacagacttttaaaaggctcttgacacatatttaggatggcaagaattattaaagttcacattctcatccttgatccctacgctcatcaccagtataggggcagatgcctgagtgtctgaagtacttcatttgaaaactccctgtacccacgaaatggtatctcatgtactcttggcatccttaaccctaatgaatggaacccctaactgtgagtctctctgtgaaatgcctgttggtttccttggctggagccacgtttggatcagagtgtacgccctagagagcaggaagcttcgtattaccttggattgactgaagggccagccttctttattagaacatgaaaaaaaaatcctgttctgttacttgtcagatgagaataatgaatatgaaaacacattgaaaactggagaactctataaatgtaatgtgttattattagggctactttggattcaaatcgtaatgctgatatgactactgagatattacataatgcttttagcacattagggggctttgatattcaaatgataatgtagaacctcagagaatatcttaccctgccctcttattttatagataaggaaactcaggctcagagaacttaatcatcttatccagtattacccagaagaatagggcaactaggtcctcacttctaattctttttggtcacattcttggcttgttgtggagccaagtgcagcaattaatatcatgtttgtatgtgcttctaaggtgctgtttaacatttttaccaaatagttttaacattctgcttgttatactgatttactttggatgctattaaaagaatagatagagtcctgggaaatttcaggcagatttaccattagattatttccttttctgaattggtgagcctgaattaatgaattatagcacaaatgcacatatgcacataaagactgaatgggtagtgatctttgaggaaattcatcaattgtaacctctaatcctgctccctccactctgctgccccatctccccactttgctttatcacttgctaatatactgtattctttactcatttgttgtatttattatttatcttcctttactaaactgtaagtaccatgggggcagggttttcattgttgtggttgtttcttgatgtctcagttcttcagtcactgcctggcatacagtagcatttgataaatatttactgaatgagtgaatgaatggttcctgaattaggaataaggcttttgtgttgggcatagagacctaggatccaattctcgttcctaattacctgtataaacttggataagtctttcttctcattgtgccttcttttaacatctgtaaaataaaatcattggttctctaaggttctgtccagctctaaaattacatgattctatacattcttagtttttggtgtttttgttttgttttgtttttgttttgtctccctctgtttcccaggctggaatacagtggtgctatcacagctcactgcagcctcaaactcctgagctcaagcagatcttcccatctcagcttcttgagtatctggtggcatatgcctggctagttaaaaaaaattttttgtgtgtggagacatggtccactatgtctgaggttagtctcaaactactggcctcaagcaatcctcctgccttggccacccaaggtgctgggaacattcttttatttttaaatgcttagtagtaatacaccatttttattttattttattttattttaaaattgtatgcagagcatcaaaatctaaaacagataaaaatataactgttctggttgaattgggaatagggataggaaagtcagggatgggagaaggaagccttatcacttggctgcctactggcaggtttcctttgtggtggctcctgaggcacatccaggagcactagggccctataggacttagtttgagaaaatctttgtctaaattaagtgagaaataggacctgggtcatgtctttgagtgaaaattctgtttatgcttagatatggatttgaagggaatgttgaataatgaaaaaaagatgtgacgtggtattaggtggtggaattgtagatgaagttttctttcttcaaataatttcatttacttatgcaaaaagaaaatcaggataaaatttctgattatatagttctattagaaattcatttggttgaggttagtcagtacacttggtctgtagttcctctttcttccataggtacaaatgtcacacagcctgaagcctagagatctgttttggaattgccagaggattagggggtctttataaagtttttacattaagttctcacagtcattgccccattttatttaagtggactattgttgaagttaatagtggaagtaatgtctaagcagtggtctgacctagaggagagttgtcagatatatgtattcaacaggacaatgaattaaagataaatgacataggcagtttcttttttcctgaatgaataactagattgaactctgtttgggttaccagctgggaaacaagctaatatttgtctagctctgtgatctgaattgtttgaggggtggtttagcttgtttgaattttaatatccattaataattgagagcgattgcaagctcttgttttgctgagtgcatatttaccatgtattatattacattttattaatatagcagttaaagaaacattcagagtaaattgtccctagacccatttgactggtatcccttcctggataatggcagtgatatctatacctggacaatacctttcatttaagtatctcaatattaaaaaaaaattctagttttttttattattcaatttattctgagaaccacttgagccttgttaattccatgaacattttgacactgaacgctgcagagaagtatgaacatagagataccagctttagtagaaactttcttgtggctgtcatcataggaaaagcagagccacttgttcatggccattattgattgacccaactgactgggcctctctgttgctatggtaactgcagcaacatttggtggaaatatgcaaactcaaattttccaaagacacttattttgatgatccaaaatttagggattcaacaacactgagaactattttccagttttcctacttgcccatctatatatttgtaatacttaaaacagcatttttttttttttgcctaatttaaaagtattttacaagtagtttgttcttcaatagagggtttatttgttttgaacttaagggaatatagatactgtctcatagtaacaactttttgttttctgatctgcttatcacaacagtttgttgaattatggcagatattattgtttaattttatatatgaggaacctgaagcccagatagatggagtgactttcccagggacagtagctagtagtgactgagcatgttagaagccaggtctcttgatacccagtttagtgctctttccaatagaagtccaactcaatgcatatcatttttcttcctcagtttgccatttggatgtcacaagatgacattaatcaatcaatacagattaaaataagatcaatgaggactagtagtgaattggaacaacattattaaatttacaaccctccaagccaagagttgtataaacctccatttaaaatgaaagatgatagaaatgaactatctttagatggatttatgattaaccatgtgtatcttttccttagtgacctgtagaacctcaaatcatctctacaggaaatttgctgttatagtacagctgacttttcattattattgtcttcctcagtattcaacattttgtggtatactggaggaaaattgcatttggatgataacattagacctaacttgacattgagtttcattccaggaaaacagatattttaaaatcaaatgtattattttaaaacttagttggagttaaacattaatgtataattcagtatagcctttatcatcatgagcactttttattacatgattgtccatgcattttaaaatataatgatgctctttaattagggccactgaattagtatgcataaaaacaatccatttctcattatactctccctgctcccagccacccagcttgaagttgctctgcctctccatttgttccgcatctctattcccaccccaatgcaatgacaaacaagaaaagataaatccaagcagtagctctgggcagcaactaagctgtgctgggttgatttcaccacctggtggcagaggctaagaaatgtttcaatattccttcattacctcctttctccttctatggctcctttctcctcttagggctgatcctcccatctttctttttttattcagagctcaacaaattcaactctaagcagtctctttctcatatgtgcacacatttatttttccatcctttcaaaaattctaccttcattttaaaattattgaccccaggaacatttattgctcctttccttcttacttgccatcctcttatttatgaattttttttaaaaagtgaccttaattatgattgctgagtctgagagatctgccagcgaatgtgtgggaacaccctttgaagtgatgggctctcagttgaagaaaaggcctatatttggaaatgaagcaccacacaggaaaaggcctagggccttaggccgcagaggtttttgaacacgcgcagacattccctgttgcattagcagagcatttctttctttctttcttttttattatacttaagttttagggcacatgtgcacaacgtgcaggtttgttacatatgtatacatgtagcacagcatttctttctcttccttctctgacaaagctgtttttttttccaaaacaccaatatttaagatacattgaaaaacctgttcttacccagttttattgcttttctcttaggtttaattgaaagcttagttttctactgtttttactgcaaacatgcagcagtttggatgctttagggcagtgactctcaaacctcagcatgcatcagaatcacttggaggacttgttaaaacacagattgctgggcgtcactcccagagtttctgattcagtaggtctgggaaggagcctgagaatttggtttctaacaagttcccaggtggtgttgatacttaaggtctgggactatgctttgagaaccacagccccagtattaagtggtcttttataatgcagatattgggtgatgttttgcagtccattctttggcctaagtgctcacagaagtcaccttgtggcatatggactgggttctagtttgccactttttctttcacagctgggaccacttgacctttaggctgagactttgtctaaggacagtaattgtgtcttattactgtggttctccagccctaagaagaatgggtaggacatattaaatggcatttagtgaatgttgggtatgtgtttggatggaggtggttagtattgcaaggcagcaggcccaggacatttgagtattatttgcagtgtttctgtaagaaaaaggttctgggttatgaatgggctaccttactgtgtgtggcattacatgtttgtgaagtaggcattatatttttgcccccatgttctttctgatagtagtatgatttttattgcaggtcagcaattcattatagatattgctgttattacaatggaaacaaaggagaaaattgttttctgggtaaatttcatttggcagttatattgattagtctttctaatactctacctaatcttatttaaaataagaaagaatacctgaaatacagaagcaagtgacaaataaatgatagctgtttcagggagtgcctgtgatgatattatctagtaaattgcaaatgcagaaggaacaggtgcagtgctgaattgggagactaaataggctcaggaaataccatattagctcttccttatgaccattttttctgcagtgtaattgagagcagtgtagcagacgtcagctcagtggtgtgcgtgattgaagagttctccttttgcctgctgattacagctgactgacatgcagctagcatctcagatctttctcactgtaagggcccttagacactatcctagtctaatcccttcgatttacagatggtgaaatgagacctgaataagggaaactcttgtcccaaatcacacatccagtaggtggcagagtttggacttgaaccctgtcatctgattctaggtgtagtcctcctgttgtgctgtgttgcctttaacctcactggtctaactaagcttacttgtagacctttggattccattaagttacctatggacagcatagatggggaagggagttttgtatgcttttgtctaaatgcttcaaaagccaaaaggaatgggctcagtctctgccatcttctccccatggctgcagccattggatcctccatctgtaggcttagtcgtgggcctagtattgtaccttggtcagacacactgaaggagctcaagttcaaagcttgggagtcagtaagatgtcatctgggatgctatctttgaccttcccttattcctgtgcctgaatcctgttttgataagttctgatagaattggggccctgccttggtgttgtcaactctttcgtaaccataggcaagttgggaagtgggtaggaggataacatttgttgagcatctattttgtgccagttactttacccacatcatgttatttaatcttcactacatctctatgaagttttgtctgtgtttcacacatgaggaactaaggctcagagagattatgggacttgcttaaggtgacctagctaatgagtggtacagctggggttcagatttgggtctgttgagctccaaatcctgcacttattccgctatatctctcagagcctgtagcttggctataaatcccagtttgttcatttgttcagtgaatatgtatcgaatcctactatattctagcctctgtgctcgtaactggagaggcagtccccgctcacatggagcttaccatctatctgagactataaagtaatgatggatgtgtagaatgttaaaaaggaaatgctgtaggaatatagagcagacaagcctaatctagtccagggtgggatgggggaataaatcaggcaagacctcttggaagaggaaacatttacacagagaactgtgttgaagcatgaaacaaccttgcaaaagacctgaaggaaggctagagtggcaggaacatagtaagcagtagtaggctgatgttctgctgcctgcctgcctagcacagcgcctggcatataatgggaacccacaaatgtttgctgaacaaatgcatgaatggctaaaacaatgaatgaatggcaatgctgaaagctcattttgcttgttatataaaaacataataagttaccttgggatgattcatagttccaaacagctttttcctccagctcctcttgtctttctgttgttttgggtttccttgctatattttgaatgtccacacacgtgtcctgcctttccttcacagccatggggtgtcttcctgtctcaaagagagcaaaaactgagctgccctattatcctcttagtggctgccttgagcatgaagtttgaaatagcgtcagtgatttgattttttcctctggggatctggcaattgaaaataaatgtagaaagagccccaaaggagttttttcttgggggcatgagagatgacagcaccagttattggtgcactttgacaatgccgagttatgtaagtggatgaaaaataaaggctattccaccaaagtcagcttgccttacttaagtgattttatattcacaaaagtgggtggtccaaagtgttctgtaattctgctatttgcaaaattcctagtttatgacatagagaaatagaattctatagattgagtttcaacaaatgttaatgtagatgatgattatgtgttaggtactttcacattgcatttaataactaaaatataaatagcatctagtttctagaaaagaatttcttgcctggaaattctggtaagagtagcataaaacattacaaaacctggaaaaggttagaatagcctgtttgttagcataccttggtccagaaaaaaatgccaagctagtttgagtccctttttttttcaggtttaaatctcctagaccccttggggtcttctgttgtggcttttggactgaggagtaagcttagttcacgagtttgaagggtagtctcgactgacactgatgaaaccaagcgaatgatctttggtccttgtttctttattgtttttttttcattggttggttcgttcattcattcactcataaaacatttgttgaatgacttctatgtgcaggccactatagctagagacaagttttacagtcctgtcctcacaaagcttgcagtctgtgggagagacagataagaagtcagaaactggcttctccctggatttggaagcgggagtcttcaccactaaatattcagtctgtgctggttccactctgcttctcccttttttccctttctcctccatggactgactctgtgggtctgtgaccccagagtttgtagccctctctcacctttgccatactgtctaggctcagacagtgttcctttcaatgtggtcttgtctgtgagattccaactgagactgaagttctgtaggtgaggaccagtcaggagacaggtgaggccgggagaaatgctgtggttacagaggtgacctccttgctgattttagagcttctgttcatgcctgctggcagcatgccagtacagaaggagctttggattcactaatgcttggttcatggttagacttccgtgcataattagtatttttaaagtcattttatctaaagacttcaaatttagagactctaagtacttgagagacattttatggattgcagctgagtttaaaaggatcttgcagcattttctcctcagcccttactactagccagctgcttctaatcacattcagtaaagtcctgtgacagactctttcttcttccagcttcttgcagaagatgtcatgccccaggtcggcctggatcttcctgagaagctgcacaacagtgtttctcaaatttcaatgtgtgtgcaatcacttggggatcttgttaaaatgtagaagattctagctctgtaggtctgagtcagtagggctactttccacttctaacaggttcccagatgatttcaattctgtgttctgagtagcaaggaaattgctaaatgtcaggcatagacggggctttataaatggatcatcacatctgagactgtgactttacaaaggaagacacagaaatccaaagaaggagagtgacttgcctgaggtcacacagcaaattagtggaagagaccaggaccaacactcaggtcatcattttccttctgtgttgtatgtgtgcttttcctctgctgatctagcaatgtaaagaagcagaaataaggtttcctacttgcattttcatgtttacagcagcctcacagaaccaaaatcgggtatgttggtagtctagacttgcctgaagcccttctttcttaggttttagtgaggcatttaccacgggatcttaagcagagcctctctatgacaccaggctttgtgttcagtagtgcttgttgaacaggacttgagtcccttccacactggacaaggggaagtgggtggtgccaaaaattgccagatggccccaaatgagtctctagtgtgggttaaccctcataatccaggagcaaaaggtgtgtctgggacactgaagcagccttcagacttcagaatttgcttagcactctttcttttaggatgtgctaagtggcaaagagggcataccgggaatagagtaggtatgtttgacccagagaccctgtcaggggcctggagttggaacaacaaagcagccaaagaacatggtgacaggcgatggttggtttatccgtcaaagaggtcctgtgagttggggaggggcataggagcagacagtctgcagtgatctagaccagtgggtaaccttttcattctataaatatttgttgtgtgcccattacatgccagatactgaactgcacagtgggagatgtggagatgaattcctagagctctggtctcaggaggccctccaggtggattctgcatcaagatagtcttttggagtaatagcaaggtaggactctggtcttggtgaaacggtttattaggtggggattcagatagaggaaacaatcaattcagggtcacacttgctgaacctctggcataaaggagggcatggtttctagaataaggcagatacccagtgatggaaaccaaggaacaagatcagggcaggaatgggcagcacactgaggctgcttctgagctgctaacctctgaaacttgaaatctttcctgatagaagacaggggtacgctggagtaaaggtcacctggtgtggacgtggagccaggcactctgatactggaaagacttagccatgcaggttttccatctgtttacctgtctctccctgcctctggccctgcttgtgagaactgtcttgttctgtggttgtggagggtaagattctggaagcttcttaggatcaggccctctagggtagcagaggtggcagaggctcctctccccatcatcatttgtactaacatgtctcagggcctcttagggctgagatgtcgttagatatctcctgatggaggcaagtgactaatgccccaattgggaaaaaaaaactgggtgaatgagaggttggcttgagaccatagacctgtctgcatttgaaactgacatctaatgactgagctggaaggggtggaatattggtaataacattaacagttgaagggaaacaatgcctaatacctagtaggctctcagtgaatatttattgactgagtaggtattagcaaagtgctttatagttttcaaaatatattgtttcccccagactctgtgagacaggcagagcattatactcatttgatagtaaggcagctgaggctcaagatgttacatattttgcccaagatcacacagctggtaaatggtacagctgacactggaattcaggtcttttgagtcttattctaatgtcctgtctttgaagacacttccaaaaatgcagacagatactgccagggatcttgctattgtacatttaatttttggtatctattaaacagatatggtttttttaatgcaaaacatttttgtaagatggaaatgtgcctccctgtgtgcatttttaccaaattgagcccttgggtctctttatttttaataaggaggaaacactagggtctggaacagctgaaccaagcaccattgctgcctactcattagctctttctgtctaattagattgaaagcaaggaaagaagcagaaaaggcaactattttgtgtttagcagaagtggtcatgtatggtcttgaacactccctccccctttttcacccttcttttcttcttctcttccttcctttgccctccagaaggcttctagaatgcagtccctttcaccctgcagtagcgtatttcttctgccatgagtggtgtctttgtgatgtgtgtgacagacagatggacttctgggaccttagagacttggtgggttactgtatctctttcgtggtgcccagtggcctagtcatgtagagcaaagaggctattgttttttctttaagaacaaattaaatacaaagcatttctctgaagtacaaggaggaccttgggttcctgtaaatggcttaaaaaacaaaagaaaaaaaagagtacacctgaaagattttgtcggtggaactccatccccaagtttgcatgtgaataaaaaattgctggccgggatcccaggcctgtttgtagatggtttcatctaaccatcagtggtgactgtgacctctgggcctgttcatgcggtcaaagttttcagctggaattttccatattcatgctcctctattgcacaaattgtaagacagcaaacatggaaggaaggtgatttattacaactcatagacctacactttatatgaagaagtcttggggaatgccaagggccagttgcaatttttctgagactcagtttctacctaacttcttgagctggccagcttcactttccccctctctccaccccatctccattcttttcttctcaacccaaatcaccccccgcacccccactgttctatgtttgtctccagtcttaccccttttttctaccctccacactgccaccacagtgcttctatgtttcactctcttactcaaaaccctgcagtggcttttcagtatcttccaggagaaatccattctctgtggcagagcttgcagggaatttttggctctaagtcatctcttcaccctgtgtgtcaccaccattcctttgcacagacccttcttatagccagacttgcagttcctgaacataccaggttctctttcctgcctctctgacttcacacatggccttcctttggcctgattttagatctttagattttagttcaagtgttacctcctctgtgaagttttctatatatgccaaggcaaaatttggtgctttcctttctgctttcagagtaattcaaatgtattcctactatattatttattacataattccagaaccatttgtttgaatgtttttctctccctcttacctcaaattcattgccccaaattcattcactagctaaccctttttgagtattgactctcagtcagggattgggataagtaagggctttagagaagttcactcatttcttcctccttgggtgtagagattattatcatcttcactctacagactaggaaattgaggcttagagagtttaaatgacttggcaaagctagtaattggtaggcctgggaattgtaccacgcactatgctagatggctgtagatataaagttcagtatgacacagtctcttccatcaaggagcttgtgatgtagcaggtgagacaggtaagtcatagtgtcagtccaggatgctgagtgcaatgatgagggtgtccagggtgctatggcagcagagtgctgggaactaacttatcctgggggagggctggagctgtgtgtacacccacctctgcatccctagcacttagcactgtgttaagttgttttcccctgtgaccaggactcaaaatctcagtcaccttttgcttcactctctgtattctcattagtccatctgcaacacctcccttcccagtgagtctggaatctgtactgcctccaccctggtccaggccccattcacataatctgcagcaagcgtgtgaggaatgtgcatgagagtgtgaaggtttctggagtaccaggagtctctggagattgcctgttctcagctcatttgtcattgcctaggtttcctggagcatttccatcctaggaaattttttcttggcctcaggacagaacttctaagaacatgtcccaggattgggccctctggcaccgagtccctctcaccccaccacttctggccagcctctgctgtgtactggatcctgagctgcttacagagctgagcgcactgaggtatggcccctgctctccagggactaaggatccagtaggctaaactggatgagggcagaagcctggctagacctgggcctatggcagggctggaccaatagacgggaatcagctgatggcaggagaagaaggttgcagggacagggaaacaggcagacctcatagatgggtcagctagagaggaatgcaaactgatgtatatctaggtgggatgggactgtcagaggtcagaggaaggagagaagtgaaagggctggccccgtggtcattacccagatttctttctgttagggtaacctccaggtggaagttagtttcaaaccagcagagactaggatggcagttttaatctgaaatcaaaagaggtgaacccagtatccagataggaaaccattctaatttttccaggacacaaaaggagtaaagggaatagagaacaaaatgtaaatagctcccttatgtgcattgtgccaggtgcatggtatgttatttagtttccacagaaaccccatgaatctacatttatgaatggggaaactgagactgcaagtcatacagtgaggacacaaaagaacaagcagtatttgaagccaggtatgattccagagcttctcctcagtgttctgcttgttctcaggggactaaaaaatacccccagtggagacaattgagtaaactcctgagtaccacatagtacgccaaaaactgaccagtatgaaactgccacccaaggagcaaaaagttgttaatgaaatatttgccagcataggctgtgttataatacttagaaaaaaaccccaatgttttctgcaaagggtcaggttctttttactttctcttccttgttctgagcatgatcatcttttccaagagctatgggtaacctcatgaccctaagatctctgaaagacccttgtctgttggtaccttgatgaataatcctaaaacaatataggctggcctgctagagccctctctgtgagtgtgtgtgatctgtctcactgccagagctcatttgggctcgtttaataattgaaggccagtgttaagcattttgcagtttgtccttcgtagacaggagtggttttctgtgtgtaaagtgatatgctctattctccaaggacactctgtttcctgaagtgcagctgactcagcatgttcagacgttgccattgggtaacttagatttcatcaagttctcttttaaagagaaatctctcccatctcatctttgagacaagtccatgaggcttggtggtggctggggcttgagatcaccttactgggagtttgcactagggaaagtgggctacaaggcaagctcagccacttcccattgtgctgaggagtcagtgcatttagtcactttaacaaaaaaagaggggccattgcaggtctcatgaccatctgttccccctgtgtcggtcattctaggctggttctaattacagtatccctaaatcatgtgttcttccttgcttccaggcctttgcatgtgttgttctctctgtctcttggtctctgtctctttttcaccttcccccatgctttactgaactcatctttccctgtctagttcatttcaggtcttgctctcccctggggtgaggactctttgtctgcaccctcatagccctttttgtctatgtttctcttagcactcattcccttttgtgggagttacatgcttacttgcctttccccagcagactgagagctctttgggaatgagggaatcatggaatgtatgaacaaatgaacaaattgaggtggtttgtaaattctgctgctgaggaatttttaaggaagaaaatcagcatttactgaggacctattatgtcttaggcactggactagatattttacatgggcagtctcatttaattttcacaatggccttggattgtgaatattagaggttatacaaagaagccaatcttccttcagtctttcattatcatccttctgtttttggactgactcatcataaatgacctgctttataatttaataatgagtacttttaaaacttaaaaaaattactttcttttaattttgcagtttcacagtttagcattgagtacaataatgtatcagatgactgtcaaaatgcagaaccaactcttttgctggaaataattacactttgccaaacccgtttattttgagcagctccagtgtgataatgtactgaactgtaaatgtgagtcttgtgatgtatggattatgtggggggatcagaatggcaattaaaccaagtgcagatccactggatgggtgttaaaaagggaaatagaacatgtccctttgttaaatacattcccctgaagataagtttgtaatttgacaatctaggcagctggaaaaattagaaactgcttcactggagaagctggcctgattcttcaaacttgcacttggaaaatgaaaccattcgttctcttggtgattctctggtcagattgcttgtttctcagtctgcaggcagttcaggatctctatgcatacgtagacctgctcccttccaggccaagtctactgtcttgtgggaatggttgctctaatctcacatcactggcctcccatataggccactgtagccttaaacttggtctgtctaaagggagactttgcctgctagagtgagagttgaagttggacagatgtgtttgaattcagattactatcactgattgacaactgtgttatttagggaaagttgcattcctcctctcagcctcagttttctcatctataaaatggagatagttcattgaatttattgagcacagttatgtgccagccacttccaaggcatttggggaatagacagaaatccttgtctttatggagtttacattttagtgaggagagacagacattaaacctagacataagaaataaactcaaataccatgttagaagataataaatataatcaaaagaagaaaaaagtgagagcagggtaagggattttaggagttctggggaaagtgtgagttgctgttttgtttgtttgtttgtttttgagacagagtctcgctctattgcccaggctggagtgcagtggcgcaatctcggttcactgcaatctctgcttcatgggttcaagcgattctcctgcctcagcctcctgagtagctaggactacaggcgcgtgccaccatgcccagctaattttttatatttttagtagagacagggtttcaccgttttagccaggatagtctcgattccctgaccttttgatccactcgccttggcctcccaaagtgttgggattacaggcgtgagccaccgtgcctggctgcggttttttttttttttttagatggagttttgctcttgttgcccaggctggagtgcaatggcacaatctcagctcactgcaacctccgctccccaggttcaagcgattctcctgcctcagcctcccgcgttgcagtttttaataggcctcactgaaataatgacatggagttggtgagggacttagccatgcagatatctggggaagcatgtcccagtgcaaaggccctaaagtgggagcaggcttggcatattcaggaaatagcaaggaagctggcatgactcaagtggagtgagtatgggggagaataagagaggatgagttcagggagataataccctcaagggttgtaaggatttaataagtgatatctataatgcatcttgctcttccatttcactacccatttttcaaatggtttggagtctgttacccagactccaaacttcagtgagactttgatgtcttccttttctgctcacattgccaatcacttactgtgttctgtaaccatctctctctcttctgtccctttttcctcattcccattacccttaacctagttgtttccaaactcttgcctgtctaatcacagtggcctcctagccattagatctgaggcttccggtctctccatctccatccctccccttaccctttccttttcaggccatgatgcagtattgagccttctctctcctgcttataacctctcagctgctcattagtgtactcatttattcattcctttgtttatacattcagcatcttttgagaatttactaatgctcaaagtcatttgaattcagtctaatggaggaagcagacttgaaataattataataccaattcagaaatgtttgtttttaccctagtttgttgcaaaaaggatttggggttcaatgatttgttatgtaatatgatgagtaatatgcagcagctctctatatatgtacaaagttctgctctctcaacctagcatttagagtcttccctactgaggcacagtcctgcatttctagtttcatctcccaaagtcacgttaagtgaaccttttgcttcacctaaggggataacttgcagttctgtaacttgacttctctttcacacatttatacctttgctcacactcttccctttgccaggagtgctttttgcctaatccatattctgctttttttccagactagctttagatggcatctccttggaaagtcttccctgatgtccaggtcctaattgatcacttcattctctgaacttccagtaggtagggggagagaaagagagagagagagagagtgtgtgtgtatgtgtgtgtgtgtgtgtgtgtgtgtgtctgttcctgctttatttatcttactgattatgaattccttaagtcatggggacattttcacctacagcacctggcacagcaccttttccataggaggcagtaaatctttgaatgagggaatgaatggatgtttcccaggccatgacatctggggagggatttgccttggaggtgctttttcttatgttgatataaatgaagtgctgacaagttcctggagcccagatgtattgaccctgcagggagctgctaccttctggtgctgtaattcagaatgcatgttcttgtagaagccatgatgtaaatagtttctacaagtagttctctcactagttccaaacatctgacttagaaaaacatttttggagtcttgctcattcataagttggggactgtctctgttttgaagtgctccacttgtaccagcaggcaggtggtatctgcttagctatacccacaggcaccatggagtggagaaaggaacacagacttcgggtcatacagagatgatcagctgtaccacttcttagcttgtgaccttcagcaagttactttactgatttgagactcaattttctaatctgtaaaacaggaataaaaatacctaccacaggcataatgaggatgaacaaggtaatctgtgtaaaggacagtgcctagtaagtacttataaaccccatttaaataatcaaaacaacagtaaatttagtttcatttgcatctctgaagttcctgtggactaggatagtgcttctcaaatgataccgtgcatatgaatcacctggggatttcattaaaatgcagaatctgatttagtcagtctgggttgggacctgagattctgcatttccagcattcctatgctgctgatacggagaccatactttgaattgcaagatgtttgggtgatggttctcgaactatagcctgtttctgaatcacctggaaagcttgctgaaatgaatttctgggcttcacctctgatgatatactcatgcagtaagtctggagtggagcttgagaatttgcatttctttcttattcatttatttatttatatttccatagatttttggggaacaggtgatatttggttacatgagtaagttctttagcggtgattgtgtgatttttgagacccattacccaagcagtatacattaaacccaatttgcagtcttgtatccatcacccacttcccacccttcccccctgagtcattgaagtctattgtgtcattcttatgcctttgcatcctcatagtttagctcccacttatgagtgagaacatacaatgtttggttttccattcctgagttacttcacttagaataatagtctccaatcccattcaggttgctgcaaatgtcattaattcattcctttttatggctgagtagtatttcatcatatatatgtaccacagtttctttatccactagttgattgatgggcatttgggttggttccatagttttgcaattgcaaattgtactgctataaacatgcatgtgcaagtatcttttttgtataatgacttctttttctctgggtagatacccagtagtgggaatgctggatcaaatggtagttctacttttagttctttaaggaatatccacactgtttcctgtagtggctgtactagtttacattcccaccaacagtgtacaagtgttccctgttcactgcatccgtattcaaataatattcccagataatgctgatgctactgatttagggaccacactttgagaaccgttgtgctagggggataacagggatgaagttaataagaaaaaacagataaatgatagtgattgttccactccaggatatttgtattctctgccttttagcttgtacatgtccatagagtaactattatcagaccaggcttggaatgtcttattaattattacacagcaacaaaaaccaacacttattgagtacttattatgtgccaggtattgtgctaacacctttatatagtttcacttaattctgataataatcctgtgaaatggatactatagttttctagcttggtgtttcctatgctaaccaattcataagaatcacctggtgtgcttgctaaaaatacagatttccaggtctctactttgattctaatctggtggggctcaatgcctccaggtaatttataagctcagataaagctagaaatctctgctgcagttaatcagctactctgcttctctttcatctatgtccaacacaaaatgccaatttttaagaaataataataatgataataaatttgacactgaaagctgcactcagccaaattttcctttgatgattcagaaagccctttaggatctccaaatgccttagagtcctcattttgaacattcttggactgtagaggtacagaagggccaggtgatagagcgatgtatttactacaaagccagggaagcccatgccaactgtataacttttggctctcttgagcattttgtttggaaagttattctaggaaattggtcttcattgcatccagatggatgctgtgattccacagacttttaagaaaaatggaaaaaaaaaggttttacttgcttgtcttcaggccagtttgtttgcccacagcaaggccagtgtggccaaccacttgttgcagcacaacccatcactacgtcaacagtccctgcacctgctgctgtccctcacctggccagactctttagctcctccctggttttccagccactggcttctttgcctagcctttcccatgtagcctggcattgccttaccatatctcattggaacttggctaaggatggaaaatgggaaaggttcatagttttatttgtagttggaaattcaccaatcccctgcctgctctaggagatcctgtctgcatgccttgctgtgggtggtggagttgggcagtgaggtgtcgtgagggtgagattgtctgtgaaatgtaccacgcttgagtcatcagcaaagactgttatgagatcaaagaaaatggaggttttctttagttttactgatgccaatctgagttgttttttgggtcagctgagttaatggtcctcagaatagttttttcttgctaatggaaaaagtgtttcagtttgatggaatgagcactggaccaagagtcagaagaactagggactcagatcacctctccctttgatttcttctgtgaccttgggccagttaggtgatcatctctgaagaatagttttctctttaaaaaggggaggttgagctcagtaatctcaggatgagcttgatattctgtgatcttgtgatgacctagtcgcaggaaatatgccatcaaaataacttgtcccaaaattcagtcaagttcacccactcagccaatatgtattcagcatctggtatatttcaggtactgccctgggcattatgggggatacagtgattaataaggcacattgatccatttactcattcattcattcattcattcatacaacgagcatctacttattgagcacctatttatgcaagcactatacaaaaagctatgagagatacaaaaatgaattagacacaggttttgttgtcagtcaatatgccatctaaaagggacgtaagattgcaataaggaaagccgttcctaaccatattctctaagagaggacctcttcttttattctccattcctttcctgcttttactggcacttatcatctgaccttattttatctgtttagtatctgtttccgcatcagaatttaaactccatgagagcagggccctttgtgttgatcactattatattacagtgcctagaacagtgcctgacacaaaataaccctcaataaaatactttaaaaataaaatatgtatgaaagaagctagaaactatgtgtcataaaagatatttagataaaatgttatgggagctcagtgagaggagagatctcttttaacgaggacaatggtttttaactatggttgcatattagaaataccttgagtttctctcactctttctccataaataaaaataaaataaaataaaatacttagctgagggcagtagtacatgcctgtagtctcagctactcagaaggctgaggctggaggatcacttgagcccaggatttggaggctgcagtcagccttggattgtgccactgcattccagcctgggttcagagcaagaccccaactctaaaaaaataaaataaattaaaaaaataaaaacattaaaaatgttacttgccaagccctaccccaaattcattaaatcgtcatctctgaggataatgcttaggcatcagtattttgtaagagctcctcaggtactgataatatgtagctgaaataatgtgaactagtagaatagtcaggaaaacttcatggatgaggtgggatttgagctggcttgaaaatccgtaagatttggacaagaaggaagcattccagatggagtgcacagcatgaacaaagtacagaggcaggaatcacagactgagttcagggatcagcaagtagttcattttggctgtagcctaaagaacacaaagggaaataattgaaacaatgttgtaaaggtcaactggggccaatttgagaagacctttaatgccaggctataggatttgggcttcattcagtcatgtagtcagtgagaattgtgaatggttattaatcaaatgatgtgatcaaagccttccctggctgcccttggaggatggcttggaagtaggcagggagaccagtaaggaaacagttgtcaaagtctaagtaaggtgggctctactgagggctgcatcactggtgttggagagaagggctgcagtagagcctgtacaaccaggctgtgtgagggctgcctacactgcagccacaggtctcttttctcttggtggagtcactggcattgcattttaatcaagccaggggagtcagtctgcactggcattctctagcctagctttttcctgtgcatgactgaggagtagatagtgcagctaagcctccttcctgaaatgataggctgttttatccagagaagcatttctacaggcagaactcagtaccccccaaagctacctctgagataggtttctattatcttacaatagcagtatgtgtcttctctagctaattccagcaccatgaatgaagtcagctctaccagtgtctggagctgttaatttcttaagctctgggtgtactaacaacatcctgcctccaaaaagacagctttgagctagggctggggtcaggggcccaagggtgtatttctagtagcttcatagcaggacgctcatttataaacagctgaagtttttggaggcacaggacatctgcacaggcaagcatgccatatgtgtgtggggctggaagaaagtggggctagtggaggcaggatggtgattgggtctagtattgctgatacaggcttatgcagagaggactgcctgcccttggccagatgctgcgggtagccagtgcatccccagggtcatatactacccaaaaggacaggcaagcaagagttgctagtgcagatattttttctttccctctgtctgtttagccagggctgacctaactcacagtcatttgtttcagaatgtcagtccctgagatgggcacagactttacagtttgtaaggatcctttgcacccattatctcattggaatctcacagcagtcctatgaattaagtaagataagagttattgctccattttactaatgagaaaactggggctaggatagggtaaagtagcttattctacagttgtgtggatgtaaaatatgaaggctgtgacttgttgaagctggagccgagaggccacttgtcagggctgccttaggtggaatgtatacacattgtggtagaagaagtagtgaatgctttggctccctcataatctagctgggtgattctgcgcaagtcctttattatgcctctcacttttgtcagctataaaatgggaatatagcatctatttaataggattattcgaagattaaaatgatcattcattatgaaagtgtttagtacaatgcctggcatacattagatgatgttcagttcgttccttggtttttaaactttttaattttgaaatatagattcagagggaaattgatacagatgatcctatatacgcttcacccagcttccctcaatgatagaatcttatgtaactgtcgtatcatatcaaaatcaggaaatgggcattggtacaatacctcttgttaactaggccacaaatggtattcagattccctgtgtttttttaaagaaaaattatatcatttctgagtttgtttctggttctgaaatgtttttatacagtgtcatcattatccttgacttttctctggcatctaactttttagaagctttgttctctgttggttttcataacactgtgtatttctccttgtcatccccctgtctccttcaccatcttctcttcttctcttctatactgtatgtctcccagattcagttcttagcccctgctcttctctctgtttgttttgttttgtttctccctcttggatagggtcttacttttatctttattctggaatcagtattcccacctccacttaccaagcccctctctagttccctgtttttgactatttgctgaatataagctcaaactcatcatatccaaagctaaatttgtcatttttttaaactccaaactactacccagctacctccacttgacttccctgcttccattaatgagttgtcattcaaaaactgctcagggctgtacgaggggactttttggtgatagatatgctcatcatcttgattgtggtaaagattttactagtgtaggatgggcatggtagataatgcctataatctcagcactttgggaggctgagatgagcagattgctggagcccagaagtttgagaacagcctgggcaacatgatgaaatcccatctctacaaaaaatacaaaaattagctgggtgtggtggtgcgcacctgtagtcccaactacttgggaggctgagcggggaggatcacttgagcctgggaggtggagattacagtgagccatcgtgctgctgcactccagtctgggcaacagagagatcctgtctcaaaaaaacctaggtgacaaagaaagactgtctcaaaaaaaaatttttactagtgtgtacatatgtcaaaacttatcaaattacacacattaaatatatgtgtgtgtgtatatatatgtgtgtatatatattttatatatattttaatatataaaatatatatattatatataatatatatataatatatataaaatacctcaataaaacttaaacaaaaaacttcccagagccagacatgaatcctggccccatcactcatacaagttactcacctttcctctgcctcatttttctcatttgtaaaatgagggttataacagtaatttaccatattggattgcagggaagattgagtaggtaaagtgcttaaaacattacctgatacatattaagttcttcaaaagtatttgttgatgttcctctcttattcatctcatgtgccccatgtctggcacagaataggtgtttaataagcgtttgttgaatgaatgttgccacagtcttgaagtactattttccctccctgacttttatttaaatattgcttcttctgtaaggtccagcttaggttctacttgatctgtgaggtcttgtctacccacctgagccacgaggccctcctggccaccctcctctatccccagcactgatgctttgtattagcgtatttgttactgattcacagccagatttttggttttgccttttttttttaaagtggctttcagtatagatatctttcttcttcatctacattggacatcttctgagggcacatgtaatttctgattttttttctctatgtcctcttcgcctatgctgggcatatagttggttttcagtaaaagtagaatgaatgaatgaatgagtgaatggtgtatgatttgcaaaatattagggagacttcagacgacaaattcccatgatttagcttattaaaacaaacccacaacaggccagacatgatggctcatggctataatcccagctctttaggagactaaagcgggagagaattgcttgaagccaggaatttaagaccagcctcgacaacataacaagactccatctctataaaaaaattttttttaattagctgggcgtggtggcacatgcctgtagtcctaactactcaggaggttgaggcaggaggattgcttgagcccaagagtttgaggttacagtgagctatgagttcaccactgcattctaacctgggtagcacagtgagaccctgtctctaagcaaaccaactaaccaaccctgaacttacaagatttagccttggagggaaagagagagagagagagagagagagagtgtgtgtgtgtgtgtgtgtgtaggtggcaaatggttccaagtctgttcctctgaattcaccttctcttttggatcttaggggaactgtaggcctcctttaaccccttgatccaagtttggaccctgaccttactgtgagtcccctgagtgcagctgaggcaggctggcagtgttctgacttgtctgaatgatagtgcatgagagatagggaactagacaaagagagaagaaatgtgaagcatctggctcacttagtctaggacactcagtctctggccctaaggggtggatgcaactcccctaactctagcctggtcctctgctttccagctgcagccccttgcctctgtgggaggtctaatcagaaactttccccccaggagctccttcttggatatatgacattttaatgtctaagattggaggacctggtttctacttctctgaatacacacttcctttattcagtttgagagatatatccaggatgatcactattcaggtgacacttctgccactccactctgcacaaatgtagttctggtttgtcctttatttgactctaatagcatgatgataccttagccatatcatcaagaagacatctatattctgatagttacacaaaataacacattattctgtgccatcccagctgggccctgatcctgcttacaagttcatcattattaataccattcctttggattaagcattgacctttccagcagaatctcccactgggaatggtaacatatcaggttcctcataccttggagtacattcctttatcaacatgtgttctttctcgtcacaaggaatctggaacaatttataagctctggattccttcaaacagaagagacagcttctggccaaataataattgtcaattacattgctcctttcatttacgaagtgttgtatgtctcatatgtttctttaaatagttctgtgaaataggtatcatatgcccattttgccaatgaataatctaagattcctaggaaaacaatggcttgacttgcccaaggtcacagaggtagtaagtggtggagctacctaactccaaaaccggtcctctttccattgtaactcctggctccttctaccagcatcttccctttgatctgcctaggcttattctggctttagccccaggttttttctgtgattccaggctaaactatttattaatttctctgctgcttctatacctttttattcttgggagagttccatggattccagcaagaagaagttttacctctcaggccctgagattcttctgtggcttctcttgctgatgatggaaccctatccatttccctttgctagagctcttactagtttctgcttttattttttctactgtcagatttgttgttggttctgctttctccctaatctgtcccatatttctcaccatttgtcctgtcagtattgctctgattcattaaggctcccccatctatcaggtaggcttggtttcccacgtgcatttatttatttactcactcactcattcatcaactgttttctgaatactgatgtcaagcactgtatttagagttccaagatgttaaaatatggttgaggagatcaaggaatcaggagccctttacaattcaatatggaaatggttgtgatggcataaacataagatgtttgtggagcataagaggagggatatgtcatccagatttgagggagctggtcagaacagtcttctcggaggggatcatgtctgaactgactcctaagggatgagcggaaattgccttagagtgagtgagtgatgatggtggtggttgggggagttgtggagagggcagagtttcaggcaaaaagagctgcttatatgaagatccaaagctgcacattcaggaaactgcaagcacttcagcatgactggagcagagcctgtagggatggtgagggatgagacaggagaggtcatctggaaccagattgtataggactcctattttgttctgaaggtgatgaggggccattgaaagatctgaagtagaagagtggctgtttaaaatagtgttttagaaagatcactgtgatggcagggtgaaagatggattggagaaagggagagataagaggcaagtcagaaaactgtgacagtgattgagggctaagttgcggagaacttgaactaaggttatggcagcaataatggagagaagtaaataggttcagaatatcagggaggtggaatttctaggactagtagctgattagctgcccatggagttgaggatgcatgctattttgtcttacccttagatttgtctgccttgctgtctcctacaagcagttcctttttgctgtctgaagagaaacctgatgtttgtttcctagttaactatcaatttccctttccctaccccatcttccctctgagatccttctccttttggctgactctacctttatcatctgtctgactaatgtccaggttattttttcaatttgtacttggaaacctgagtgacaatttgatatttctttaggcaaccctcattccccctctgcctggatagttctatcctcctccaagagtggtacctggggaggagtgaggaaaagggcaaccttatttgcggagctatctcaaaagaaagaggaggcaagtatctgccttacatttttagaatagaagatctttaaacacagggaaagaacatataactaattctcattgtgagaagagaaagcccattgtaggcagattgaaatgcaattggtgacattcagaactgacccctccatggtagtgctgaccaatttaatcttttatggaatagaatagagcattagcatcagaaggcactgtagagtttatccagttcatcaccctcattttgcagatgaagactctgaagtctctagggatcctgtggtttgctcaaggtcttaattatttagtagtagaactgggaccagaatggggacctctagttcagttcttgtttcactagtctgatgaaagtacatttttttttttttttttttttggtcataagtttgacagtttgacagactagagaataagagactcacaggatgttttaatgataatccagtttgatattttcctctttccccaagacactggaaatagctttccgagggtcatggactgggcgaggagaagaagggcctgcagacttatagcctagtgctcttcccagcacagtccaaagtctcatctagggcccaagacttggacaactgtggctccaaggacactgagcagaatcattctttaaatatattacaaccacattcagtttcataagatcgaaagacatgatttctttctttttaccctgaggttttttttttttttttttcttatttgatagaagtgtatggctgtggaaattacgtcagtttaattaggctgcttgacacagtacttttccactgaatttactaggaactgtgaatttgttgtaacaaactgcactgccggctgcagtatctgattggcatgccaggagcatcactagcgaacagctaaatagagattggggagaaaactgggtcaggaaacaggcctcctgtacctgcagaggctgcagaaggcggcgcagaggcggcaggtggccacagcatggcactgtctcctagagcctgagccaccaagcgccccacccccacttagctctgtgctgcaacccccaccccaccaaccccctttgcaggtgattgttcctgtggccattttgccttctgtttctctaaagaccacaaagcttttatatctcgcagctcaagaatggctttttctcaataaaaaagacagagactggtttagaccgaaacttcgttagccactggtattctaaaccatggatcaagtcttttggctttgcagagctggttttgtcaggaggctgaaactgggtttgagagttctgcacggtaatgaggaaagggttggtaatgtttcagtttgcctgtctcctgtattcccttccttatcagcccacccctccccgtgccctgctccaactatgtagcatccacctctgacagtgtcagtgctgagcaccaacacaaattaggagctcctagagaaggaatgagtggttatgccagaagggtcaggggaagcttcttgaaggcagtggcattcaaactaggttttgagtgatgaattgggtcaagacaggaagaaatgaagggaagatgctagtggcctcccatgctggtctcaggactgccttgttaaggctggagacctcctcagcaatctggggttggaatctatttcagaatttcgaggctgactgagaccctaaggatctgctcatccaagctccttattttatttatttatttatttatttttcaagctccttattttagagatgggcagactaagggacagagaggaaaggaccagagcataggccagtctagtgctgttacaaccacacagttcccatttgtgcacttgtcctcatttctaatgggtctctgaaaacattcacttcttctttctgggtttcactcctgtcacctctgactcctgtcatgtgagctctgagagacccaatggtctccacttataaattacccattagagaaggagccctgggtcctgctgactttggattccaaggtcactccaatctctgccagacaactgcatccttcctcctcagactaagcctggttcagccagtgctggttgttcagcaaggctggtgcctccccaagaatgcttggtaggaatgggtcttgcctcagagcaagggctcagattctcacagtcagaaaagctgagtgtgtcaagaacccaggccattgcacttttatgctattctgtgagaaaactgggctcattgtgactaaaaattgtttcaataaattacacttcaatttattgaaatttgctttaaagacaatgtttgttagaacatttaaattctgtacagcatctctttcgcttttgaagagaaacagagggtggaataaaagcaatctccctaataaattttcctggatattttggatagtctccagtatgaggaatgttgtctttggaccaagtattgatgttacaactgaaatgcagaaatgtgtacccatattcttatagatgtactaaagtttgctaatcaaatgaagtatttgtgtaggatctttcagggccaatttcaagaccaacatgttttggaagacagttgataattcagatgtcaagtagtctctgggttgagcaaagttggaaaaacagatgaacccattaggataggtgaaacttctgcctgtgagaattaggctttgatgacccagggaatcaggcatccaggactgatccagttctcaagcagaagtttctgtcttgcactgcattgcattgtgttttgggtcagagaaggtggttttaaatgcctctaaataatttccttggtcttggaaggttatatctgtttgcagactggtaggccttgcatctagttggtatttactaaaataaagaaagagggagaaggaaagaagaaatgcttcttgatacctagggaggtttctactcagaggctgacatagtcatataaatttccatttattcttaaactaggacttgtcactagagtcacctaacagttcatagaaatggtttgaatagacagagtaaagctggagagagattataatttgaagtttatcaagagtcacctctcttcctagaacagttacattaaaggaattgaaaggcagggcctgtggttatagtcgaatgccccagcggggctcagtctggcatggtggaggctggctgggtagtctttccaggatcccagcctctttggtcatggacatttatcttaagagtagactttagtcctcaaccattcacttttagctgctgcaaagggtaccttggagaacccccactcttttccttgaggacttcacttctgcttcactggttcaggctgtggccaatgttcctacttccagccttggaaatgcttttctgtttcttggagccctcattagccctctgatacaaaatcaacacagggtctaaagcagtgggctgcattttctcctcttccctcggctttgctactatcccaatccctgaacacttccctgcatatactcccctggccctagatacctactcctctgttctaggcacacagagcagttgtgggctaactgatctggcacttgtggtgatgcctgcaaggcctacacggccaaggtgaaggagggattatagtgttcatagttgatggctgttaccttgtcacttaagatgacctacggaagtggagactcccctttccctttttctccacggctgtcctcttccctacattaatgactcctcagttctgatcatggttagaaagctcaggcagcttcagtgtgcctcttccttccttccatatttatctgttcaatgatcaaatcctgtgatttttacctttggaatttcttttatatctctccccgtgttttaacttttgctgccacctgaacaattgcaaataagcttctcttcccaaagctctgctctggaaatgtctgtcctggttgcagcctctacaatgtcagcttccattgcttgctgcccaggcctctcctcatttacttgtttgcatctcaggcttttatactaaatgttcattaaacattctacgatctatctagggtaaccttgtcagaacagggagggaaaaaggaaatatctatcttctttcttgtcatttctctcagatgaatgaattaaatatttttattgccttgaagattaattatcttctgtccccaggccagctttagtattctagctgtatcttcttgtgactggacctgccagttggagtttctgcccccactctcaactctgtttttgccaggtttttcttcatcatcatatcatgtaggcttccgcagtgagtcacagtccaggggttcagagagactagagtgtgacctgcagagtttagaataaattttgaattatctatcttagagctgagagacctcctgaaatcttctggtcctttctggcacatgagatactgttattgtacttaacaagtgaaatacctgagacctagagagtttaaatgaccaacctaaagctgcccagctaataaattatgagtcctaatgccagattttatccttccgaggaaagccaactcttaatttggaaaaggcatcaactctctggattctctttgcagataaaacagtttaggacctccttttgtaataacatgccttgttagtgtaaggaaggaaagacagcttagaagtcatttccttggggcaggtgatgtctggtagataggcagatatcccttgtcccttgtcttctagaaagctcatgagctcagcatgttggcaactctagtcctgcatgcttcttgttcagctaatccttgcaggcgctcatgtacaaaatgattttttgtttgtttgtctctgaagtggcttctcagtccttgagggccaccaggcactaattcctcgtttctgcccatgttccacctaactaaaaaagtaaacttatgttctttgtacatgtgctgctcccctgacacctcctaccttccccaaatccctccattcttctgggtgttcttctgttcttctagttaccgaggcttggggttctctgtgattcagcttgatgagagtgctccagtcagttagttcatctgcactcaccaactctgccattttttctcttgaacatgctttgcaaattcatccattcctgtttgctcccttgtggcttccaccagccatagccgggtgtctgcgccctctttcctggaccactgtagcagcctcttagtgatcttctggtcctctgtcctttcatccatcatgcagagtgatagactcccaacttttgaacttaaaacttggtaaagcaatcaggccaaacgttatagctctttcatcaatcaaaccttcagttcccatataggtttgtcataccagtcaaagtggactactcctgtctgctgcatgtttactcatttgttccctccatccctctctcccttcttcagcgaaaaaatacagtaatgtttctttgcaaactataaagcatgcaaccttttatctgtccaacaaagtaccctgctatgtgaaagggaagaatggagttttggatttggtaactacctactgtgtgctgataatttgtatttagtatcttatttaattctcttgttattcctgtgagttagattgagttatgttcacgttacagatatggaaactgaagctctaagaaaaaggtaacatgttctcctgctctgctgccatcctggtgctagacgcagagtggtgggtgggaactaaagtctttaagagggcaggagggataaagcacacacataaaacagctgtcatggaagaaaatgctcattgtcatgagaactgtagttatggtgctgtcaaaattctgagcatgatgaaatttcttctagctggaagattaggaaagacttcatggagaagttggattccgctgagtgtgaaggatgggcagtgttttgacagaaggagctgacaggcagagatcaggaagggagggactagcataggcagaggtacagagaggaaatgctggtagtgccattagaaatcattagtttacagtccactttggttggagcatggacttcttgtggtggaagatgtggtgggatgtaggctgtaaaagtgagctgtaacctgttcattgatgaacacttaaacgtctagctaaaggattcgtggtttgttctataggctcaggggagccattagcaggttttgagcagaggagttgctagtctgagctgaagtctagaaaggttactttgggcatccaatgaattggagagaagaagaaacagcagagagaggaaacacttaagaaactattgccattgtccagtacaggtgttttgagggcctgaactagtagagtggcagtagaggtggaaaagaggggcaacatgagagcagaaccaggaaggcagaattacaggatttggtggttggccacacttggggagtgggaggaggaggtgattctgaggtaactacaatgatggtgatggcagcacctaacagaaataggaggatcagtaagggaaacagatttgggggtgggaagggatgaggtgggggtagacggtgtgttctgttttgtgcagcttgaattttaggtgcaggtgaattgcctatttcacatctatgttcagtgttcttcaccacgactgccaccattcctggtccccttctctcctccctctttattaagcaaacttttggctccttttacaatgtggctgagtgaaactctcaagtagtctttgtttatctttgaatttctgatgtaccatccatgtcacttggtatttcctaaggccagtctccccattgtatgcttccacacacataaatatacttacaggtatgagcacctggtggttataactggcatagtaacaccagtggttcatgtttgtatgaacgtttatggttggcaaagcagttagaattgtcagaagtatgttgtacttctccgctaatcccctaggtagggtcactgaaccattgactcaataagctaaaaaggttattagagaataaacagtagattttagtttaataataaatgcaattggagccattagcatatatcaaataggaaagttagatgacttttagctgctataagtacatagattttgttggaagagatgatcaaattttaaaatatattcaggatgatagcaatgccgagattgatgttttgtgggtattaagaatagctgtcatgtatagggtactttgtacaatactgctctaagcattttgcatatcataattcaaatctcatggtaacctagcgaaatggcaactatgttattcttgttttttaggtggggaaactgagacgcttagagttaagcagcttgcccaaggtcacatagctcaaataaggcagagccaggattcaaactcaggccgtctgtttctagaccctgcactattagccactatgtgtactgccccttggtgatatttcagtcagctttgaaatattgtttaaagcaaactctagcccactactcttaactcctagaaggtagggatattgtcttcattctgtctgtatccctagtgccagcacattgcctgacatatagtacatgttcattaattttttatttagtttttttttttttttggaggcaagagtctcaaaattcaggctggagtgtagtcatgccatcatagctctctgcagccttgaactcctgggctcaagccatcctcccacctcagcctcctgagtagctaggactacaggtgtgtgctaccatgcctggctaattttttaatttttttttagagatggggggtctcagtatgttgtcctggctggtcttgaaccgctggcctcaagtgatcctcctgcctcagcctcccaaagtgctgggattacaggtgtgagccaccatacctggcctcattaaatgtttgatgaatgaatatctttctaagttactttcctaatctgatatgaagtgaaggtggtcaaggaagtttcttacatattcctgttgttgctgctagagatgctgtatttcacagaagaggtatggtatggtgatatattaataggtacacctttggtgtagatttggacaaatcactgagactctctaagccttagttttattatctgtaaaatagaaacaatgatggaacctgcaatgtagggctttagtaaggattaaatgaaataattcttgtaaaactcttagcattgtacttggcacatagaactcagtaaattttggattatattattactgatggaaattttgaaaccgtagaagggaaaaaagtcattttttagagtaggaccaaattattaattaaaatggaaatatacagtgattttaaagtgccctggtatttatctgttctcacactgctataaagaaatatctgagacttggtaaattataaagaaaagaggtttcattggcttatggttctgcaggctgtacagggagcatagtggtttctgcttctgggaaggcctgaggaaacttacaatcatagtggaagggaaagaagaagcaggcatgtcttagatagctggagcaggagcaggagagagaaggaggaggtgctacatacttttaaacaaccagctctcacgatcactcactcactatcatgagaatagcaccgagagggtggtgctaaatcattcatgaagggccacgcctatgatccagtcacctcctaccaggccccacctccaacactggggattacaatttgacatgagatttggtggggacacagaaccaaaccatatcaggcctttagagatctaaaataattgttgatgggtgcaaaaatgttttgtttgctcataaaattatagctaacacatttagagagaattaaactcaaagttttggaagagttgtttttcttttccatctaatgtttcttaatgaaatataaaggaggtctgggggaaaaacgttttcctacccctcaaacaatttcacacttccccttttgtttctctgggccattagatattcagtggacaagggggcaagtgaaccatcatgtaagcatctactttgtccaagatgctaaataatagctaactgaattcaactcttaggatagtcctgtgaggttagtactataattcctattgtgcaggtgagaaaactgaggcccagaaagtcttagtaacttggccaagttcacagaagattgtgatagaacctgaagttcaacctactcttacctggactactgcagtagcttcctgacagtctgtgattgcagagctcatgttcctttctccctgccgtgcacccttcctgctgtgtgtggcagagggtgacagcttatgttcacagcttcactttagagctgctagaacaggaattcattcaaaaatatttgacctgtatattgcttgaaggcaagacagggccagattcctgagtttctcagtcaccattgctgcctacttatttaaaatatattttttaatagtgttaaattatcatgaatgctcagccctgccagtgtggcccctctataaatgggacatattattaaatggaacttgacaagagaaatctatgtagcatagctttttgaaaacttggttattcccttctggaatgtattttaaggtttcaaattgtgcttttgatagaccgtttaccaacattaggggttaatggggtccttagtcttcttagagtggcagagaaagaaatgaatatatagtggtgtgttttgtgagtggacctccccattctccatgctaggctgaaggtacaagtggaggcagaaaagtcagacaggaaggggataggatcagtcaaccaatccaccccaaccacagcctttctattgctatacattagatttgtttttctgcctgctttctatcactataaattagatttgactttcctagagtttcatattaatgaaatcatgcactatttacttttttgtgcctggcttctttcactcggcacagtggtttttgagattcatccatgttgttatgtgtttcagtagactgttgcttttgtattgattagtggtattccattatatggttgtactatgctttgtttattcacttatccattgtattagttctctcttgctgcataacaaattaccacaaacttagtggcttaaaacagcacataattaatagttcatagtactgtaagccagaagtctgggtgggattggctgggctttctgtttaagatttcacagagcctaaatcaaggtgtcagctggactggattcttacctggagactctagggaagaatcagcttctaagcttgttcagattgttgggagatgtcagttctttgagattataggactgaggtccctgtatctttgctggttgtcagccttgagttgtcgtcagcaatagatgctgctctccagttcttttatgtagcaccacatcttcaaacccagcaatggtcccttacatccttcttgtgctcctagtctttctgatttctccttctgccatcagccagagaaaactctcagcttttaaagggcacgtgtgattgattaggcccacctggagacagtcctttgatttttggtagagctttatttttagaatggcctttctaatattaaggtgtactttgactttttaagacttcccttcccttcccttccccttccaagtcttctgttctccagactgaaaacactcatttttttccctttattttttatgtgatacgttgtagcatagcattaagtgtactctctggaattataccataatttgatttaaattgcagctatgccacctatgaactgtaatattgaaaaagttaacttctctgacctatggtttccttatgtacgtatactttatagaattaaatcacagattaaatgagctaatgcatgcaaacaaaattcctaagcccttttcctgtgacattatatacaccccatatatgttagccaatattatcatttcaatattgctaccttttccccattttgttctttttcttctgaatgtggttcattttgtcaatgatcttaataaaatgtactccccaaattgtatagttgnnnnnnnnnnnnnnnnnnnnnnnnnnnnnnnnnnnnnnnnnnnnnnnnnnnnnnnnnnnnnnnnnnnnnnatgtgatacgttgtagcatagcattaagtgtactctctggaattataccataatttgatttaaattgcagctatgccacctatgaactgtaatattgaaaaagttaacttctctgacctatggtttccttatgtatgtatactttatagaattaaatcacagattaaatgagctaatgcatgcaaacaaaattcctaagcccttttcctgtgacattatatacaccccatatatgttagccaatattatcatttcaatattgctaccttttccccattttgttctttttcttctgaatgtggttcattttgtcaatgatcttaataaaatgtactccccaaattgtatagttgtcttaaagagattcatagcccctttttcaataattctattttagaaaacttatcccaaggaaataattagagatgttaagattttttgttcaccacacactttataatgacaagttattgaaagtaatgtaggtaccccatagaagagaaatagtgaaataaggtatattcctatgatgctataaagtctggaaaatcacattttcaatgaaacaatgatatgggaaacataaaatgttaaaggcaaaggtcatgatataaaactgaatatatagtatgactataagctgtgtttctgaaattatatatattttattcacatgcagacaaatatcgataggaaaggactaaagggaatataccacgtgttaagtggacagtgggattatgggtgtttttgttttccttattatattctttgcaataagtgtatattacttttataacctaaaaaaataaataaactttatttaaaaattattatgtatatgtatatgtatgtcacccagaacagaacctgaaaatctacaactttattttgtaccagaaaagttgcagtcatgtcagtagatcaagaaggtcactgtgatgatcactcagctaggaactggacttctggcagtgggattctagcaagctgcccctggggacaggacagcagcactcctaagtctgctgacttgtcgggctgtgcctaggaagagagtctgtcaggctgggttacgtggcaccagtcagctgcaaaagatatattcatcattcttgctgctgtgttcaatgttatattgtatacacttgctatgataagctttgatctctctgtcacatcttatcttcattattgactttttaatcccagaaagagtaaagctttaggacctggcctcaatacgttttgttttgttttaatcacaaaatcaaaagtgatccttacggtgaggggctctggggtaccagagggcctcttgattaggggccatgttcacgtgtttgtgcctcatgcctggcagtggcccagccaagctctgctgtgcagctgcagcaaaggcaaagattcttgggctctgtgcacaaatggctcagagtcagcctgtcatctggttgttgttgttggggatagaatggagacaggaaggggctgtgctgcctttccccatacactacaggcccactttttaactgtctctgccctgtggcatcacccagggaacttttccctaggccttgtgggatctgcctgtgatgttttgggaggccattctgtttagccactgactcaaattcttaacgtctgaaggatcatcagtctctgaattcagccattacttacagagttcaatgcatttacaagaccctggtgaggagctgaggaagttcagagataaattcagtgtcattcatttagcatttcctgagtactaatgtgtcagcctctgagccaggagcagtaaggggtacccagataagtggcttcaattcaacaaacatctcattaagacctactatgtacacagcactgtgcaagccactggggatagaaatgaatgaaatatatcccgcgtgattaagaaagttataatcaatataatttgggaagagacagatttgaaaaccacttaataataagtagagaaagtactatttctatagcaggacccagaggaggaagcaattacttatgaagtggcccatccacttactagctatgtgcttttagtcaaggtatttaaccatcctatttctcagttaatctataaaatgtggatataatgtgttaatccaccaaaagtacctagaataggtttagtaatcactaaatgtaattcttttccttttcttcttctcctctctccttccttctcaaggatgagtggtgaaggtacactgaagtgagagcacagtgtaagttgggcatgatgaggagtggggtggtgggatgctgtgtggaggggtttgatgaggtaggagtgcaagtacttgtgggtaattttactggggaaagaggctagagaactgcattgggtctagaccatggaagatcttaaataccagacaaaggaatttggacttcggcaatgtggagcaaaataattcacttgtactttaggaagaccattttgacagagtgggggagaggtcagaggggagaggagcacaaggaagctgctgcacaatcccaggcaagagctaaggccagaattaagactcagaccatttctctgacaccctcagtgtcatggaggctgagcaagatatttagttccaccctttctatgtgcctgtggttttcttgctggaggaacactggtttgagtgatagtttattccatgtagcccataacttttaatattgtgaagttatgttcagccttctgatctcaaggctgatctacccatgcatccctgcccatttggctgtactcatcacatcatatgagagttgagcatatacacaagatctttctgcacgtggatactagtggcttgtatagagctgagccactgtggaaccagctgaactatgaaatagcctcatgtaggggagcctctctgaaaagaggcccagtatttatttacaacaatgaaaattaccttgatatagattccatataaagatgttttccagaggccccatgatatgaaaagagtggggatatcaagggagatggaagtagtaatattggttgaaccacttctagatactaggagatgggttgggttctttagcatatttgatctcatttaatcttcactatctggtggggcaaatattactacacccattttacaatgaagaagcaaaggttcaaaaagtacaggcttcatgcccaaggtcagacagcttacatatgtcagaccttggaccaggcttttaatgtccatgagcctcaattttctcatctatttaaaaaagtcataataaaacctacttttagggctattttgtggatcaaataaggttctgtacagataaagagaaaatcattccctggcatccaggaactggcctggtactatcagtcactgggccttggtgttgctgtgagctggcctggcactcaggtaggtcttgatgttctcctgttgaacatatactacttgacaaaacgtcaacatcagacaaggccactctgtgaccatgatggatcaagacaaaaataagaccactttgtaatcatgtgtgaacacagacaaaacatgaacattgtccaagccataaatcaccaaacatcccacttttctgtctaatagagtcctttctaatatgttccaggctggagtgcagtggtatgatctcaactcacggcaacctccacctcccagagatgctccatggtttcctgtagtgtgtgttctccttcacagcaataagtagtaaacccgtctgttcaactacacacaagttcctggtagtcttgggctgcagggcattaacagtgaatacacttggaaaccgctcagtgctagacaaatgttagtggatgttttaagtcagttatctatcgccacagtaatgttacgtaataaatcactcataacctagtagtttaaaaacttctaggttctactacgagaaacagttatttgttcatgtgtctgtggctcagctaagtggttcttctggtcttggcaggtcttgctcccatgcctaggtcttggctgatctttgattaggacaactgggagtggctcagcactgttccacatatctcatcattgaacagggtagcctgggtgagttctcatggcagtggcagagggcagaaggcaaaaatgagcataaatatacaaatgatttttcaaatctctacttgtgtcacatttgctaacatctagttacccaagcaagtcacatggctgagtccaaagccaaaggatgacgggctggtaaactgtctctgaatgggaaggcaattcatggcaaaggatgtggatatgaggaggagtaagaattggggacattcatccaatcagtctataatagtgttcttatgttttactatcttctaggcatgcttcctttttatccccaagtgctcctcacatttttcctaactctgtagtgtttttctggaaaaagctggaagcttcccctcccctttttcacccccattttaggcatagtcctactccagaatttatctatatgcaaatacttattttcagaatttttgcccacttggaaaaaagatcctaaaagatagacaaggagaccaaagaaggtggtggcttaggaaaaatgtctagccaatagtaggacagatacagaaactcagaactcaaaaggattttaataattagctttgagaggcagtctgtacttaaatgcttcccatagtgggtagtagctcaccaccttacaagatataccactctgttttagaatagctctgtgttaaaaaggttcttctgcatattagaccacattctatgttaataacactgttttgccatctggaaccctgcagaacaagttttctatgtgactgtctttcagttatttgaagagtcatatgcacctccacctaccacgtccctacaaatctttttttccaggcttaacatgtattgtttcttcagcagctcattatatgacaatttctacatgttttaatattctggttactttgatcttattattccttaaattcagtatcttaaaatgtgagagagagtcccgaactgaccacagctctccaaatatgatgtgaccagcacagaggacactaggaccagttcatttttgtgggcaaaaatgtaatgcagcccaggatcctattttttgagaggctatgtcacattgctgactcaaattgcaagtatggatcttttttcacaagaaatgctttttagtcaggtcttgccaattctgcatctctacaactttttttttgaaactgagtttaggaattcacattttaaattataacctatgtgtttctacttgttcatctcgttgagtccagagcatctcatccaaggtactggctgtctctcccagcattataaattctgtgtgtttagtaagcaaaccttcagtctttatccaatttgttgatcagaagtttagttaggccaaattgagggccatattccttggtaaaccacaagatgcctctaggtaagagcttcacataggaagatttctgttttagtctctggcttatattccaatgagtatcattatttattttgatgctcaaattgtcttatatttagccagtgggaaccccttcaagtttgcttctgtgtcatttgacatgcccccatcattttttgagcacttttttttgctctctgacacaagatgttacaggttcatcttatactttccctgcctcagtcctagaatcagccatttctccaagaataattttttagtggagaatgatttttagaaataaaaatcagctaggcgcagtggctcatgcctgtaatctcaacactttgggagcctgggaggtgggagtatcgcttgagcccaggggtttgagaccagtctgggccacatcataagaccccgtctctacaaaaaatcaatcagtccatcaatctcaggtctgggtgtgcttgtatcattggagattgctgctcacaggctccctcagtggacaaagctgagaaaacatgtgagagaaaacgtgagaaaaacatgagtttgtgcatatacagacacacacacacacagccctacttttctatatatatttctgtttctctgtctgccttgaaaataatgagttcacgccagcgtctttagttataatgcagcactacagagttccttctatatctcactctttcagttgtaattcatttccctgactatgagaaacctggctcccattatcttcaatacatttacttacttgctcagttctcctgtatgaaaccgacccattgcatcacagtcctgctgactaccttccttgcacaggttgattccccaccaggccacagctgtccagccaggctctgaaccttcactgggaccctgctgccccttcttagccacttttctcatgtaggttctgatgcttggccactttcctcacttaggcttaagaaggaagctatcctgtcttttttttttttttttttttttggttgaagtgtaacttacctacagtaaaatgcacagatcttaaatattcaactcagtgacctcttatatttgtatgcacccatgtaatcacccaaattaggcacttcagtaagcttcctggatatacctatcccaaaataaccattattctaaactttcaccacagattaattttgcttaactttttattttgaaatgatttcaaactcacggaagagttgcaagaataatataaagaattccacaaatcccttcacccagacacagaatgtattaacattttgccacatttgtgtcctctctctttttaaaacaatttaacgttgatagaatactcttatctaatctacagagcttctgtatatttttccagttgtctcaatgatgtcttttatgacaatttttcactttgatctagcatccagttcagaatcatatattgcatttagttgtcatgtccccttgcctcctttattctggaatagcttttctttatctcttatgacattgacattttttaagagtacaggacagttgttttgtatataatgtccctcaattggttttatctgatttttcctcatgagtggatttcacttacacacttttggcaggaatactaaataagtgatgttgtgtctgtctttagtgcatcatatgaggaggcacctgatgtcagtttggcacattattagtgattctaacctacatttcttgtgtaaggtggtgcttgcctcctttctctgctataaggctaccatttatcctttgtaattaagaagtaatctgtgaagagatactttaagactatgtgaatacccttttcctcttcagacttttgcccagtagttttaacatgcattgatgattcttgtctgaattaactaatgattgcaaaattattttctagcccaattattcttttacatttattatttttggcatcctactataagaaagagctttccctgcttccctatctatctattgctcagtatatacagtggatttttattttattcaatgggctataatctactgtcattattcattttggagctcaagttctccctgatttagctagtgggagctgtttcaggctggctagtttccttttgacacgtctcctttactcttttatcactttcttacttcgtggtacaaatacatgttccaggctcaaactgttctttcctcatcccaaccctagaatcagccttttctccgaggagctctgatccctcttagttgaatggtatttaaaagccagggtctgtgcaccaagtaaactcattgctgctggggtgtcagtgctgctgggcaatttcatgttggtttaactcaatgcgtgtgtgtgtgtgtgtgtgtgtgtgtgtgtgtgtgtaaaactgtgagttcatactgataactctaattctaacctgatatccacagggtttctctttgccttctctcattctatatttgtgtttccttcaactacagtgagcattctggctcctagcaacattcatatatttcctcatttgcatggtcccacaatatatacaaaatactttcagaattgatacacgcatgcaatgaaagaaaataacctacaaagtagttaaattttttttgcattgtttgtttgtaaacagaagttatttagtcaaagtactgtgttcaagagttattctgacccccttcagagcagttatattatttatttgaaatcagttttgcctacttttgagtttcatattattattcttaaagatttacttatgttgtgaatatcaatatttccccccactgctgtaaagcagcagtccccaacctttttggcactaggggccggtttcctggaagaggtggggatgggatggtttcgggatgaaactgttccacctcagatcaccaggcattagttagagtctcataaggattgcgcagcctagatccctcccacgcggagttcacaatagggtttgtgctcatatgagaatctaatgccaccgctgatctgacaggaggcggagctcagatggtaatgtgagcgatgggaagcagccgtaaatacagatgaagcttcgctcccttgcctgctgcttacctcctgctgtgtggcctggttcctaacaggccgtggaattttaccagtctgcagcctaggggttggggacccctgctgtaaagtattctgaatgaactacactgtatccattatactgatgatgaatatttgtgttatttcatatttttattatgaataaaactgctatgaacatgcttgtacatgccttttgatagaagtaagcaataatttattttgggtacttgagtgtccacatatgtgtttagctttagtagatactgccagacagtttttccaagcagttgttgaatttacactcccgtcagcagtgtaagagttccagttatttcacatcctcgttagtacttggtgttgacagtcttttaattttaacctatcatggctactagggaaagggttaaattgtttctgagaagcctgccataggatatttacctggcctgaatctattaattgcctgtcttttagtttgattgtccaactcacatggttccattttgttctcagtacaagtactgagtaacttaagtaacttggtggcatgcctttactgaaatccagatgtattgttgtgttaggcttttttagttggcaaggaccagagatattagcagattattattgtgaagactgtattgtactttagcataagtgaggaaaacaggtgaagcaaatgccttataaaagaacaatgggaaagtcatttagaacccaaggcaactcaaaagcctaaaccttcttgagccctcagcagtgggatctattgattcttcctttagaactcacatcctggtgacttagcttcactttactgttccttcctgctgcttctgactcctctgcttgtacctcctcctcatcttaaccttccttgtgtctatttcttccagctactgctccagctaccaactggaggactcactccctagaactgtttcaaggcagaattttcactaagccgtttcacaggctgtggtcaatctatgcattaatccacattgagacaggtgtccatccatagtccaattaggtttggccccaggaagcaggactgcatggtatcaacacggccatttatgatgaagacattcccttagaagggcactatgggaaaagcaagcagtctgactgcctggctagtttaattgtatatattatagcctaattactgtgtatattatattgtaattcagtagacatttctcaagccctctccttatctgtcaataaactattggaaaaggaaatgaactgtttatactgaagaaggtttttttgtttgtttgttttgttttgtttttagtctcgcttttagtactcgcccaggctggagtacagtggtatgatctcggttcactgcaaccttcgcctcccaggttaagtgatcctaccacaccacttcagtcttccaactagctgggactacaggcacacttcaccacgccgggctaattttgttgtattttctgtagagacagggtttcgccatgttgcccaggctggtcttgaactcatgagctcaagctatctgcttgcctcagcctcctaaagtgccgggattacagatgtgtgccaccgtgtccagcttgaagaactcttcatagtgaacctatgccagttcctaatgcttatagtctcctttcatatgttctcaaataatatataagtcctaaaatgtatctgtagaacagggtcaagcccaaagtgaattttattctgtagatagcagaggttaggatgcgtgaggtatacctggttgtttgaattccgttttacagatgagggaactgagggccagagggaggcaaagagatttacccaaagtcacatggctaggaagtgggggcggggggcatcaggacttaaatccaggttttctggttccatatccagaactctctccattacctcacactgacatgccccatactcgtgtccaagctgttaaaagcacaaaggagatttgataaaagcaaactatagccaaggcaagtggtgagaattgagaggaggcagatctcctaaaggctgaggtgatctgggggactgcctcaggttttgaactaggccttgtagagttggttggatttagaatggtatggagaagggagaatggtacaaatgaagatacaaaagtgggggaaatgagatttttccagagacagaaaagagactcgtgttgctgggttagagggtttatttaggaaaggagtggtaaaatgtgtgttaaacagtaatgagactttgataactgtgacaactttaattaaaaaaaaaatcagatcatgcccatgcatgtacggtgggtcatgcctgttatcccagaactttgagaggccgagggaggagggtcgcttgaagccaggagttcaagcagtctggacaacatgatgagatcctgttcctacaagaagtaaaaaaaaaaattggccaggcatagtggtgtgtacctgtagtcctcgctactcaggaagctaaggcagaagggtcgcttgagcccaggaattcgaggttatagtgagctaggttcacaccactgcactccagcctgggcaatagagcaagaccctgtctctaaaaacaaaaacagatcagatcatgatattatggtgagaagaaagcttaaagtcattggttgctaagactccaggctgaggcgaaaaggactaaactaagatgatagcagctggaaataagtcagacttgagaaccattgagaaggcaggattaacaggatctggagacagcctaaatataagggtgggagagagataaggaaaagagttagaactgtcacttgagagtttgagcctttgtgacagggacactctgtatcaaaagaggagagtatcagaggaggaggaggcagtatgtgtagtgagttagcttacaggctttggaccaaagcagacctgggaccagtgacttaactgctctgagcgggtttgctggcctgctatgtagggagacagattcccacttctcagagtggctgtgaagatgggaggtattgcaggtaaagtgaaattctataatgtcacatgcttgacatccaggcacttaaccaaactttagctctcttcttctcaccccaacttctctggaagatagcagaacctagttcaagatcatttttttcacaggcatacatacaatgtgcttttttttaaaatgtatatataacatatacacatatatatgaaataaaatacaaattcaagcccacagagagagttaaagatatcttagtaaggctaggttcttccagaagcaaacagccgtgctgcctctctggtgtcgccatggccttccccagttgggaccatttctgagcttagaggtggaactctggtggctcactggattgcagtgtgcctgtaaaacgtgcccagcttccaagcactgcgtttctaatagtttggaaattctggttgtcaccccagagatacacggatggaaaccgggtttgggcagagctctagcaaaggcggcaccgagacgcccattccctcgccctgttaacccaggcggcgcaggctgcccagccagctggggctgccattctggagctgcttctggtacgcttctcccaccctggcggctgtgcccgccaagggctcgcagtgcggcacagagcataacccagtaccgtaccaacctaaaccccgttactccccttccaccctggccatcatgtgtttccgcacgtacgcctcgttgccatagcacctgaaggcgcccgggctcattggcacccggcgagaaccaatcagcaggcctcgctgtccatctggcaccctgggtggcctttgggctgcggctggctacccctctctggtagaggaaagcggcccctggctggtggcgtggggctggcctcgcctcacttcctctccttggcgtacctgaccctgagttctggtccgcaacccggtgttcgtttcccaccccactcttccgcgccccgatttccccgtttagaatgttcaacaatctggcggcgttctgtcgccatgggtatccatgaggagggcaggcgacagaactttgttgccactttgcagccgttcccctaagaaatatccctggaaacagctccttgatcattccagaggtgggcactcctagccccaggcaggatgttgtttgggtcctataaatctagggctctcccagccttacgtccctggcactgggcttgccagatgtaagggaactggatgggtggtttatttccatctaatatgagaaaaagaagggtacataccgttttgaggaagaaagcttgaacctgaaggatcacagaatcctgcacctccgctagctgtgaaacactgcacaagttaccttgcttccctgaaccccagcagcttcatctgtaaaatggttgtaacaaaggaatctcttaggttttgtgtaagtctatatgagataatataggtaaagcagttagccaagtgcctggcctataagtattctataagagccagtcagctgtttttacaaacaggtacaactgtactgctaagaaccaaagtactcacatccaacagttggcaagcattttcacattcatccaatttttgcttaaattattcgtttgttttaactcattaatgcattcaacatgtatttactgagcatattatcagtcagctcttgccctggtccagctgtattttctaagaccccacccctaggagagttttaactggccttgcaagaactgatgaagtctagcctggtgggtggatgggagatcttatccctctggcattggggtttcggaatttgttttttgcagctctgacttcgcaggccgaggtccctgaacagagcagacctctctcatttctgggaagcactaagacagagcagctttccacagccacctttgcttctcaccccttacccttggggagttgtgtcccccttctccagaaggccccaatcagcaagctggaacttgctttttctatagtggggtcctgtttcctgtaactgacttctgttacagtcttctgtgctttgctgtgctggagttgccagaagaaccctactctgctttcagtgcccccagcatcttcatgctgtatccttctaatgctgtctccttgtccccattgtgcatgtcagggtctgtctccaattggactggattggccacactgctgcttatacttgctttgggatcatataccttccctgagtcccttctctttgtactgccatctcctcacccccatgccctgtacttagattgtgtgcagaaagactactgagcaggcagtcttctagatgtctgagagacagaggacctaacacatgcacagtctgatcagacatcatagtgggataagggccatgatacatagtgctgtgggaatagccaggacggggcagctggctctgcctgaagaagtcagggaaggctttaccaggaggtgatgtttgaacagtctttttttttcttttttttttttttttttgagactgactcttgctctgttgcccaggctcaagtgcagtggcatgatctcagctcactgcaacctccacctcccaggttaaagcaattcttctgcctcagcctcctgagcagatgggatcataggcacccgccaccacgccccaccaattatttttgtatttttagtagagacggggtttcaccatgttggccaggctggtctcgaactcctggcctcaaacgatccccccgccttggcctcccaaagtgctgggattacacacgtgagccaccacacccggctgagcagtcttaaaagatttaccttggtagacagtgggagaaagcaaatttcaggcaaggagcatagcatgcataaaggcctgaaattgcgtgatgttcttagagaaaagtaatgtgatgtgaatagaacaaaaggattatattatttggtttgaaggttcatgagtagcagagggaggaaatgaggccagagaggtaaacagggacctattcatgagggccttgtaagatgttttaggctttatcctaccaacactgggatcctgtgaaggttttatacatgggcatgacatggtcagatttgtgcatgaggaaggcaggatgcatggctgtaaggggataaattgtctcatttgtcctctagcgagtctgtaaggcaggcagggaagacactgttatctactttttacacctcagaacactgaggcccaagaggtcaaatcaaataccttgccctttaggtctcagagccagaaagaggaggacctgggactcatctagcttcctggtcctgaatctctttctcttgggcgcattgccattgttaacagcatcttctagaaagctgcctgcagctgagcagtgggtagatgctgacaggagcattatgaagcaaatggtcattgatacagtttcactgagggagtataacactgggattttgcagcctgtggtgttcagtctcctgacctctatgccagcacacagacagcaagaagcagtggggaactttgagcttcaagctctacattggtttgacaaaatcaattcatcactgtctcattcattaatgtgctgtctgatactgacatttgtcaatggcttgtttctggaagcccctggtcctcaaggctggtcagctctacagtcacagccccagggtgaaccccagcagtcagaagcagggcttttctctctctgcattttgtaaaataaaataactttaaaacaataacaaaagtaacatgatgtagcagtaaagaacactagcttggagatcaggcagacctgggttttagttctgctgctgccacttgtctagctgtgaaggttatttaatatgtatgagcctcagtctccttatgtctcaaataagcaaagtggaacttacctgaaaagattgttgtgatgactaaaatgtgataatgtttataaagtaccttggcatgacacctggcatgtatgaatcctcaatatatgctggctttaattcctacagttactgttgccctagccaccactactactgccaccacagttaaataatatttggaaaatagagaatagtagaaaaaatatcttacaatcttaccaccatgatgcagctacccttataatttaaatttccttcaaatccttttcccccactacttctaaacattcctgattttatagcatgtatattttatacccaggtgggtttttttctctgtggtggtaactgcattacacttattttttctagtttttaatagatttttccctaattataaaaattttgtataaaattcggagtatagaaaaaaagaaaaagaaaaatcatactcattgttaacattttgatgtatctccttccattcttattcatgctttattatagagttgagatcatattacatatacaatttttatgtaatttttcatatcatgaatattttcctattattataagcatcattttccgaggctgcatattagtccatcagatggctctaccataatttacataagcatttcccaattgttcgacatctgagttttctccagttcttcaatcgaaatatcttcctgtaacagacctagggaaccagcctcattacagccaggaagcatataatgaacttgtgctgcatatatggtcctgagtgaggcatagtgggagccctcaggtcaatcagacacagagccagccttaaaggagctcagggactaaacaacctggaaatacttactggtaattaagcactgtcagggagtccacttaagtgtgggtaacccttttccctgtggaagctgggatctgggaagcacagcttctacacaggaaaaagcctaggaagccttgctgccccttctcacctatgaatgtgcagattggcttctaatgctgaaatgccttttgagctacactgtcaggggcctgagctaagaaccattgaatattacttccaagtggttttcactaggagagaatgagaaacactaccaaaggaacttgtgggagaattaagagaatcagagtggctctagtcttagttttttattttatttttttaattgacagataaaattgtatatgtttactgtatacaatatgatgttttgaaatatatacgcatggtggaatggctaaactggctaattaacatatattacttcacatagttgtcatttttgtggtgagaaaacaaaatctactttcagaatttttcaagaatataatagattaactgtagtcatatataataacatggatgaacctggaagacattattttaagtaaaataagtcaagcacagacagacaaataccacatgatctcattcaataaggaatcactcatacatgaatttaaaaagttgatttcatagaagtagaggatagaatggtggctctagtcttagttttgtcacagacttgccctgggacctgaggtaagtaagttatttctccctcccaagcctccatcttctcataacataggtgatctccagggcccttccagtattaacattccagagtacttgaaacattcctcttgccaggagctaaagtgagtatcctgataaaggtcacaggataattctctaaagcctagagctcctcttaattagtcctggggaaccatttatgcctttgtattcccagtcacttcctcctgctagcagttgggacatatggagactgaagggcaagaagtatctcccactggttggaaactctggattcagaaagccaaaaattgtcttttatgtattaggtatttgttcttttatgtactttgttctttcattcattccctcatttagcagatgttaactgaatcccaggccttgtccaatccatctgtgcaatacagaggtgaatgagactcaaccatgttctcaaaatagatgtagtctcataagaggacaggaaacaatgataaaaggcaacaagatggttgctacggtgggggtacatttaagggcataaggacaggtgcacctgagtctgcctagaagcaacagcaaagaagtcttagtagatactttgagattttaaaggataagtagaaattttttaggtatgcagtagaggagaggacattctgggtagaggaagaggcatgtgcaaggggctagaggtgtgagagaacatgacgtgttgaaagaactgcatatagtttgtgtggctggtaggtgaaagggagagtggacagatgagaaaaagtcaaacatttctccacagaccagtctgtttccactgaattctttgctcattttatcagtccatacgagagggatggtctttttagttcagttttcaaaaactgttatctttattgccttatctttccatttttacagtaacatatgctcattttagaaagtttgaaaaatacaaaaagtaaaaggaagaaagggtttaaaaaattactcatggtctcactagctaaagacaactttaatatctgatgaatttccattcaatattttttttattttctttttatgtagctgtgaatgtgttgtaattataatcttaacttttgtatgtgatgcttctttctatttccttcctaaattttgccaaaaatggatgttagtgtcattagaaaagaactatgattataaaatatactggctgaaatatctatccattttctttgtctttttttttttttacaggtctcttgtggctcagagcataatttggcaataattggtaagtaatttttatactgataactgtttcttctgaaaatcatgtggcagaattggagaagacttttggttaaccaaaagccatggtgcgtgcactcatgcatgtgtgttaggggagattgggggaaatggaagtttttggttgaccaagggtttactagaagctccttttctgaatatttcgattcatatcattgagcatctttttaaggtacctgagctggcctccctgcccgggaagtggcatttgagcatattaaagaactcacaggctgaggggcaccatgtgtagaaagccagacataaaaaggaagaatgattggactgcttctggtttttcgaataaatccccattctaagttctttcctattggtttggctctttctttggaaatatgcggctctgctcactgcccttgctgccttgtatttagtggcactcaggaactcccagttggactcaaacctctggttaatagaggcttcctcttagttggccctggataatcatagtttagtgttttcataattagatctatgagtaattcattcaagaaggcttctcattaacttccacaggtagactcagtttccatctcacagtacattaaagagactgcagtgtagggccagactgcctgagttcagtacagacttctacttactagccatgtgaacttggacaaggtattgacttctctatgctcatctttaaaatggggagggcaatagtgcctacctcatagtgttgttgcagggataagttatgtaaagcacatagaatgacgcttaactcctaggaggggctttggtaatgttcgttattattacctgatattatatgttaaagtaattgccctccgctaggctttagtttccccatctgtaaaatggagaagttaaaacagaaaaccaagtttccctccagctctgatattttaggactcttgttacaaccccaccactgactgatttgtgtcaataatttctgttcctggccactcctgtctcctagcttctaactttgaacttctaccaggccaggcccttgtgttttcctcatttcttgccgattcacagcacctaaagcagtgtgtggctcttagcagagactcacacattcttttctgaattgagctggactggctcagctgcctggggtggcagtagtttgaagcactactttgcaggcccaaacatgatgtacaaagaggcagaaccaaggacagcagaggaggtggggagtaacagggactggagttagagaaggagctagaaaatgtaacagcaaacctgcatgctttgcagcaggaccagatactttataccggaactgcttcggcctgggtgtaattaagacaagctaatcaaaagagtcaaaggcggtgcctaggacattgctgctactgctatcactggactgggagaggctggcttcccctgggaccaacataaacaagaagatggcagggaatctaaatttgtgaaagcacaaaatccagatgaaggaatgggtcagagctagcaaagcagcaggctgagctgacgtaggcagcctggggctgtagaaggagcaaagactctgcaggcagacagccttggttcaaactggctccatctctgtgtgagcgtccatattcttctcatctttgtaatgggggtaatcattccgcctttcaggattattgtgattaggtgagataatttatgtgaaatggctggcagatataaattcctttggtttctcttttctcttggttgggtagcgggaggggagaaatacttgttagtgtaactgttctagtgaaatatttctttgttggaagagaaacaatgacattctggaaagatgtgtccagtgttacctgtgtggaggccatcagaggcagtgggagaatagggcatgctggcgagcacttgaggacagacctgttattttccattttatccccagtgcctgggacctggctcacagacttctgaatgaatggtttcagagtcaggaaaagtgagtgcaggcacagggctctgcacatatgtacctgcctggtggccaggagcaagaggctctccatcactggaggaatgaggccctcagtgggtgccctgcagggtgcaggctttgaaacaggaagctacaagaagctgcctgttagtcctagcaggaggctagcaagagggagacaagttgcaggtgaagaagagttcctgccagcttaaagccatgtttctcatggggttgagctcctcccctcaatcctactgcctttgcctgctttagagggatttccctgccttcagtttcattccctgaactctagcccttcagtgcctggtgctgtgtcccacatgtaaaaggcacaaaatagttatagactagactagaagagaacataaagcagccaaactttgcccaagggtataagcaaccctaatgtctgatgaatgtgtgacagatgaatcaacttggaaagggaggtgaaacagagaatggtgaaaggacatgattgagaacctagtctgtcttaggttagtggacacaactcctcaaagtatatttgttgtatctgctttgtagagacgaaacagactcagaagttaaatgggttaaacaggttgtagagataagtagcagtgttacctgagcaatggactcgctgcccagcgcacatagaagcgaatgctgtgacactggctttgagaaaagaaagtttattgtgagtcaattgacaaggagacagggaggcaacgctcaaatccatctccccgatctgggagtgggtcaagcttttatggcattttaaactaatcccaggtgatgccagtgcagctggtcagccaggctggtgatgctaacaattaggctgctaaagcttttctcctgagcatgccaggtaactttggctctgcactacctgtaacttaagcagtgattacttggtttgaattggtcctacggttacagcaataaatagtagagctgtctgcctgacttccaaaactgctcctctattctgtcatttccagtggcctgaagtagtatgggtagtagttaagaagagctcaggcactggggacagattgcctggatccagattctgtcttctccacttacaagctgtgtaacctgtataagtggcttaccttctctatgtcttgatcacctcatctgggatataatattattgacttcatagggttgttaggtaaagtgctaagaacaatgcctaacacaaaagtaaagactcaataaatgttagctgctattattattattctatattaagacctcaaggaaggaagtaattataagcctgaggccagggtaggaatctcaggagctagagaaggaagtgtctttcccagcctggatatcagggtccatggcaagatctcagcatagctgcaggatggatttgtaaactggagcctggggttcccactggggaatctgcacatccaagcagccctggaaacagtcctagcccagatttgttcaaggacaggattctgctattcattgtcccagacagggactcaggccctgcatgttccagcctgaagcaagccccatggaagccacatttcagtttcttgagaagatggaaattttactctgctgctttatgtgcttctgggtttctttgttccccttcttttgaaatttggtttagttacttccttagttttccaattaagtttctcttgacatgttttgtctttgccaccaggtgcccccatgactagacagaatggtgaagtggtatgagttcctgctttagactaaggaagaactgttggagctgagcatagagagactcaggtgacaatcagaaaagagagagctgaggccattgaccatggctggcttgggcattctctgcctatatgccttgtacaatcactctgcctcaccaagcctgattcctcatttgtaaaatcgacatcatgatacccactcccagaagttgttcttcccaatggcataggtatgtcaagtacatgctcagtacccgccatgtcataggtgctccgcaggtgttgtccacttggctgcttcactgattcactctcttcctttccacctaggatttctttccacatctgacaaagctcactggctaactcccatttgtgggcatagactgaggtgaactgagggcatgtggccatcacttgctgagaagatccctgcctttcagaggcagggtccccagatccagctctgctttcaggcccctcacctctgtgtctggatgaattggctccagctgttgtgcttccaccaggagcagcttattttggcttgaattggcaatttgcttgccttcttcctgatgtgcagttgttttgtcttcccttcctgcggagaaaaaagagctgactgcgtttcctctctccctgctccacacagacccttggaaggattttattggtggccctttcctggagcactcaggcttgccagacaggcattgttaaagggttggttattggcaggaaagtgtgatgcctcctcctcctcctcctcctcctcctcctcctccaagcagagccagttcttttactaaattggagctataatatatgcatggatttttttttcatttcacagatgattttcaactgttgaaccattgtacctttataatatgtatggcagaacatctaaccttggcatgaaaccatcaagcaatttcatgtaagaatttaataggaaaatagagaaataactctttttttggcactggatattcctctgagtggtgatatctccaaaccctagggccttgtagagagcttagaggcagatacaaatttgtatgtttctgtgcacaatgagataggcagaatgtaaatgctttacctacctcatcccatttaatcctcacagcaaattgatgagctggtactctggttaatcccatcttctaggtacgggaaaatgaagctgaaggtgagcagtttactccacccaggtcacacaagtaggaagaatttgtgtgttaggtcttttacccccacctctaatttcagagcctgtggaccgatgctgccttcctgcagactggtgacagtctggcctgtttttaaagccaccagataggagtacttcatctttttgtttcagtatttaagatgaaaaactcccttccatgctatccccctctctctagctccccaaaacccttctaccacatgtgcaggtaatgcctgttactagtttcttctgtatccttctagtgtccttttacatatgtaagtgaatactaagatatgtttttatccttccttttacataaatggtagcatactatactcatttctcagtgcctgatttttcccaacaatttttctgggagatctttccatatcagtataaaagctgtcctagttctttttttacagttacataatattccaaagttcctatgtatcttgatttatttaactagtgacctgttcatggacatttatgtaatttctagtcttttgttattataagcaacgctatagtgaatgaccttctatgtatgttatttcatgtgaggagagtatagttataagttcctagaagtgaaattactgtgtcaaagtataaatgtatttgtaattttgcaatgtacttcaaaattggcctccataggggctatgccatttttcacttccactagcaaggtataagggtgcttgtttattgcagcctccttaataggatatattaagaaactcttggatttttgccagtctgataggtaagcaactactcagggtagcttttgtttatctttttaagttgaagtataacgtatataatatagtaaagttcacaaatcttaagggttcagatgatgaatttttacatatgtatgtacttaagaaaacaccatccagagcaagatatagaacatttccagcaccctggaagactagttcatgctccatctctgtctataacccacccccagagctaaccattcttctgacttctgtctccaaagatgcctttgtttgaacttcacgtggatggtgtttggcttcttttgttcaacacattgtgtctgtaagagtcattcatgttgtgtgtagcagtaattttgtaatgcttggtaatattctactgtataaatataccacaacttatttaaccatttaactgttgaacatttgggttgtttctagtttggggatgctatgtacattcttatacacgccttttgatagatatgtgcatttatttctcttgggtgcatgattaagactaggaattctagttcatatttagtattagtaaatactgcgcaacagtgtttaaagtagttgcaccaatttacacccccaccagcaatatgagagttccatttgtgctatactctcgccagatattttcaatcttatagatttaggcaattctgttgagtgtgcagtgtggaatctcactgattttaatttgcatttctctcataactaatgatgtggagtacctttttacatgcttataggccatttgggtggcttcttttgtcaaattcaaagacttaagtccgaagactttaagtctttgcccattgttttaagttgggttttgtctatgtttctcttagtgatttgcaggcatcccttatatcttgtagattccagtccgttgttgaatatgcatattgcaaacatcttctcccagccagtggcttactcttttttttttttttttttttgagatggagtctcgctctgtcacccaggccggagtgcagtggcacaatctcagttcactgcaagctccgcctcctgggttcacgctattctcctgcctcagcctcccgagtagctgggactacaggcgcctgccaccacacccggctaattttttgtattttttagtagagacggggtttcaccatgttagccaggttggtctctatctcctgacctcgtgtggcttactcttttactctcttaatcgtgtcttttgatgaatagttatttattttaatgaagtccagtttattgaccattcctttaatggtttgaggtatttgtgccctacttaagacatttttactcattccaagatcatgaaagtattcttatgtcttctttgtgaagctttattattttgccttttatatttaggcctaaaatccatctcaagttagtttttttaaacatttagaaccatttattgaaaagttcattttttaccattgaattgtggaggtacctttgttataaatcaagagactgcatatatgtgttgatgtgcttttagattcttttttattagtttgtttttccgtttgtatgctagtatcacactagcttgattattgtagctttataataaatcttgatatctagcattataagccctcctactttgttcttttttaagattattgtggcctttttaatctgtctaattttagttattataaatgaaggttgagcttctttttatatgttcaagaactatttgtattttctcttttatgaggagtttttcattcacacccgtattagttttgttcattgttgctataacaaattaccataaaattaatggcttaaaacaagacaaatgtattatcttcaagtttgaggtcagaaatctaagatgggtctcacttggctaaaatcaagctgttggcagccttcattccttcctggaagttccagagagaattcattttcttgccctttctagctactaaaggctacctatattccttgacttatgacctcttccatcttcaaagccagccatagcttttcaagtctttctcctactgcatcactctgacactgactcttctgcctcccttttctacatttaaggacctttctgattacatcatccctgcctggataatccagcataatctccctgtattagtacattttcatactgctgtaaataactgcccaagactggataatttataaaggaaagaggtttaattgactcacagttcagtgtggctggggaggcgtcaggaaacttacaatcatggtggaaggtgaaggggaagcaaggcaccttcttcacaaggtggcaggaaggagaagtgccaaatgaagtggggaagagccccttataaaaccatcagatctcatgagaatttactcactatcacaagaacagcatgggggaaactgcccccctgattcaattacctccacctggtctctcccttgacatgtggggattatgggtattacaattcaagatgagattttgggtgggaacacagctaaaccatatcactccctgtcttaatatcagctaattagcaaccttaattttatctgataactcagttccccttgccatgtaacaaaacatattcataggctctaggaattaggacatggacatctttaggaggccattattttttctacctcaatatcctttgccttgctatagagtctgaatgtttgtgtctttcaaaaaattttatgttgatatttattccctaacgtgatagcattaagaggtggggtgtttgggaggtgattaggtcatgagggctctaccctcaagaatggtgttagtacccttataaaagaggtccaagggagcttgttcaccccttttgccatgtgaggacatttaaaaggtgccatctaaaaggaataggccctcactatataccatcagatcagctggtaccttgatcttggacttcccagcctccagaacttgtattatttatacattttccggtctaaggtattttgttatagcagcccagaaggactaagacagccttttatattgtcagtctttttctaataaatgtctaggtgttctttacatattagggagattaggcattgttctgtgatttgaattgcaaatgtattttcccagctttttatcttctgtttttgatgtttttgtttattttgtctgtaatattttgtcatgcaaccttttattttactatagattaaatgtatcagtcttttcctgtatggcttttggattttgagtcagggaatccttctctcctccagagtataatggtctttctttatattttattctagtatggtcatgcattgcctaaaaatcgggatacgtggccagggtcagtcgctcacacctgtaatcccagcactttgggaagtcaaggcaggctgatcacttaaggccaggagtttgagaccagcctggtcaacatggctgatatggtttggctgtgtccctacccaaatctcatattgaattcccatgtgttgtggggagtgaccttgtgggaggtaattgaatcatgggagcaggtctttctcatgctgttctcatgatagtgaataagtctcacgagatctgatggttttaaaaaggggagtttccctgcacaagctctctctttgcctgccaccatccatgtaagatgtgactttctcctccttgctttctgccatgattgtgaggcctcccctgccatgtggaactgtaagtccattaaatctctttatttcgtaaattgcccagtctcaggtatgtctttattagcagcatgaaaatggactaatacagtaaattgataccaggagtagggtgctgctgaaaagatacccgaaaatgtgggtgcgactttggaactgggtaacagacagaggttggaacagtctggagggatcagaagaagacaggaaaatgtgggaaagtttggagccccctagagacttgttgagtgactttgatcaaaatactgataatgatatggacaatggaatccagactcaggtggtctaagatggagatgaggaacttgttgggaactggagtaaaggtgatccttgttgtgttttaacaaagagactggtggcattttgcctctgccctagagatttgtggaactttgaacttgagagaaatgatttagggtatgtggtggaagaaatttctaagcagcaaagcattcaacaggtgacttgggcactgttaaaggcgttcagttttaaaagggaaacagagcataaagtttcagaaaatttacagcctgatgatgtgatagaaaagaaaatcccatttttctaaagagaaattcaagccagttgcagaaatttgcataagtaacaaggagccaaatgttaatccccaagacaatagggaaaatgtctccagggcatgtcaggggtcttgatggcagcccctcttatcacagacccagaggcctagaaggaaaagacggttttctgggctgggtccagggtgcccctactgtatgcagcctagggacttggtgccctgtgtcccagccactccagttgtggctgaaaggggccaatgtagagccctggccgtggcttcagtgggtacaagcctcaagccttggcagcttccacatggtgtcgagcctgcgagtgcaccaaagtcaagaattggggtttgggaacctctgcctaggtttcagaagatgtatggaaattcctggatgcccagacaaaattttgctacagtggtggggccttcatggagaacttctgctagagcagtgtggaagggaaatgtggggtcagagccccgacacagactccctactggggcactgcctagtggagcggtgagaagagggccactatcctccaggccccagaatggtagatccactgacagctgtgcacctgcaaaagccacagacactcagtgccaacccatgaaagcagctaggaaggaggctgtaccctgcaaaaccacaggggcagagctgcccaagaccatgggaacccacctgttaacatcagcatgacctggctgtgagacatggaggcaatggagatcattttggaactttaagatttgactacgctactggattttggacttgcatggggcctgtggcccctttgttttggccaatttctcccattttgaatggctatatttacccaaagcctgtacccccattgtatctaagaagcaactaacttacttttgattttacaggctcataggcagaagggacttgccttgtctcatatgagactttggactgtggacttttgagttaatgctgaaatgaattaagactttaggacactgttaagaaaacatgattggttttgaaatgtgaggacatgagatttaggaggggccaggggcggaatgatatggtttggctgtgtcccagatctcatcttgaattcccatgtgttgtaggagagacacagtgggaggtaatggaatcacggaggcaggtctttcctgtgctgctcttgtgatagtgaataagtctcacgagatctgatggttttaaaaaggggagtttctctgcacaagctctctctttgcctgccaccatcagtgtaagatgtgacttgcttctccttgtcttctgccacgattgtgaggcctccccaaccacatggaactgtaagtccattaaatctctttcttttataaattacccagtcttgggttgtctttattaacagtgttaaaacagactaataaaatggtgaaaccgcgtctctactaaaaatacaaaaaaattagctgggcttagtggcacatgcctgtaatcccagttacttgggaggctgaggcacaagaattgtttgaaccagggaggcggaggttgtagcgagccaagatcctgccactggactccagcctgggtgacagagcaagactccctctctctcaaaaaggggggatatgttctgagaaatgtgtcattagatgattttgtcataagcaatataaagtgtacttaacaaacctagatggtatagcctagtacacacctaggctatatggtttagcctgttgctcctgggctataaacctggacagcatgttactgtactgaatactgtaggcaattgtaacacaatggctgatcagttatctgaaaactatttatggagttctttggctgccttcctgggtcctgttgctaccagagcagccgtaaggcattacccaaaattgcacagctggtcagtagcagagctgggactagcactcaagtctagcttgtgctattcagaaggagatggtgcctgattctcaaggggctttctcaagtggttgcttgagctgtttgccagacagggagacagcagctaaaggcagagcaacagttttttagttctattggttaccagtgctctgtcccaggtcttgcctttctcaggcaaaatatggtacaaaagattaaagatgatacatctgtatacggcatttactatgaatggagctttcaggactggaagttgttctgggtgagtcagtgagtgagtgatgagtgaatatgaaggcccaggacattattatatactactgtagcctttataaacactatacacttaggctgtaaatactgtgcacttaggctacactgaattacacacaaaaaatctctttcttcaaacgtaaattaaccatagcttactataacatgttgctttatgaactttaaaaaacttttttactcttgtaataacacagcttaaaacacattgtacacagtacaaaaatattttttaatatattttataagctattttctatttcttaaattattattattattattttgctttttaaacttttttgtttaaaacacaaacacacacattagctcaggcctgtacggggtcagaattatcaatatcactgtctttcacctccacatcttgtctcactggaaggtcttcagaggcatgtatggagccatcatctccaatggtaacaatgccttcttctgtaatatctcctgaaggacctgccttttaggaggtatttttacagttaacttaaaaaaaagataagtagaaggaatacactccaaaataacaataaaaagtatagtatagtaaatacacaaaccagtaacatagtcatttatttatcaagtattattacatactgtacataattgtatgtggtagacttttatatgactagaagcacagtaggtttgtttacaccagcatcatcacaaacatgtgagtaatgtgttgtgttacaacattatcacagctactatggcagtaggcaataggaattttttcagctcccttataatcttatgggactaccattgtatatatggtccagttgttgaccgaaacttggtgatgttttggtcaacaaaatagcatgactatatttttatggttttatttttggcatctaaatcttcgatccatatggaatttatcctggtataagtcaggtgtgcattcagcctcacaattttttaaatggctgatcagttatctcaaaactgtttattgaattctttggctgccttcctgggtcctgttgctacgagagcagtcctaaggcattacccaaaattgcacagctggtcagtagcagagctgggactagcactcaagtttagcttgtgctattcagaaggagatggtgcctggttctcaaggggctttctcaagtggttgcctgagctgtttgccagacagggagacagcagctaaaggcagagcaacagttttttagctctcttggttaccagtgctctgtcccagatcttgcctttctcagccctggaactgatatattcgttgccactaccacacctggccgcttggggcaccatattttcctctccaacaggccagaaacatgataaaccttttacatttaagaaagatgtttcacaataaatacagagtgttttttttacagaatcttgcttattgctcaagtcacatttctgttaagtcatacattttcaaggcatagcttcaaatcccaagatgtaactttttacctctcaatcaaggtggatttttcactgttcctaaagaagcgacatttatatcactccacaggagtcattctatatgacaccacaggtgagggtgccaggctgttgaggaggctcccatacttgctaaattactctttcatgctggccattttaggcacaaggttgaccacctgtttagcacaatgctctggtcctttttagggttgcttacagtagtagaaactgcatttgtgacccactgcacttgtttacagttactcaagaggcttgaggccttgcgaaagtaaatctaatgtgaactcaaagaggaaaatacaaaaaattagagcaagttagagacagccttccactgtgcaccataactagagttatggtgataactctctgtgttatcctaggcagttactctccttctctgggcctctagaatccccatctgggaaatgtgggagctggactagacaatttctaaagtcttctgcaactctcaaagtctgtcttcatgtccacaaactgtgtttaacatcttcatagactcagaccatctatacttgccatgcatgcaataggtgcttcatgtgtttgttaaatactcaatgaacattatatgcaatattttctcattctctcctttcagcttactagtgtctgatgatgtgccatgtagtgttatggatgctgtggaggaatacaacattcatggaattcacattcatggaactcacatttagtgggaaagagagctatgggaattaaatttggccatactttggacttaaatactgaatgaatgaatgaatgaatgaatgaatacaaagcagaccatgataagaactaggagaaagaatgaagaggtaagaatgattgattttggaaatccttatggaagaagtggctcctcagtggaggaagggtaaagagcagcattctgtgctgagggataagcatgagcaaagggaaagaaggctctaaagtgtgaatggttgagggacaagtggtcagccagcaaaacagcttaggaccaggtctccaacagcatgctgaaaggcattgactttattgtttagacagtgtagaactatcgtgggttatttaggaagattcttcagaagttgacaattatagcagataaaacttttttttcgttaaaggataatacctttttacagagtaaaactgaagtgatgtagttaagtacaaagtgctgacactattctgaacattttgcatatatcatctcacttagttatcaccatgcagggtagaaagtagatagaaattgtccccgtttttcagatgagaactcaaagaagtagagcccagaattcaaactaaggtctgctgactgcaaggtctgcacttgccgcttcttgtgctgctccctgcagaggtttgacttaggttaattagcatatcaagcagcataaactgaacttttaatatgcatgtggctttggaagacaggaaaaagcaacagcagagctagcattactgatggtacttgtttgtaggggcagagaccagcccccatccttttgtcttatctaccatagcatagcaactaggggacaaccacatgtgacattgggcagctttgacaatggccaggcagtccagcccatgagcctgctctgtccttccttagacaggcactagcttcctgagcctgggcagcaccatcgtatctgcaaaactcagactcacagtattgcctctccgcatccacaggcctcagcttatgctagtgcccctctgtatcacctgtcctatgactgctgtccctgctgcctcttgcctctggaatcctctgttcctccttggtgcacctaaagcccttaaatgtagaacagctatgactattcattcaccgtgctgtccctgggcagtgctttagcaacattcggtttgcctatttgtccattcatgaattcatttattaagaagctgtaccatgcaataggaagagtactgggacagaatacctgagtactagacaagctgctgacaccttgggcaggccactttccttctacaggcctccttttctttatggataaaataggagaattgagtaagataatctttgaggtctctactagctctctcactttgaggctgttttgtttagctgtaaattcacaccttcatcctaacatggggttagggaatgcttcttagaagagatgatccttgaagtgggtcttaacggatgagtatgaagaagagaaaggtattccagggaatatgatcaacatgaacaaaagtatggagaaggcatggcaaactgggggaaatgagggcctctggaggggagcagagcagtgggagacaaggctacagtgatggctacgttcagatcgtaaaagctttaatgtcaggctaaggaactagaacttcatcctgtggggtaaaggtgcaggaaaggttttaaagcagagaaatgacttgatttgatctatttttagaagctagtactgttcaacagagaaacctgggaggaatggcagtggtttcaatcttgtggctttgtaagatattaatttggtaagtttttgctttttaacgagacaagatgctaccaacctattggataggggatgtcatgatttacagtctgactgtggctctagaatccccatcagactcctttatccagattctgccccattctagttggcaactccaggcctaggccaaagccagcccttttctcttcccatgacaaccaagccaaacagctgacttaggaagctccacagtgtagcccttgcggcacgcatgcatgtgtcagtaggtcctcatgtgtgctcactgcttcatagtgtatcaggctctttgactcaccaactcttttcattcttacagtaactctgaagttctcagagaaagtacaatccctactgtacagtggggaaatggaatctcagaaggattgcatgatttgccccaagcagcataatgtagtgtaaggggcatgaggccttggagttgttaagtcatgggttccatttccagttctgctgcttaatatcttgatatctgaccacgggcaagattgccaccctctctaaactgtgggtttctcatccttaaagactgagataataatagcttctgtatgtgtgtatcattggagcgaattatgtggtttatggaaaagctcttggcacagagtaggtgctcagaatgtctgtttctgtttcctctgactcacttcagtgctctttctggtgtttcgccttgcttcccatatggccctctttgtcatctctcttgctcctctattcttaagtcaatgccacagacatgcattactggaaatgttcttcctgggtacacaatatgaagctaagccttgtggatgaagtgagaggacataggaaatggccctttccctcactgcttgctacctgattattgtgggtgttagggtggagagggtttagccttcactcttgaaacaaagctgaggtgatctgaccatctcatgatgatcccttcttgctcctcagggaacttactgtatgccaagtgccggactcaactcttacactgtctcactaagctcttacacactgttacatccactgtgtgtgtatcttacatacgcttctgtattcttaacatataaccctgttctacagatgaggaaaatgaggctcagaaaagctaaacctattaagatcttaaactcatatttgatgaaaccaggatttgagctaggttatctgattctggagcatgcactcttaaattagattaccttttgtttattacaaaatagtgtatgtacatagtttaaaaattttctaaatactaaaaggcttagtaatggcaatttctgcctcaccttttcccactcttttgtccaatttccggagccaaccattttgaattattttggggtgtctatctccatatttctaaactaaatgtctatttaagatatcaattttaaaataaattttatctgttgctttcttataaataaaaatttaattatcttataccaccaccttcatttcccttccctccatcctcacgtgtagttaagtcattagtctattattatgagtagtgtaaatactgttctcactgctaagccaagtaatatatcatgatatggttcctatgctatacttttcttttcctggagttaaacttgcctgtttattttccccttcctttaactgactttctatataccaattactaattgttcccaaatgcctccaaaacatctataaaacacctcttacacgctttgcaacatggtcaaagacgtcaactctttcagcagtctccccacccccactttcaccacatgccactctggggttcagcctttctgttccactctgaaatggttactctaggcctgcaccgtggttacgtgatgacttctctataccatttccctgtgttaaatccctgttccctatcttccttcttctttagattagtctcattttggtggggcacaggactcagtacctttcccggaaaagaggagttgaagataaattttttggttctttgaaattctgaaaatatacttactctattttcacatttgattgacactttcactgtttgtagaaatctaggttggcaatttttttcattctgacttttgcatgcatttcccattgtcctctagcatctaatgttactattgagaagtctgctgctttttctaattcctgtttctttgtacgttgccatttttttttccttgaaattcttaggaacttctctttacttcagtgttttgaaattttatgatgacatgccttgatatgtatcttctttattcattgttctggtatttattgagccttctcagtccagaggcttaggcctgccagttctgggaaatctttcttgaaattgttttacaattttttccttatttttctttgttctgtctttcagggacttctattgaatgtatattgaatttcctgactcctaattttcttatcttttctttcctcttgggcatgtttttacttttcttaccactttgtgagaaaattttttgacttgatcttccaacttttctaatggaacttttattcagctattatttttaatttctaaggttctttcttatttttaatcctttaaaatagttttctgttcttgtttatattgccatatcatctatcatttttctatggatattaattatagagtttaaaaaaatgttttcttctctgccttgactctgtttttttccaatttttaattttctatttctttgttttgggttctgtctttcacactggagactgtgctttatgttttttgtttgccctgtagatgcattatccaccttttttcacactccatatatccctagggaggatggcctctctatggcctgcatcaactggccctctggcttctggttgggttcagctaatgagaggaacggcagatctcaggactgaaaaacaacgaggtcagggtatttattctcctagcttctccctgcttacctgccatggctgcatccctctatcagggattccagtctggtgtccctctccttaacttcaccctctccaattcaccctctccaagggtaaccactcctttcccttacttcttcaggcttagaggtggtagagctctagttttatctagtagtcctggaatataaacattgtccatacctctgtaaatggttcctttattaaactctcacctgctgtccagtttgatgtggtcttctgctgagattctaactgatacagaggttttcctctctaaagatctgatgatctttagctggctgtttatattgaaaagagatactacatgagactctgtgggcatggggaggatgcactggctgctgacttccttgtaagatgtttggactgatgagttggggaagcttttccattggtaaacttccagagatcaatatttatgaacttttcccctaatcttctgtcttggggtgtatatgcttagttgttgactttctggagcaggatgccggaagggggctggggggagtcccatcatcctttacatagactgtcacttactcacttaacccatttgtttcattctgatcctcactcccaccctctgatgactcttcttccaggtccagggctgccctgggtcagtttcgccagataataaatgtgtggtgttcgttaggtatagcaagagataggttgcctagttatgtgtgttggggagaatctgggcatctaactaccccccataaatatactttcaggcaacgcctctgatttcagccctatccttacccgactttcaaagacacttggtgcttctcagtcctgaggcttttcattgtcttccaagacaaaatttgtttccttctcactgttccctgcagcaggcacagggtttcagcctcctccactctgcataatcagttacctccttcatctgtggtattcatctgaaatgtgttgaactatcttgtttcttcttctattcctcttttcttggtggattcatactttctttgttcctttacagttggcttaagagggttttggaaggaaatagagataaaggtgtgggctcaatctatcccgattaatggaagttcctactgctctttgtaggccacagctgacaaggatagagaaagtggtcccacagtggccctgagaatgtgaggcaggctggaagttgtgtgactgcacagtatgacagaagggaagccactcaaagctgaagccttggcaccgtggcctttgtatttgtgagttttgtgagtctgttcattttattcgggcagcacctctgagatgaatacttcttgtgaaggaaatttactaagatcagctgggaacttacttgaagaagttttcaccaaatggcattacatagcaagaagggggaaaaatatggggagctcttagacagatgctttttaaaattttaattttgccaaatggcgagggtagccaaagaagacgtatatgcttctagtctgggagggactgcttttcagagcggggagaagcaaaatcttagctgatctaatgtaagaagaaccctggggtcatagaaccacagactttcatggtggaggggactttagaaacagcctaatctttacagaagaggaaattaaggcctaagtttggaaatgatttgccctaagtcacacagcaagttatgggctatgtccggaacggtcacccacaagtcctaacttcagctggcacattacacccctctggagatagaacgtcggcaactttagaggtgagctccaaaggtcccacctttgtcactgtgacctagcagtccatggcctcaggagcccttgacttggcttgtttctgggtagtttctgctactcacccatactggagatattatattctccatttccctaggctgcataggtttgtaccaaaccagtgctatgccaaattgtagacctgtttagacatgtttcctttcgtttcattatttttgggggctctgccaaggctcaccatatgaactcaaatgtgatttaagaaacaaaaaaagataatgacttcaatagcttggctttttaggaaagttaagggggaagaagagtccaggaagccaacacactgtgtgaccaactgtcaaatatttattgaaccataataacagtaatagttgacattattgatctatgtgtggttttacacattttacatacattattaattgattctttacatcaacagtaaggtaggtactattattatacctgtttcacagatggggaaactatggcagagagggtaacttgctcaaggaggagaaccttgtcctgggtactctgcagcttaaggacttgggtatctaaagacacaggttcataattagcaatattctctcaaattattcagtaacagattgttaagagctgcaaaggggtctcttttggctgccaaaaggctccagctgcagcctgtctccatgaaggcatagaaggggaccatttcactttttctgaaaactgggaatttattacacaaaggatgatgaattcaggatctaaagggtggaatatgaaaagaagtcaacaaagtaatgtgtaattgggaatcaatataagagagggcctagtggtagaaatggtaagtcttgggtattgactgagtcagcttgcactagggaggccagagcacaggggagccagccatgggcagcagagatattgacagagggtaaaggatgagcttgttagttatattgcctttaaattgtcagtgggataggcagtggggtagtctgaagacattcctataaaagaggcctagagaggaaatttgtgggttaggggtggggatgtggttttcagtatcttgcattacaggaccacatctgtgcccacactgcagaataacctttgtccattctagagagagcctgcaaagtacagatgaccatggtatacttgggaatgttgggtttatagaattaaagtgggttggtgctggaaaggatctcagaagccaactgttcccaatcttcatctgtaagtgaaatattcaagtcttagaaggggcagtgatatgtttcagttgtgagccagccagaggacctgcccaggcagactaagaaagcagatctcccaccactcagcccaggcccctttgcttcaaatcgtgtctcagagggagaacagtagttccccttatctgcagttgcactttctacagtttctgttacctgcagtcagccacagtccgaaaatactcaatggaaaattccagaaataatgcaaaagtttcacattttgagtagcgtgatgaaatctcatgccatgtcactccatcccacccagaacatgaatcatctctttgtccagtgtgtccatgatgtatatactatccgcctgttactgtataggaaaaaatagcaaatatatatagtttggtactatctgagatttcaggcatcccttgggggtcttggaacatgtcccctgaagataagggggcactactgtatttaaaactgtgacagtttccaaatccagtactgactgtcccctagtgaagatgtctttttaatctggctccttaaactgtccaggtacctttgttaatcttcaattttaaaatgaaatttaaattaccttaagtaatttactcgccctccaagggctccaatagcacatctataaaataaagataatactctggctctcctactcccccgctttactttatataggccttctgaggttgtaacaagtacaagtatggttggaaaagaaagataataattttgtataaaaagtaagaatattatagttttaatagtttcattataattttcaaatgaagttgacgtgattttgagagggacactaagtccatgaaagaaactcagctctgctccttcctagcaatgcaacgttgagtgaattataacctccttgagcctcagtttccctatgtagataaagaatgaaaatgctcagagcaactatgacagttagacgggataatatatataaaggactgagcttagtgcctgatgcttgacagaagcagtaaatgcagatttctatagctccacatccttgccagaacttagcatgatccagttatcaatttttacctgtcaaaggtgagaaacaaaatgttattctactaaaataagaatttagttttagtttcaaagacagagtgtgtcagtccaggttcaactagagaaacagacccagaaggagatgcaaattaagatattttggtgaggaaatggcttgtacaactgtggagactggctagcaagcttgaaatccacagggcaaactgtcaggaaggacaggcagtggcagcagaaataggaagtacggaagagatttgaaagccattgctagtcagtaattaagtggcctaatatgaaaaggattgagaaaggaaggggaagaatgggcaggatcaaggatgtggtacccttttctccttggtagactgggtagatatgtcatcattgagaagagagatgcctggagagaggaaagaataggctttgggcaaggtaatgaatttattttttagcatagctgagtgtaagatgcctgtggaacactaggcatcttacccaaacaggactacttggtagaaggttggaatgaaaactttcagctctgtagagaagtcggggagttggttctgtagagaaagcttaatgaagcagagctacttaattacagtttttttctttatgtatatgtacacagtgtttgtgctaagtggccctgctatagggtatggtgttgtgatagctttaataatgttatgtaagtgtcactattctgtgattatttttgctgctgcaataatttggcccagggcaaagactgctttcctggtcctttttttttttttttttttttgagacggtgtctcgctctgtcccccaggctggagtgcagtggtgtgatcttggctcactgcaacctctgcctcccgatttcaagcggttcccctgcctcagcttcagcctcccgagtagctgggactacaggtgtgcgccactgtgcctggctaaattgtgtgtgtgtatatatgttttttttgtttttgttttagtagggacaggttttgccatgttggccaggcttctcaaactcctgacctcaggtgatccacccgcctcggcctcacaaagtgctggaattacaggcgtgagccaccgtgcccagcctcctggtccctttttatagggacgaactcaccttagtagactttccagattccaagaagctattgcaaaggttgagtcctcaataggaactccatacgtggatacatgggaaggctctgtctccctgaggaaaaaccagatggagttgtccatttctgcagagtgacctgaaagcacatagcaccacgtatgattaatgactttgtgtagcagctcactgccccagtaaacaaggccagcccagtcacattgcctgggaagaagcactgtgtgctcttcctcaaccctagacctcgtcttaacaggtctacagataacagatgggggtgtggtgccttgggaaatacaggagcaaggggaaggagaagaaatgaacattcacttaacatttctcatgtgccaagcagtgtgttgggcacgttcatgatgataatgatgaaaacagtgacagctaacacttactgattgtttgccttggcgccaagcactgttcatgtatggtatttttttttctatttagtcatcacaaccaccatatgaagtgggtactattgtttgctatgttttacaagtgaggaaatcagggcagagattaaatgagttgcctagggtcacacaattatgtagtagtatatatctaaggtgggacttgaaaaatgttcctgagcccacagttccagactccgtgctactactctctgatactgtcgcagccactttcccctccctggtcctgtcatgcagaggggcaagactacagagttctttctctgatagttctcatggatttctgtcttcactttattgggtgagtggcttatgggaagcactgagcgagaattaggagacctgggttcttatcctacccacggtctgaccttggacctcagatctaaccctcacattcttcatctgtaaaatggagatactaacatctaccagggtattatgaggatcagatgaataaattgctaggaaagtgtttatgtaaatgctgagagttaccctgttgcatctgtacctacttctttgcttttcagaatatcttctttcctgttaccttccctgaccctgattccttttgtcctttattatgatttatgacatttttatcacttaaaagtctgtgataatcatgcttaaggcaggaggccactgaaattcttacataaataattccacctacctgagccaaatggagggggtgaagtggggtggtgtgtagcagatttagcagctgctgaagctataaccaagagaagtctccttgtcagtcacaggaatgaatcattcaaatggctgccttgctgggtccttcccagagccagaaggtaaattagggagcaatgttgctttcattactcattaagcttaaaatgaagctctgcctctttgaaatgtagcaaggatttctgtttgaaagagcatgggttcgggagtcagactgacctgagttcattcaattcccagtattgccacttagtagctgaatgaccttgggcaagtcatcttacctaactgggcctcagtttcctcctctgtacatgcatcccaaggttattgtgcagcacagatgagatcatgggtataaagggcccggcatggtaccacacactcattagactctcagcagtttttactttgctgtgtctccaagctgtgggaatgaacaccttagggaggtagatttgatggggagtgaaacaacctggtttccagagtgcaaaagcagagaactcagtaatagacatttgaatcacaggtctatttttagttcaatccagcctaagatttcaaaatgtgggttcttccttgtgtcccttcatcctttctgtgtaagcagtgggggtggggttgtccagcttctctgaaggcacgtactcctgccatttcagtcatatctttttcctcattagtgtccagcacagtcaccttggatacatcagcttaaaaatctgcaataatgcatgaatgcaagtgttttactctagtcttcagcaagattctgtcactgccacgccagcctttaactctccaacttttaaaacttcggagaaatttcatccataaccctcatccatgtttctagtatggctgacttcatgactttggggagcacagcagtaaatacttttctaccaggtcctgtctgtcccttgccttctcaaaatgcacatatccccacacagggccccacagtcacagagcagcctcatgtgcgggggctctatagagcatccttgtactcatgtgtcttacagaagagggatgcaaactactagatacacaggagacacataataattaatgtttcttcatttcttccttgcaacagctctctggtaagtaggaatgtggtttcaaggttaagggcactgcatttcaaatcaaggggaccaaggtttgaatcctaactctgtaacttaacagttatatgacctggtacaaattattgaactcctctgagcataggtttcctcttctgtcagctggagataatagcacccgtctcacaggactgtaaggaggagtgaaagaatacatgcaaagccctcagcacagggccagcacacggtacagatatatacatagtaattgtgacagtttcacagcagaggaaatactgccctagggaggttagctaatttatctaaggtaggtatcatccctattttatgtaaaaggacatcgaggctgagtcaagcatgttgtccaatgttatatagtgaataagcagcagaatgtgaactacaacccaggtctcctgacacctcagccaggtctcctaacatttcaccagaaacctctggaaaactgaaataaatgtcccccagcccatttacaattgcccccctggtggtggaatccaagcccagcttcccttttgctgaatcctgctttctagaaataggctgccagtgaaagatgtgtgcaagtgtatatagaaatgcatacatatatgtgatagagtgggaaaatatcccagggagccatgattaccagagtactccaagaatgcagtattttggttaatggatttttctcagagtattaacctcttggtttcaggccttattgaaagtcattatgaaatgcattgcaaacattcactctctgatgctagaaggagctgtctagtgagcgtaattaaattctctttaagtgacagaggatcttggcaggatgtccatttatcaccagaatgatcagttgtgctgttcaggactctaataacaacccatatgtctgtctgggtcttttacactcattataacatttaatcattgcaacagccctgtatgtgtacgtgtgtgttgggagtaaagggcaggatgggaagatgattatccccatgttgttactgaggaggctaggatttggagagcatgaatgtcctgttaggcatctgctatggtttgaatatgctcctcaaaaattcctgtgttagaaacttggtccccagtgtaacagtgctgggagtggggcctttggaagctgattgggtcatgggggatcaacccttatgaatggatttatgtcattattgtgggagtaggttagttattgctggagtggctttgttaaaaatataagctctctctcgcatgtgttctcttctccttccacctgtccaccctagcatgaccctcactagataccagcaccatgctcttggactttccagcctccagaactgtgagccaaatcaacttctttataaattatccagcctgtggtattcggttatagcaacagaaaaaaagaccaggagaagatcatgtatcttgaaagtaacagagatagaactgaaatgacatttgctgagacataatatagtaaagcagaaaaaaacatagatttttgagtaagacatacttgagtttaaatcctgattttgccacttactgatggtattgaccgtgaataaattaatctctcaggtcctaagattcctcatctgtaaaatgggtcaaataatatttcccttgctgggggtaattttaaggattctaaataatgtatataaagcaaccagcattgtgcctggtcagagtaggtcctcagcacatggaagctattattattctgtctcctggtcctgtgctctttccagtctaccaagatgtctactactgtagatatagaaggtacaagggattggccttacctgtcttcagcccatcaaatgctagaagtcttttcattagcctcaagggtggggttgggggggttgttttatccctttctaataacagaagctggaggcagcttttattgtataggtaaaacttaaataattttatatcaataccagagctgctgcaaagcaataaagtaagtatcacgtatgactcttgttgatagtaagtgcccagagtcaggaaatgctttttggattttaaaaatatgcatagaatttgactaggagaacaagagatacttcatgtaggatcaacggtgtggaggtaagacaatgtaagatttgctcagcttggctagaacaaaaattgtcattggtaggggagcatacatgataaggatggaaaaatagactcgtatatagagcttcacatgtgcatgtaaacacacacatgttactcacatctcctatgcatgtacattgccaacctaaaatacttagaattgattggaagcattgggtgaatagatattatttcatctctctatgatttgtagaaaagcaatgtggtcagaagaaagagagctagagtgggggttgggagacccagatgttgctcttggtaccgccccattcgactgtataatctggacaagacatggaacctctttgggccttatctcctcatttataaaaacatctgtgccacttttggaaaatcctttggagctattatcaagagccttgaagatgtccattcactttcatttattaattcatatcctagcattcttctctaaggaaagatcttaaatatggaaaaaaactttatggttaaagatgttcatcatagtctttttataatttagtaaaattaggagctacctaattttactaacatttggtaatggataaaagatgacctatctgcttcactaatttgtagtgtttattaagtaagaattgcagcattggtcatgtaaaaatgaaaacaaaaaggcacatatgaaaaatatactgggaaatatactttccagtgtaggaagcattgttgatgttatccacacccttcatgatccagacccagatgttcacaccagctgtctttgtgccaccactatttactgtatatggtgacctcactatggtgaccttaggacattttcctaacaaatacctttcatccctgtatgcttttgtatgtctggttcattcctcctgaaattccctttactcccttgtctcgccatgaatatctgctcttcttctagtccagctctgcaaatttccctgacttcctaggtggaatcagttgctccttcatccttctttctataaaatttgtaacttggctctaacacatatgtcctctgttacagtcttcttgtttgtttccatctctgcacatagactgggccttccttagggtcagaattgtgttatcaacaaatccctaggattcagcaaagggcctggcatttaataatcactcaatatatgattgaatttttacttttttattttgattttttgcttttccatgttttctgcatattttataatgactatgcattgtgcttataatggaagaaaaatagtagtaattcatttactcatttactttaacaaggtgactgacctagttcagaggttctcaaacttggcagttcatcagaatcacctggagagcttattaaattgcagataccctggcccctagacagacttcttgagtcccagtctcccggataaggacctggaatcagtattattaacaggctaccagttattgggatgctcagccatgtctgagaacctttgacctcagtactgctaaagccctttcagcttaaaatcttcctaattctttgattggccttctgtcccttgctccccctgctatgagaggctttagctggagggcatgtggagcaacaggccatacaatggagaatacctgtactagcttcattattgggctcctcttctgtgccaaagactgctttgtaaatagcgttttaaaatatctatacaatcatactttaaggtcagttttattttctccattttacagatgagaaaactgaggcaaagagaagttgtgactttcccaaggtcaaataagaaagcattggatgctgtgtttcaattcagttctgtcagacttcaaaactggatctagaatttccctcactgcccctccctgtcccccttccccccaaataaaggaaccccagcagggtcacgtacagccctgctgagtgcagacacgttctgccgtctgctcaggcatgtggaattagcatccttgggcagcaatgcaccacataagcagaggcttgcagctcaccaaatgtgctctggcgcccacccacctgcttacagggtgcagtgaagcagtggaattcaatttgcggcagtgacctaagaagagctatttttagtaagaaagtaggtcaggggctgcagcggtgctgcctgataaaggaacagcctcccctgtcaccaggaggcttgctcacttctcgcacagccagtgtggaggtgaggtgcagatctgacatcctcacatgactgcagttgtaatcattactgtggagccactagggggtaatacacacacacatctaagacacagaggctcttgcctgggtttgcttaaggtcttgggccctagtcttcctcaggagattagaatcccttcaggaaacacctctaacatactaggaggctcatctattatatacctgctacatgtcagccaccattctgggttcaatatgcattctctcatttaatctttgcagtatctctgcaaggtaagtattattatcccagttttgctgatgtggaaatggagttgcagagaaattaagagatatactcaagatcacagtgttcatgtgtcatggagccatttttgaatcctgtgagagacttcagtgctgatgatcggatgaccagaccatcaaaccatgctggaggtgattttttaattaccattctgcctctgccccgttttgttcaatacttcagagaaaaaaaaatacaaagatggtgttctccatctgaacttatctgaatcaggacaggaaagacccaggacacagaccctttccccagagaggagagaatacatctctacatactgctgcccaatcatcaagcccagtagttgccaaaaacaaaccaaccacctgatttccctgggcctggagtgtttcagaatcctctgccccacttgttctgccgtgtattaactgcagagctgtggcaaattgcaaggcactcattggcgatacacaggtggacatgagcttgttaacagaatgcagtaattgacataccgtgattcattatgcacagcacgaaggactctagtagaagcccactttatggccaagagctgctggcaccaccaaccttgagaatttgttcctggctctgttctgtctccccagctagagagcaccatccctttaggggccagaagcagtctgtggcttcagtcttatctgcccctacctccaggcaaggagtaaggatacttccctggtcccaggctgcatgacgttggagggagattatttgttcattcattcactcaacaagcatttaaaaaaatctggccagtaatgcagtggagaacaagacagatagttcctgcccttccagaacttaatcacctggtgactatcagaactgcaaatttctaagcacccaattcccagttctatagacctggaagtgggccctctctggaccttagtttctttatcatcaaatgagtagaaaagagagaattgtattggtcaatctcttttagctctaagatttcagactctgtggttatggattataaacatgagtcacagtatcagtcttagtcatttgtatccaatgccaaaggaaaaaaaatgaaaatctcaaatttcagaatctggatgggaaacatggacacaagctaattcaatttcttcacttacaaatgggaaaaatgaggctaaaagaagggtgtgtcttgcctagtatatcagtgaacagagccaggatggagaggccagtcagctgagcccaagtcttgagacaccccattcctactgaggctgcctcttcactcagcactgctgctgtgcccctgtttggaaccctttctgcacttggcttttctaacagtgagctctactgagtcttctacttacgcctctaaccactgcttctgtgtttccttatcagccccagggccgatggcctgagagtagaagaaggagtaggctttgatagctgagcccccaaaggtaaatcaaatttaactttgttatgctaaggctataaaaaaaaatggacatgaagaagttgaagcagagcatgtagagtttgctgacagagttctcgaacaagcagttacagaggcaaaccacagtgaaacaacagaagaagggaacctggtggagatggctgctgagaagttgctccatgaactcagaggacctatagaagggcctacctacactcattgtcttagagcagccttgctaacccacgggcagcgagctgcatgtggcccaggacagctttgaatgcagcccaacacaaatttgtaaactttcttaaaacaggggttttttgttctgtttttttttttttgtttgttttgttttgtttttttttaagctcattagctgttgttagtgtactttttgtgtggcccaattcttcttccagtgtggcccagggacgccaaaagattggacacctctggcgtagagcctctctatacccctggcccatgtctgtcttctacatgtagccaatgaaaggaatctaaagctggaagggcaggggacctttctgatgctcttgtgaggcaaagggattgagatcactgcaaagaagctggcaacaggaggcccatcattttttcagtgggcaggacatctccattctgggtggaggaagacgcaaggctttggcaaatactaaaatgcttgtttgtctattgctctttctttatgtccatcacagtctgggaaccagtaccttgaagcactatccttgattaatttataattttctgccctatactgactgcctaggaaagaggtggtcagaggtacgagagggtgaaaatactgttcttaattatgaaaacctatatctgttctgtgtatccatggataattttagtcttctaaattgatttgttattttccaagctttatttttataaaaagtcatttttcagtaaacatataacattgtcaagaactacctaatccatgtacataaaatgtcatgtgaatgtataaatatgtatataatgtataaaaataaaattattctaatttttaaaaaatgactaaaggtcatttgactgtgaattggatacctgagtctgaagtattgattcctgtgtgtccttgagctagtcacttgccctttctgcccctctgttctcatatctataaagtgaaaggtctggatcagtggttttagtcacctggactattctatcaaatcacttgggataattattaaacatatacattcctgggcccacttccagatcaatagatttgggaattgggtgcttagaaatttttagttctgatagtcctccaggtaattaattccaggtgatgtagccaggttttgagtagttgtcttccctgaacccctctggttctgatgttttaggatcctttgccttctttctctcttgctcagtttcccattgttctcttttccttttttccctagagtgctcctctcactagactgtgaacctctgaggaggaggggctgtatcttacccatctctttatccccgtcctccagtgcaatgtctgacacactggtagtgctcagtgaacagtgggtgcaatgaagggaaggagggaatgaatgggctctcatggctttataccacctatacacatccaagtaatgtccttaatgtttcctgcatcctcagtcattatagatttcttcagaacagtaagtggaaagaccacagactttggaatctaagaaaactggatttgaatctcaactctttctcttactgtgtagtgatttctcctaagtcatttaatctctttaaactacagtttccttgattgtaaaataaggagaatggcacctgttgcttgagattgttgttaggattgacttactacatgaaaatatggatgcagagtgcttgacatatagtaggaactcaagtatctcagcttcttttcttcctttacatgcccagtgatgagtgacagtaaaaggagggaggaagactcagaagaatagatcaaccccaagccaggccgcagaggatgacaatatagttcattgtcatctcctggcttcctgtgacactgaggttctcactgaggcccaggcatcttggtggatccccacttgctcaaccctgggcatatcagaattcagacttagaatctcctgactttaagtgtggcctgttctctctgtttctgtgagctacaggagatagacaagtaacaaaagaaattcaaggaactattataggttggggatccttatgcaggcttgatgtctgggcttgctgtgagaaactcaagttcatttcatatggttggttctcagggctaaaaatctgtgcgttggtttcgttagcatatcagctcctctcttcacacactctgtgttggaactgccacagcatgctgcttttcataaaagtctctctttcaaaccaagtccagctgtttcagtcctagaaggcagccagattagttctcttctgggcaaaatggtaagtgcttatcactccccacaatgcctccagcaccacagaaataacagccaccctttactgagtgcctactgtgcttgagtcctttgacatcactatgagtggttattattagctcattttatagggcagtaggttatgattaagactgtagactttcaagtttgaccaaggttcaaatcctggccccaccatattttagcaaatcctctctgagtttctgtttcttattagcaaaaaagggctagtaatgtatacctcatagtactgaaaggattaactgaataccggatgcatggtcttggtaccacgcctaatgcatggtaagtaaatcctcaataaatgtaactgtggtaatgatggcaatgctgtggtgtcttcatctatagaaggtgtttcactgtagtggataccagagagataaggagaggtggcaaaaatatcaacagtttctgttagtctaatccagactcaagagaacctcagaaatactattagaaagggacctgttatgattgcttggaataaactcagtgaatagctgcggtgtattattcattcagcagatttttattgactatctactatgtttcaggccttatgctaaaagctggagatactatgatgataaaacagacatgatccctcaccctcaaggagcttaagtcttatggaaggactcagacactgttaaaaaaaaaaaattgcaccagtcatgcaaaattacagactaggataaatgctacgaaagaaagggacaaggtactatgagaatgtatgataggggtcctcacttacttcacatgatcaaggatagctttgctgaggaattgacatctgagctgagatctgaaggatcactaggagttataattagatgaaaggagtgggtagggtggagagaaagctttctaggcatatggacaaatatggcccccatggtgagaggcagcttagcgctttcaaagaagtgagaaggtcaatatgatttgagtacagagaaaaggctggagggggagattaggttcttgcaggccatgtgaagagtttcttttctttttattctaagctcatagtaatcatagaaggatttgaagcagaggtggttatgtgtatgttactcatggggagggcattatgctcaatttgacatttacaagagatctttccaacaatggccttgagaattgatggagggtgcaaaagtggatgtggcaaaaccagttaaggagcttttgcaatggtcccagtaagaaatcatgctggatagagtgagagaagtaacagtggagataagaaggacaacatggtttgagatatttagcaggtaaaattagcaggacttgatgatggattgaatgtagctgtgaggaaaagaaagatgtgaagcataagccccaggtttctgggtgcataagtgggaatggccctgccattcgctaagctaaaaataaacagtagaaggtgaacaggtttggagaggaagatctgatctgaatttgaacacactgcactagaggtgccttttagacatctgggtatggatattccatgcccatggccaccaagggtaggccacaatggccttaggatgccccgagaaatctgacccagatccagcctctctgggggtcagccttgtttggtagctggcctgaggactcatggtttgcttcccacccttgtggttctatttccttaccagagtatcctgaaaagggagaattcagcctaagaaggaacaggaacagtctggggagagactctgctgctttaggggaaacaatttagatattgatgcatgttgtttgagatgtttttccaaatctgtgattgagatatttgtgtttgacatgtgtgcttttatttattaagatatttgctattaatatatatctactatatggtagacacaatgtcaagtcagaaaggacccgtggtacttcagaagcgacagccccagaacccatctggctttgctgttcttgtgattttagagaatactaaatctctaggatgctgagctgctgacttttcatcaagggaacctgtccttgagttcagggggttggcttgtcaggggcttcttctgcagctgcaactcttcaatctgtctttgggggcctctcttctgcagtctccctagacagtaactacatcagttctccactttgaacagggctcagctgggcactctgagccaccccaccttaccactgctatgtgttctggtttgttgcctgaaagcaactctttgtgtccaggttagcaggtgagggtgagagaagtgtcagaggaggtttcgtgtccttctgtagaacagcagaggagagctggactggcgggcaggaagggggtggtgggcagaggtgtgactcatccagccctggcaccatgtgataggatctgtgaatacccatgtgaaatagatacatgctttaagaacatttgccttgtgaaaatctaaactcacaagccacatgaatttggaaccgcgattaccatcacaaaagggagctggtatcctttaaaatatcctgtagtgtatctaaaatacagtgcagtgagtgatgaaatatttatgccagtttaggcactcaggggaagctggcattctctatgtcagtggaacaaagaacttcttataactggagcagatggtgagcccctgtcagggcagatgttcctgcagaggccaggtgaccacatgtcaggtgggacagagggactgcttcccatggtggactgagaatcgcagctttaagattctctgattcttggctttgctttctgtcttgaaaagtaagtctgccttaggcaaatctgccaaggacagatgtgtccttgaagtcagaaggacctaggctaaatctcagctccacctcttctagctatgtaaattaggcaggtggctctctgaacctccctcttctagtctataaaattaggtttataataccttgcagagttttgtgtgtgagggtcaaatgagttaagtccaggagccaacacctcaggatgtgaggtggggagaaggcttcggagcctctgatcagctggcagccctgtggcatgtgcgcgtggatggtgtgcacatggcttgagtttgcatgctctgcacagggagaacattcattgctccacagaacacaaattcagggcatgtgtcagctcactggcagcctggggtaggctgggacacgctgtcctttttctgcctgaggactgacaccagctcagcaaacagcccacccatcttaagtttccccaaagaactcagtcttcgttacagagaaatcctttcaggtgctgagagtggcatgtttcttgcaatctgacccctggaagaattctgactgtgtccctttcccatgccaactctttactaaagccgattttatgaggaattatttttctaatgtgttggataaaatcctaaagtgtgtctctgatggtgtcttaggaggttcacaatgtttttattttcatggggagcattaagaggatacagactaggtttttgttggggcaagcatagtcattgtaaactagaggctgcttgctgcctgcaaaatccttgacacccaaggcaaaattctggcttcatatgtcaccatctagcatacctgaaccactccaacttgaagacatttgtccctgttcagggtatccatcatagtcatcacggttccatctgtgtacacaataaagctctgtatttaccagttattttatctgcctagcctccctgtgggctctgtagggcagggttcttggcccttttattcagattaagagaacatggctctgcaaggtgcaatagtttgtcttaggtcacccaactaattattggcagggctgtttttcaaatcctggtcttctaaggggcagcctgacataatgtaaacaccatccagcatttacatcccaccaatggcactcatgagctgtatgaccttgtgcaagctagttattataagtagttattgatattaataattagagtagaatttacaaagcacctggcatggtagtaggtgctctacaccgtatctcgttttcattctcacactagacctgtgagaggggttttattattatcggttttacagataagcatcctgaaattcagagtgctaaagtagctttccctgtctgagccccagtttctctataaaataagaatattaatatctccctgggagggtgatgataagggctgaatgagataatgtgtgtaaactgcccagcacagagcctggaatagaggaggtgctcagtcaatacttgtttcctttccctagttcctcctctgacttctaatctagtggtctttctactgcaccccactaaatacatttggaagctaaggtcatgcttaagtcctctccatagctctctctatcacactcttccctactgcccagaggccacttcaagtctctctgtcagataccgcctgtttagttttatgccagttcaggaaacatcatccttccctggcatgctgcacccctgacatttgccccagggctgtgttctggaccgctaaagcctaccctggcctctctagccacagggctttcttctttcctagctttctctaaggcaaaaacaggttgcttcccttactttgacattttacctggactctttcgtgttgttatgttgtgcttcatgagaggccacatatggcacccaggtcttctgacttctagtgttgtgcatgccctgaaggttactatcttcgtctatttggtgattgtatcaaggaatacctaagactgggtaatttataaagaaaagaggtttattggccaggcacggtggctcacgcctgtaatcccagcactttgggaggccgaggcgggtgaatcacaaggtcacgagttcaagaccagcctgaccaacatagtgaaacccccccatctctattaaaaatacaaaaattagccgggcgtggtggcagcacacacctgtgatcccagatactcaggaggctgaggcaggagaaccgcttgaacccgggaagcagaggttgctgtgagccaagacagtgccacactgtactccagcttgggcgacagagcaagactctgtctcaaaaaaaaaaaaaaaaagaaagaggtttacttggcttatagttctgcaggctgtataagaagcatggcgccggcttctgcttggtttatggtgagggcctcaggctgcttccactcatgacagaagacaaaggggagccaacatatgcagagatcacatggtgagacaggaagcaagagagaggggaggtgccaggctctttttaacaagtagctctcccaggaactaatagagtgacaactcactccccacagagggcatccaactattcgttagggatctgtccccctttacccaaacatcacacttcaggcctgtacctccaatattgggatcaaatttcaacatgaggtttaggggaactcattcatttggctttcaataaatattcatttatttatcacttactcagccagaccctgtgttagacaaaatagtaagtgctgtagtactcaattagtatagatcaaattaatagctagtttcagctcctaaacttggggatgggggtgtggggtgtggtaaggaagaagagaagggtattacctggcagtgggtggacgtcagaggtaatagacctgactgccaggatgtacctccataaatttgagggactatagatagcggctagttcttatacctctaaaagatagcttggagaagtgaaaaggggagctatttctgaatgattcattcattcagcagtcttttagcaagtactttatctgtggctggtgttctgctggtggtgaataagatagggctctgttcttttggactccccttgtctctggagaggtaaacttgtagataggtgaatctcagtgagtggtataatggcaaagaagagtccagggaaggtgggaacttcgaaggacgggacttacttttcataggggaagtaagggaaagtttcatagagaaactgcacctcagaaggggattaggcaagagagcattccagaaaagggaataacacttgaaaaggcccagaatccttaaggaaaggagtatattcaagaaacagaaaacaagacagtgtgtttaggagatatgcactgatgtgttacattattggttgtaccatgaaggtctttgtgtggcatgttgagggtactggacttaatcctttaggcatcaggaaccaatagaggtcttaaagctatagtctagttgatggaaagaaaatagctgttctattgaatactaaccaatcaaatccccattttctactgagtctggatgcagcctcagaaatattctcatgaaggaggcatgaaagtatgaggctttcaagtaagcccagtccagtagaccttgagtggatgcccttggcccatatacctgtagtgatccagtaaatgcaaggccttcttgcccaatggacattggtccttttctccaggaagctcttctgaacagaaagtctagctcttttgaagaggataaaatgtgctgggctaaggaatcaggaagtagctattagtctgtaacctcactggtggctgtgattgtctttgccagctctgtatccctagaatccagcacaaaacttggcacatggtatgtgctcagtgatgtttgctgaataaataacaaggaaaagaaactaatcaactctctacctaaccagtcaaccatccaacctgggttctaattccagctcttaaattttcattctctcagctatacaaccacctggttgttctctaaggcctttcacaccctaggattgtaggatgatgaatagttcagagcaagcccagttatcatttataattctaatatgcctcaaatttaatcagaataaaatatcaaaaccagcactactttacaacatttcagatatgccgtctaaaaacagaacctgcatctgtctcagagttgtgaagaaaatgtattaagttatattaaacagcaagattgtcctttttgtaggaaaaaaataaattaaatcttgtcttcctgactggggattttaattgggatttgagtcaatttgatccaaatttgagcatccatccagagaacatttattgacatctgctatgagcaaggttttgtgctaggcatgagggagataggaaaatgaataagatacaggtccttccaggcaggaattgatggtgtagttagggagatataacatatacatgcttgactctgacccagatggacagagaataagcagagacagtccagatccaggggtaggagtgtcggaggaggaaatcccttccaagtacaccatatatgtaggaagtctgcctcttaccaccaccctagggctcagaatttagacggagctattgtggctatgaggatgtgctctgtggattgtgctctgtgccatgcaactgcctggagcttacagtcatcctcagccatcaagttgagcacctcagcccaaaccggtattggcaacgaaaatcatcttaggccttaatgaacagtgtgcacatactacactgccaagcttggtagcatctttttgtggcttgtatccttggagttgatttccagaaaaagttgttcactgtaacaggaatttgtatttcttgttttataagactggaaactattaataatatttgtccaatgtgtgctcttctctgccttggctgccactgaaattcaggacctagctaaaatgggatcatccactttcccaacatttatccaacaattatttgttaagtgattctctgtgcaaggccctgtgctaagtgggtaggagacacacacaggctatgctctcaaggagctgacaaaagatgtgtgaaccaggccgaggggaaccgaaataccagctgagagaagtactagagggatcagagcagaaaaagtttgattttagcctatgggcacaaagagaaaaacgtaaaagagatccatgtgatttggacctcaaaaaggtaggaatagtacacattgaaataggtgtagtaggatttctaaaataaaataatgaccaaagtattgaggaagcaaaaaacttcaggcttgtttaggaaagtaggaatacttcagtttggctaaggggaacaggcttagaaaaggttaggatcagatcatcacagagggcctcctcctcagatgttccagggtaaagcatttatatatttaattctatgggcaaaaagatgcctgcttaaaaacttaataagtttaataagtttttaagcaggtgtgagttggaaaaatcctagagttggaaaggattttggatataacctagttcagcctccatctgtattagtacgttttcatgctgctgataaagatatacccgagactgagcaatttacacaagaaggaggtttagttggacttaacagtttcatgtgactgaggaagcctcacaatcatgatggaaggcaaggaggagcacctcacatcttacgtgggtggtagacaggcaaaaaaatgagagagcttgtgcaggggaacacctctttttaaaaccatcagatcttatgggacttattcactatcatgagaacagcatgggaaagacttgcccccctgattcaattacctcccaccaggtccttgtcacaacacgtgggaattcaagatgagatttggatggggacacggagctaaaccatatcatttcaccctggcccctcccaaatctcatgtgtcctcacatttcaaaaccaatcatgccttcccaacagtcccccaaagtcttaactcattttagcattaactcagaagtccacagtccagagtctcatccgagaccaggcaagtcccttctgcctatgagtctgtaaaatctaaagcaaattagttacttcctggataccatggggttacaggcattgggtaaatacagtcattccaaatgggagaaattggccaaaacaaagggctacaggccccatgcaagtccagaatccagcggggcagtcaaatcttaaagctccaaaatgatctcctttgacactgtgtctcacatccaggtcacttgatgcaagaggtaggttcccatagtcctgagcagctccacccctgtggatttgcagggtaccgcctccctcttggttattttcacgggctggggttgagtgtctgcagcttttccaagcacacagtgcaagctgtcattggatccaccattctgggttctggaggatggtggccgtcttctcacagctctactaggcagtgccccagtagggactctgtgtggggaatcccaccccacattttccttctgcactgccctagcagaggtgctctatgaggaccccacccctacagcaaacttctgcctgggcatccaggcttttctatacacttctgaaatctagacgaaggttcccaaaccccagttcttgacttctgtgcacttgcaagctcaacaccatgtggaagctgccaaggtttgaggttcgcaccctctgaagccacggcccaagctctacgttggcccctttcagccagtgctgacaaagagcaccaagtccctaggctgcacacagcacagggaccctgctcccagcccacaaaataatattttcctcctagaccttctggcctatgatggaaggggctgctctgacatgccctggagacatttttcccccttgtcttggggattaacatttggctcctcgttacttatgcaaatttctgcagctggcttgaatttctcctcagaaaatgagattttcttttgtagtgcattgtcaggctggaaaatgtcaggtgttttccaaacttttgtgcttggcttcccttataaagctgaatgattttaacaacacccaagtcacctcttgaatgtttgctgcttagaaatttcttccgccagataccctaaatcatctctttccaaagtttcacaaatctctagggcagggacaaaataccgccaatctctttgttaaaacataacaagagtcacttttgctccagttcccaacaaattcttcatctccatctgagaccacctcagcctggatttcatgtccatatcattatcagcattttgatcatagccatccagcaagtctccaagaagtctctagggagttccaaactttccccacattttcctgtcttcttctgagccctccaaactgttccaacctctgcctgatacccagttccaaagtcacttccactttttcgggtatcttcagcagcagcccactctactggtaccagtttactgtattagtccattttcacactgctaataaacacatacctgaaactgagcagtttaccaaagaaagaggttaaattggacttacagttccacgtggctggggaggcctcacaatcatggcggaaggcaaggatgagcaactcacatgttatgtgcatggttgcaggcaaaaaatgagagagcttgtgcaggggaatgcctctttttaaaaccatcagatctcatgagacttattgactatcatgacaacagcacgagaatgatttgcccccatgattcagttacctcccaccaggtccctcccacaacgtatgggaattcaagatgagagttggatggggacacagccaaaccatatcgccatctcacacataatgacagaatcccaaaaggggaagttgctaacccaaggtcagacaactagttaatgatggtgctggagctggggccagaaccagatcttctagcttcagatatagtggactttttacactctgtgatgaaacctatgctctggggagattaatgaggctttctaggggaggtagtttgaaggagaggcaagagtcagggagagccttgagatgtttttacagttcagatgaaaggtaatgcacaaggtctttaattagggctttggaagtgggctgatgaagaaggggctgatgggagagaacatagaggtccagtcagcaggacttggatgtggaagacagacaagagggaaacttaccctgtcttcagttattgttctttactgaattgtccatttggtaggctatctcaaagtggaaaagaaagggtatagagccaagataaatacatcaaacacttccagtatttccccaaatgagcctctttgcaattgttgttgttgttcctcttccctagaaggcctaattcttttccagaacctggccttccagctcttaagtcctcagaaatgggatccatttgccagctactattctggcttcatgattttactcatgggctcttggaactgccctcattgtctgagtgtgtccctggttttggctttgccaccaggccccatgaaagtgccatacatgtgacttgcctcccatcctgtgactctaggtttgaaaccaaagccctgagacaacctgcaacccgtgctgacctccagaataggccaggcacccagcctgaaggagagtgctggactggactttaattgtgtaggggtcttgccccaggtctgtagaccacttgcatcagaatcacctggggaatattaaaatgtgggtttctgggctctatctcatcctgctgaatcagaatctctggaggtaggtgacaggaacttgtagttttgacaagtgcaccaagtgatttttatttacctaaagtttgattctgccttagatagttttttttcctggacctcagtttccttgttttaaaataggaaaattatatattcagtttaccgtgaaaatagaaaagtactttgggaagatgctaaaagtttatacatatttacttatcacatattattaagtttacagtcttgagataaagaaaatttgaaatatttcttagactgaaatacactgaaaaccagtaaatggtctgagtactcacacttagaaaatgtatgcttactaagtgatacggtttgaatgtttgtcccctccaaaattcatgttaaaacttggtcattataacagcattaagaggtgggacgtgtaagaggtgtttaggtctgcccttatgaatggactaatgctgttatggagggagtcggttcatcctgacttactcttgcatgtacatgtgctctctctctctctctctctctctctctctctctctctccctccctctccctccctctttccctctctctctctctctctctctctccacctctctctctctccccatctctctccctctcttcctctctctctccctctctcttcctctctctcactctcttgccatctaccatgttacgatgcatcaggaaggccctcaccagatgctggcactttgatattagacatctcagcctccagaactataaaccaataaacgtctattatttataaattatccagtctgtgctattctgttatagcagcacaaaatgtactaagacaccaagtgagtgaatatatgaatgaatagctccaggaaaggcaaaccctgaagaaaggtcattaactttttcttcaacatcccctacttcatgcattcaatcagcattattcactgagtgcctaatatgtgccagggcactatgccaggctgagaatataaataggatgtggtccttgaccttaagggattggagatcaatgtgagtgttcaatacagtgtgataagcactggccccaggatgggtagagaggtgggtattagtgctttggcaaccagagcagaaatcacctctatctgagcctgtcaggaaaggtgtcaccaaggagttggccttggagtataggattgttccaagaaggaggaaagccctttttacagtccttgtcactggcttccttcttccattccattaaattctgtcatcaatttcctctcctcctccatcaaactaatctcaggaactcaatgtttatgtgttttttgttttctttttcaacctacccaaatctgcttttatactcaaaaccaacacttaggtttagtcataaacacttggtcttaaaacaatgcttttttgaggatcagggtagtttacattgtcacccctaaaagttttcatctgaaatagttttaagctctattagggattttgtttgtaggtttactttttcacagctgataggaggagtgttgcagtttgttggttagtagttgttggatttttttttgggtggtgtggggagaggattggtgacaactggtttaccccagctcctgttattttactagataaataatcactattttgcttacccataaagaatcaagggttaattcatggtcttctttgtgttttaaggtaaaacgataatggttaatgaatcagactttaaagtggcatagccctttacaacttacaacatgtcttgactgttcatgttcttcttttctggtcaaaaggtggtccacaaaccagaggcagggagggagacgctaattagaaatggagaacctcaggtactacctaagacctgctgaatcggaatctgcactttagcagtattccctggtaatttttatgcacaataaagtttgcaagagactataaagttagtggtttgtccgatttattgattaggacattgaagtctggagagattagggaacttacccaaggtcacgtaacaagtagcagagccaggcctcaagccctggtctatctgattccagttcagcactttgtcactgtcctactaggtttctttgtgccatattaactggaaaacacttcctctgtgattgattcatggttgtgaagaaggaagaaagtaacaatttttcaaagtataaatgtatcttcttgggagttgcaagggactagaagagttaacggggagctcacaggctgaaccctgactttatgccagacacttggacaattatacacaggaagccttgttcccattttacggatggtaagaaccctcagtattttcctgaccttgatgagcctgtagggactctcggggaagcaggggttgaatgtcgtatttaaagctcaggcactaggactttctgggttggaggtgaaggaatcagatgttggacatttcttttcatccttaaaataagattctcttctggtatgaggctttgactaatcaggttgggtggctgcccacttcttctggagtcaggaacttaggctttggccaccaggaactcctcttgatttatgaacaactctgtcttgtagagtaaaagcggttttcccaaagaggaaaaaatagcttaaaagaaggccttgaagaatcaagatgacaaaatgtattatttataaggacctaaaataagtgccagatcctccacttgaagtgagcaggcgacagccgtgcgctgtgtggagtagagcccagctgactccagctggatccacacggcagggctggtcagccacagctctgctcactattccaaggctcttctcggaaagactcctgctgccggtgcaggccatctgtggagctcacatgaatgcgtcccggcttacaagcttaaagagaaaattcttgaaggaagctggaggaaatgcagtgagaatctgtggattggtagaaagaggccacaaacacacactcatacctgtaacacacacgcatgtaagattacatcaacttcccgacttactcactcaaggatacagacacgttttgagagtgaggagtccaggcagcacacagtagatacggggtatctcaactccgccttcactagcccctagctccctagtggaacttgcagctgcaggtaacaccatccatgcagaatagagttctgttgcatccaggaatcagccccttcttgctgcatcacaggcctttttcactcaaggcttgtctcatcattcttgaagaacttagtgctgctatgttttcctttaagagaatgttcacaaacatttcttatacaaaaagctcttccactttttgaagcaaactaatggtcagcaagtctacatctttatccagtggggaaaaatacagattcagtgtctaggagtctctgatcaatagccagcattgcagaaaacccatttccttgccactcatcctttcactctggcctaatacctttgttatctggaagttcgtgatactgagttagacctgaggatcatttcccaaatctgtttttctggagggcaagattcagtgatgcggcgagaggtaactgaagagtaggaggtgatgccgagggatttctgagggcacccaaggcaagtaggagattgtgctgcagctccagaactgttacaagtcttaccaacagaacaataggctaggatttgaacatacactgcagatttcagagccttctcaccgaactctaattattcctgtgtcattgtctttctcttcctcttcaaaatttctcttctgggatatggtgactacactgtggggagaaatgcttttagtagctctttctgtatttggagcttactttgtgttctctgttggctgatggctccctccccagccataggagctgattatgatccagcggccctgatgcagtcccctggcagcatcaacctggttttgcctctggttctgatctcaaggaccctccagtttcctcttatcataatggttgcccctagagggcaggattcaataggctgagaggtttacctacatgccctggcagtacagggagccttcaagaagatggatatctgacctttctaccccctacatcccaattcagaataataaaatctcaggcttgagataaattttcggcattttaaaatccaggcatctatttaatatttgaacgagaggcggcgtggtatagaagaaagaacactggctgaattcaaatcccatcttcaccactttctagctgtgtgatcctgggctggtcacctgatccttataagcaaggaatgccttgcagggccctgctggagaataaagataatctaggtaaagtcctgacatatatgatatgcttcataagtagtaagtaccattgtcctgtaaaccagagctttcaaactttttccttcagaacacttaaattctttcacatattctctatcatatatgatgtttagattcctcacagccctggttactttatttgttattattattactattgttacttttattgtaaaatatatatgacataaatttattattttaaccattttaagcatgcagtctagtggcattaaatacattcacattgttgtgaaaccattattaccatccatctccagaacatttttattctcccatactgaaatgttgtacctattaaacagtaactcccactccccatccgtgcagcctgggcactctattttgaatagcatgctccaaattcctcagtgtctttcttcccattgcaaatggaggttaaaaagagcctcttggaagggtttgagttcttcaaactcccactggggagcccgagaattaaaagtctataccagttgcggcaaacttttgggattgcagatggttacaaaattagtgtcaatatagctgctttgcatggagtggatctggcaaagaggcttctaagcactgatacattcctttcagaaatatcaaaggatatggcttggcatagctttggggagaaaccaacagttttcgaattcttgaatagcatctaccttatggtgaagattaaatgatataattcatgtcaagtgtataatacagtgcttggcacagatcaggcccttatatgtaggcttttgttaccataattgcactatggcagagattacatatatgttttggtagttaattcccatgataggtagacaccattttcatcttatctgaggaaactgagtctctgggctgctaaagcccccaaaattacagagctagtaagttatagagtagcagagctgggattcaaacccatactctttctcttataagatgctgcctgttgtgatacaccaagaaaggaaccctgtgagtgaggtgtactgacttcatcttgatgtttcatctttctgtataccctggcccttttctagggtcataccatcttgctgtttcttattcttaaaatcatacacctaatgtccaagcttcagagctttctgtatttaccagtccccattctctctgtgagtgaagtgatctctcacagtcttccataagctctaaagtaggaaaccaaaagcatgtgtgcaaaccatggaactctctggctttattcaatgagtatctaagagctaatgaactgcacatagaatttagaggaacgttgactaggatttgatcagaaaatggtactttccaggacattcagggcacccacaaacactaggtagagtttgttcagaaaagaaaatgcttacatttgacttctgtgagtgattgggattcattttcctttcagaaaacaagaaccaagtcacgctctcttgctctttcatggttgctaggaagctaaagccaacctggatgctcaatttcggcatgtatataagctcctagggctggcatttggatacgcctcctttccatggttttgaatttccgcttgtattttatttactgtattataggaataccctttcaaaggagatgagcttagagtaagtaaatcaataaaaactataagcccctagaggtcaaggaccattttcatttactttagtgtccccagcacataactcagtatctggcgtatagtagatgctcagtaaatgtttgtcagttgaatggatgaaagtgattaatgaatcagcattcaaaatgacttaagaatgccatctctggtaccttcctttggactttcagataacaaggccatcaaggtggaagctttagaaggtgttccttggattttggaggtctatcattaagaaagtgtgtgcacattgctagacatcggaaataatattggcttagacaagacagaagcattttctctcactgttatggactgaattgtttctccccaaaattcgtagattaaatccctaacccccaatgtgactgtatttggagataaggtatttaaggaggtaatgaaggttaagtgaggtcttaaggatggagccctaatctaatatgacatatcattatgagatgcagaagagacactaggaattgctctccctttacatgcagaggaaaggccatgtgaggacacagcaagaaggcagccatctgcaggccagggagagacttgctagaaaccaactctgatggcaccttgattgtagacgtctagcttctagaactgtgagaaaattaatttctgttgtttcagctacccagtctgtggtattttttgttatggcagcccaagcagactaatacattcacgcatgacaggtctgatgatatccccccacaagattgctataatagttctacagatatcaagggccctaattatttctatctctctgtttcactatccttaacataggcctttgtcttcaagattttctcaaggtccaagatggttgctagcaatattcagccagatagaagggagaaaggacaaagagaggcctttttttttttttgagacggtgtctcgctctgtcacccaggctggagtgcagtggtgcgatcttggctcactgcaagctccgcctcctgggttcacgccattctcctgcctcagcctcctgagtagctaggactacaggcgcccgccaccatgcccggctaattttttgtatttttagtagagacggggtttcaccgtgttagccaggatggtctcaatctcctgatgtcgtgatccgcccgcctcggcctcccaaagtgctgggattacaggcatgagccaccgcgcccggccaaaaagaggcccttttaaggcactttccctgaagtggtaccaagcaatgtcaactaaaaactggccagagcctagttacatagccaaacctgttatgagggctgggaagtgagacttttagctgggcatatgtttatcctgaataaaatttgaagtctgttaccaggaaagaagaggagaatggataataagtaggtaaccagcaatctatgcctcaaagagcaggagaattgtggggaataaaggaagctggaagtcagcatctcactcataaaacagtcccacttctcagcacctgagcagtaccctgagtgccctaagcaaggtgatgagaggagatggctctcacctacagattagtccaagccccgtgcttgactgtagggcactactcagtttgggcctagccaccctccccgccttctcttcccctgtttgccaataccttgcccccagccctgttccccagatatgcctgcacttacctacattgcagttccctctacttgggatgtcctttgacactttaatatcttattattctttcaggctccatccaaactgttcctcctgggagcacctaacttgctttcaaagagtagagcatggaaaggggttgggggagggggatgagtgaggaatagccttacagtggagaaacctggcaaacactaccttgcccaggtgaccaaggttaacatcatcagtgataaatcatgttgatagtatataacttttatatagtgtgatgataaggacacttcacctctgtggtcttcctcctccaagcccataatcccagtctaactatgagtaaaacatcagaaaaactcaattgagggacatcctacaaaatacctgctagtactcaaaactgtcaagatcatcaaaaacaaagttggagaaaccgtagcagaccagaggagactaaggagacatgatggctaaatgtaatacggtatcctggagcagagaaaggacattagggagaaactagcaaaatctaaatacaatatgacgtttggctaatagtaatgtaccagtgctggtcccttagttgtaacagatgtaccacagtaatataagatgttgacaatgggggaaactgggggagggatatttgggaacttagtactatctttaaaacttttctgtaaacctaaagctattctaaaattaagagtttattaaatgaaatctctgtgctcctcctcactgatggtatgacttgggcaagtcacttgacccctctaggctcggttcttcgatgtaaaatgggggtgacgtaccttcactgcaggataggaaaaaaacttcagtgagacagtgtgcctgatggcactttggaatcagtgagccttggcccttgggatggctttgggtgcttcacacgttattgttcaaatgcagattccactcctgcctctctgaaactccacacagggagccgctccagaggtttccccaaaggctgcagttgctggtacctagcaaaaccctgccctgtccccatttggagttctttttcatccagaatttctgtgtgggtaacttccccttcacctctcttgatagcttgctcttatagactaagattgcatttttattttcatatttcacttcatttttcccccttgaatttagtttttctctttaggaatcagcatatgactcaaactgccagttctaaatttagtatcgcctgtgatacggagaatgcatttagtgctgcctgggatatgtatttggaaataatggttttatttatccacatccagtaattctgctgcctgcctgctgggttctttcaggaaagagtttgtcatctcctttcctcctaatgatgaaatgttgcttgctcaagtcccagaggcccagcctgagccagatgctggtgacttgagtctctgtttaattaaacaataccattcccaggattctgcagtcataaggttctgtctatggcttctgtttagagggagtttggaaataggtctagaaggggctcatggactctttggatcctgtaggcttatttctgggcctcaggctggtaagatttaccccttttttggggagaattgccctttcagtgctgaaatatgtggaaggagggggaagctctacgtgtatgtagctgtgtcctatgttgtggatgctgaggacttagaagcagtaaatcacattactctcttgccctctgagaagctcttctcttttgagtgagatggacacatatacacatgattagagtgcaatgtaagaactgctgtattacagcaatgtacttggcacggaattaatatagagagattaatctatgtgataaggaaaggcatgcagagaagaggtgatatctcagtagagttttgaaggataattttataggtgtttgtaagggaatgaggagggcattctaggcagagggaatagcatatgcaaagacatggaggcatgacatagcatattatgtttgaggaactgcaattaattcatttatttaaaaaaatgtatggagcacctaccgtctacctggtgccatgctaatcattagggttttgataatgaccaagttagataaggttccattctcccaaagcttgcattcttgtaacatagtttgtatgagggagatgaggggtgatacatgataagttaaggagataggcagtgtgtattagcataataatatgaataattattagtattcgtaacctaaaaattattagtctcccataataaagtaccacaatctgtgtggtttatgataggaatttattctctcatatttatgctctcacttctggaggccagatgtccaaaatcaaggtgtcagcagggccatgctccctctggaggctctaggagagacagttctcttgactcttccatcttctggtgtttccaggcattccttggcttgtggctgcaaaaaccctgaccctgcctctgtcttcacgtggccttctctgtgtgatgcatcttttcttctttctcttataaagaagagagattgcactcattccaaggtctttaacttggttacatctgcagagagtctgtgggctctaggggagaatctgttctttgacccttccagcttctggtggctgctgccattccttgacttgtggccacatcactccagtccctgcctccatggtcacactgcctcctcctcttttgtctgtgtgtcagatttccctctgcttttctcttgtgatgacatttaggctcactcagataatctaggacaagcttcttatttcaaaatccttaacttaattatatgtgcaaagaccctttttccataaaaggtcacattcacaagttctgggggttaaggcattgactaacatcttttggaggaccattgttcaacccactatacagtccaagattgtaaggtctttgtatattcaccttatgaggtaggttttatcatcctcatttttcagatgaagacactgagactcagagaaattaagtgatttgcccaaggtaattcaaaaaggaagtagcagaaccagtgattgcaacctggctttgtccgactttgaagcccattctcttcctcccatggcacactgaccagaattgtttagaagtctgtcctttggcttaatacacaagtgtccagttgagggggttgcagggagccacacctagctattaccaggcagtatgaccttagtgggagctagtttgagagaactgttagaggatcgagagcaggctgcagtggatatgggcaggaagtttgggggagggagggcagtggggatgggggtgacaatgaagagaaggggcttggagttcaggacaagggcaggaatacccaccaaatgagggaaatagcacttaaaggaaaagtagggccaggtgcagtggctcatgcctataatcccagcactttgggaggctgaggcaggaggatcatttgagcccaggagctcgagagcagccaggacaacatagtgaaaccccgcctctacaaaaaaaaatttttttttaattagccaagtgtggtggtgtgcacttttagtcccagctcccctggaggctgtcggggaggatcgcttgagcctgggaggttgaggctgcattgagctttgatagtgccactgcactccagcctgggcaatagagtgagaccctatctcaacaacaacaacaacaaaaaagcaaaagtgggccatgctttaccatcgtagagttttgcccagcacctctggttctttgatgtgtgaggggctcctatgcttgcctacaactgggaaggtctctgactggggtggatataagctggagggcctgagatgtgtagagaaggactctctgggtttgtattattcattcctcctgagcattgccatgagtgagcactggaaattcagagatgaacatgttttggtcctgcaccggaggcagagtggcagagtagaaaaagatcaagaaccaaatccctgctctgcctctcattcaccgtgtgacctcagatgaggcactttagctttccaagcctctgttttgttatctgaagaatacagatttttttgagctttgaaggagataaaaatgaaaagtgagtggcacacccctggaatataatagggtcaatgaatgttactttcatttaatcaaaaaactctcttgctgagcagagcaattgtttccaaactggaggttctgcagccttggagtcctcagagtctataacacatacacctacatgcaccattgttttcaaatattgtagatggcatggtgttgactaaaatacagttgcatttataggctttactgaattaatggtgactcttggttattaagtattgctttgattggtgtatatgaagatcctgaaattctttgatattaaaaaggagtcttcagactcaaatatgttggcaaccactggcgtaccatggaagatagagatataaactgacaaataagattatgggtgaatagtgttattacagagctattgcagaagcatagaggaaagctagacagctgcctgaagaaatctgggaaggaggaggtgatacttaggctaggctttcaaagatgagtaggagtttccctcctttggagagagggccttgcaagtatagggaacagcaggttcaaagtctaggtggcaaggacttcagttttggtgggaggtggagtgggagacaggccagaaaaggagctaggagcagggtcaggaccaggccttgaatgccatgctatagagtttaagatcaccttaggcaggggaaatcaggggcggagtttagatagaggagtaatagtgtttgaccttttagaaagatcattgcctttgcagcttggagagtagagctggagagacctgtgaaaaggaggcagttgtggaggagcagagtgggactcacagcagagcactaaagcacaaagtctcaggcagtatataccctgggcctaaatcctagctgtactccttaacagctaagtgatccaattactcagtctctcagttcctcaattttcttatctgtgtgatggatataataatgtatctatctcatgggatttttgtggaatataaataaggtacatatgtatggagcccggcacactgtaggtacttagtagatattttctgtaaaatttcctacttcatttttttcttataatcaccctaaaaaggaaaatatatttgcttgttttcttgttttacagacaagcaaattgaaactcttagagattaagaaacttgcctaaatccccccaggtagtgtggctcagaggtctgagttcctctgagcctttgccctttccactgggagatgctgtttcccgtgtctcactcaatcctgattacaagtaagttcacttatgcctggggcagagcggacacccagaaaaccgtaactgtatagtgtccatgaactctaacaaagaagtgtacacgtggtcatagcaggctggctctcccaatcctcaagtctgtccgtcttagggaaagatgggatatgcatagagtggtttggaaacctcgctcatccaaagtcacctgctggaagagccttcctgatggctgagggcatccatttctggttctgtggcctttcaacccagaggacaaatgaagtcaactggcctccctgagtttaggttggagtggttataacatcatccttaccaaggagagcttgagaaagggtgcagcctttgggttgaatacttaaattgccccttattagctatgtgatcttagcagagtgctcaaacctcagtttcctcaaccaaaccagcattaataacactaaccttgcagagttgttatttggattaaatgatacagagccaggctgtctgggtttgaatcccagctctaccacttactagctttgttatattgatcaaataatttaatctttgtgtgtcttggcattcttgtctgtaaaatgggtgtaatgatagatcctaattcaaagagttgtggtgaatattaatgagttaatacatggaggccaggcgtggtggctcatgcctgtaatcccagcactttgggaggctgaggcaggcagatcacgaggtcaggggatcgacaccatcctggctaacatggtgaaaccccgtctctactaaaaatacaaaaaaaattagccaggcatggtggtgggcgcctgtaatctcagctatttgggaggctgaggcaggagaatggcatgaacccgggaggcggaacttgcagtgagccaagatcgcgccactgcattctccagcctgggcgacagagcgagactccatctcaaaaaaaaaaaaaaaaatacatggaaagtgcttagagtaatagtatctaatagtaatacattgtaagttctcagtaaatgttagttattgttattattatcatgagctttttcctctcatagaccctagcagctgtgtaaacatgcaggcaactctttttgacagagcaacaccagcagcagaggagaggagagatctctggtctttaggcagatacagagacaatgtgcctgtctggacaggcttctagggcaagtagcactcttccatgtccttgaaggaccatttggtatatcacatataaggctgcttccctatggagagggttgagatctgatctgaaggtgaagtcatttgtctgtcaccacattccagccccattacctgaagaggaagcagcactctcagaccagaacccagaaatgaagggggttggctcaggccagagccagagctgattctggatcttgtctcaggccacaagagacaagactctgcaggacagatttcccaaccaggataccaagacaaggatcgcctcagcactttggggtggctggccaggactgagctagcaggagcaagtggtgtcagactgcacgcttacctttccatttacctatgtgccaaacttcagtattttttatgtgaccttaaacacgttggggagtactgttctgggaggccatgcctttgaggcaataagcaagatagtgaccaagtggaaactgctgaaagttcaaatggcaggaagcttagcaaaagctgctgcagatgttatgttccagccctttggagagagaagagttattaaagagtcacaaacctcatcttggcagccctgcttgcttatagatatgtttggattcctgtgattatttccttttcattccccctagcatttagtaaacttcctcttgcaaataccgccctgtctcagctgcactaatgggaactgaggaaagagggtttcatccatccttagactagagttattattcagaaaaacaatactccccctttctcaggagacaccatggtgctgagagacttctggatcaggaaaggggagctggaagaggcagaatgagggctgcttgttcatttgctctacctgagcacagccccttttagggctcattattcaagcagagtgcagtcttcccactttccaacagtagcccaatggaaacaatctatagcctggatttgccttcaggaggaagaccactcattaactagcaaaaacattatcttccccttagtatttgagggtcagtgttttttgtttgtttgtttgttgttgttatttgagatggagtctcactgtcgccaggctggagtgcagtggcgcaatctgggatcactgcaacctctgcctcctgggttcaagcgattctcctgcctcagcctcccgagtagctgagactacaggcacctgccaccacgcccagctaatttttgtatttttagtagggacgaggtttcaccatgttggccaggatggtctcgatctcttgacctcgtgatccacccacctcggcctcccaaagtgctgggattacaggtgtgagctaccaagcccggccggtttttgttttgttttgttttgttttgagatggagtctcgctctgtcacccaggctggagtgcagtggcacaatcttggctcactgcaacttccgcctcctgagttcaagcgattcttctgcctcagcctctggagtagctgggactacaggcatgtgccaccacgcccggctaatctttgtatttttttttttttttttttttagtagagatggggtttcacgatgtttaccaggctggtctggaactcctgacctcaggtgatctgcctgcctcggcctccgaaagtgctaggattacaggcgtgagccaccatgcccggccaggtcagtttttaaaagtgatgaaaccccgaagtatttatatagatcaaaaccctaaatccagaaacagatcccaggtaagaatgtagatcataacctaaagactgtaatttttgttttttgttttcttaagagatggatctcattctgtcacccaggctggactgtggtggcccgatggtagctcactgcagccttgcactcttgggctcaaaggatcctactgcctcagcttcccaagtagctagaactacaggctcatgccaccacacctggctaattttttaattttttatctttgtagagacaaggtcttgctgcgtagtccaggctggtctcaaactcctgggctcaagcgatcctcccacctcagcctcccaaagcactaggattataggcctgagcgcacctagccatcctgaagactatgttttgtaaaagcaggtcatcctgcttgaatgagcaaaattgttcatactcctagttccctttggtgttaactgcatccccaaggagaaggagaactcagaggaatcagcaacattatttgctttggccaggaattctgtcccagagttcttaagagaaattccacttcctcacagacctagggtgatacatgggctttggaatcatagttagcaagctttggtttcctcatgtgcaaacaagcatcaaaatagcaaaacctacctccaagggtcatttggaggatgaaattaggtaaattagatgaaagcatcccatcccatgtgtattcatcagggttccccagagaagcagacccaataagttaaatctctacctctacctccatctcagagaaagagagggagaaagataaagagagagtgccattgatttgaaggaattggctcacacagtagtgggggctagtaagtctaaaatccatagtagagattcaggtaagaattgagtccaaaggctggaaactcaggcaaaatttctctgttgcagtctggagatagaattacttctccaataaacctcagtctttgcttttagagcctttaactggatgaggcccacccacattatggaaggtaatctgctttacttaaaatcaattcactgtaatatgttagtcacatctaaaaaatacctttacagaaacatctacactagtgtttgatcaaacaactggtttccataattgacacaaaattaaccatcataccatgtaagggttagagttctcaacaaagacatttccttccaacttcccttcctccctcctttttaaagtcattgctgaggtttgaagaggtttcacttaatgctgtctctggcatgtaggcccacaagctgttagaacctaagcagtggggtctgtgtgtcccttctgtctctctcagatctgtttctgctgagtttacatctcagggaagcagtgtccccacttcctgagtcaagccctgggatagctttagtggttttccattgaacctgtgctccaggcacagatatacagataacgagttttcctccatatcctgtacacattgttttcaatctgcttctctaatgtttgcggtgttgcattccttatttttgtttctgaggtttgatcagaagatgtgggctctgccacagtgagaatatttcagctaccaggatgacctttctggcacaggttagttagcagtgactgagagactgtaaggaaagatttttgtgggggagtaagagttaactccctgcctagaatgtttcaggtggcattctgcctggaagtagagagctggactccattccatgacagagatttatactctgcaggtgatccaaaatgcttctcattttaatggaatgtggaattgcttttgccaaagttgaagaatgttttagatgggatctctaaggtagcaaaaggttgtgaaaagagctctggaccaagaattagaagactggaaccctgctttgccactgtctccccacatgatcatgagcaagtcacctcatgagcttaggcctcagctacctttttataagattctggaaacaaaactccacctcatctttgcacagacaccacttggctgctttcagagcacttttaccattcatcatctctggtcctcacaccagcttcgtgaggtagacaggatactggtatggaaattggtacttctgtttttcaagcaaggccactaaggttcaaagagattaaatgacttgcctaaatttacacagatggaagtgataaggctgggactgaatccaggatccttagtctagcttgttttagggtacccttctgaatacggtgatgtccatggaacagtagggaagagcacacagtcctgttggcagaaaagtagtgagcagatctgatgtcggagaggaggtgacattgccttcacgctctccaagcacccgaggctttggagggaaatgatagtctgagtggactcccataaaccagaaggaggttggtctccagctactcagattaacatgttttctcatgctgttgattcaattcagaaaacatttattgaggctttatcatatgccaggctctctactgggggcagagtaagtaagcagtataatgaaaagtagactggtaagttttgtatttgaaatgtaaacagagggctttgggtttacagtcaaaggtacaattaagtcattctggagagatgaaggcaaacacagctgagccctgaaggatgaagcaggattgaacaggaggagaatggagaaaagtgatccctgccctactcttcctgcttggcccctgtgccacagccacccctgctatgaactgccattctacatgaagccagcagcagacagcctgtttgctgcagaacctgccagatctaaccctggtggagctttaccattgcttgtcagatttgatgcaatgccctgaagcatatactgcaaagcaagaggaattctgcctggcagctcttagaggagtatacagcaggaggggaggcccatgggcccctggcagagaaatgggcaggttggaaggaggtacttttcttagtgattgtgcctacccctcttaaggggctgagaggcaggagctgttgctttgcatgtgtgattttagactgagagtgttttgtgtctttattttaaaactggtttctcagtctcccgtgcagttttctgtcagctcgttgccatggagaagtgggttggggctggaagctctgtccttctctgtcagcatttctggacccaccagctgcctcctgccccttctgcagatggaggggggcaggaccacatttggtgggcagaccttttctctgcaagcactggaactgcacctcagttccctttgggatgctagtttcattcacccatgcattgactcagcaactctacattgagtgtcttttatgtgccaggcattgtgctgtgctctgcaagtacagaaatgactttggctggtggcacgtacatctgtggtggaccctgccagcctgttctgttacaacatccctgtctgttactgttcctcaacctcattcttttcagaatttgaaggactgaatttgtttctcttccaatctttataactgctcatttaggagctccctggaagttacctacttagtctctccactcctggatcgtattcttcgcctccggagcgcccagcacagtgcctggggcaaaggagggacttggccaggaagtgtatatctgatggaattctttgtcaaacctctcagaatgtctgtctgtcctgtctttcttcctccacgctgagcctagatgcagcatgtctggaagcatgagctaatgggaaacgacgggtttttgaactagataaatctgtgcttgatatgatctgacaagcaagtggcttcttagcttggagccttagtcaaacccattattttctctaaacctgcatcacaagtctatcagcaattgagttttgacaatttaaaaagcagtgtagaaattcttggtggccatttaatcctaccagctgctctcctggctacgtccatgtgggacccagatgagaaaagttgtcctgcagagaaccctgggttgggatcaagagacatggaactgtgtcctggctgtaaccctaatgtactgtgtgactttgatcaagtctctttccttaccaagacctcaagttccctatctgaaacatttaggaattgggttaggtgatcttggagggttcttttagttccccagatctgaagattcagctttgaaagaaaaatcttctctcagctgcttccaccaccattaccagtgtccctaggctggaggctgacctcagcatgaccccttctgccagcctctggaagctgctctcccaagaggctccgggctagaacactgatactggatgcagaaatctctttcggatgtaaaagtctcctttgaatgtatcatctctgttctcacccccagtccggtggctaggcttggcttgcatcccagaacagagaagaattgctggaaggaggtttttggtggtggttttttttttttttcttcacctgtatcctgcttttcctcaggacctgttaccttcctgagtctttggctattaaggattctatttcctgagccacctgtgacccagggctctgtgctaagcacagtggaggataaagagatacaaaagtcatcgtcctcacagacagtctcacaatctgtgacatggacaggtgaaataaagaactacaaagttcatgggaagctcatcaagggaatgctatggacttgggttctaggcatagcccttattctgtcttctccaggccccagttttctgttcggtagaattttgagggttgggccaatgatctgtagattcccttgctgctctgaaatttaactatagctcagtgtaggcatgattgttgtagacattttagaggaaggaggacttgagctgagccttgaaggctaggctaggatttggattagcccaggataagggcattcctgattgcgggatggggaggtgtgaggatagacagatcccaggctgagggcagagtgtgggaagcccttctgaccagagcacagggtttgtgtgggatacaagaagtgagagaaatatcagagcaggcagctgttgccttccatctgagggccctaatcctcaggggcttggggccaccccagtgatacctaaggacagagaaataaggcaggttagaaccagggcattctccctaaatggggaccctagtctgatgcatatcatgacagaagacctccaccaagaatacactagggtcaaagaaagagaggccacttctctccaggtcctttccttctcactccaaccagcaggtactaggttggtaggagcagggcacagtgtgggagaataaatcttcctgggacagctgcccttgtttcatggtctgttcctccccaaatgttttcctgaactcagggtgacaagggatattttggccatatccttggggttggattctagattcatctaccaggactgtgaatcaaggaatcacatatcctagacctggttgcgacttccatcctcctagtctcctggctaaggctatctgactcctctcacccctctgtacccacagcttcacagatgccaagtcctcttggtcccacctctttgctttctctccgtcctgccctcttctgcgtcccactgccactgagacagctcaggctttgtttgtcctcctcctcttagactttgcctccacctccaaatgatctcccttagaccctccttcccactcagtctaagtgtttagaaaagtgcctggcatcgtgtgagtgcatcctaaatgtgatctgtcatgatggcaagaacaatattgatgattgttattatgccagattttgcctctgaggcacagatctgattctgctactctgttgtccaaaagccttagtggcttccaattggctatgaaataaagtccaaaatctttagtcaggctttttgaggattatatttcttgagccatctgccatatgccccgtacttatcatcccaaatttctttccttctgctatgttttgcaccacgtcttcttccaccaagtggaactaccaccattatctttgcaatcccctccttcccccagctaggtctttgttcccactgttctatctacttagaatgctctttcttccctctcccctaacttttcttcttcctccaggaagtctcttctgatccctcagattatttattccttgctagcaggtgccatgaatggttcattttatatcccttatgatatctaccaagtaagacaaaatagacattttatgaatgactggaaagaccgggtttagccccctattttcaaggaacctagagtttgaattagggagttgtcaggacttgtccagccaaaccccaatacctatatattcctttggagagatccagaagttctctaatggacaagtattcagttagctggctccacatggtcatgaccctataaagtgtatacaagccaattggctcctcttacagcaaactggcaggaaagggtagaaatatggggaatactagctacgaagttggcccctgctgggttgagatagggatcagtcatacaaggtgtaggggcctatattatcctggaaatgtcactatcctggagggcccatttgtgaccaggggtctgacagcaagcgtcttaaggtaattatcattgggtgacatggcttggatgtttgtcccctccaaatctcgtgttgaaatgtgatttccaatgttggaggtggggcctgttggcaagtgattggatcatgagggcagatccctcttgagtggttttgtatcatctccttggttataagtgagttctctttctgagttcatgtgtgatttggttgtttaaaagcgcatggcacttccccctgctcgctcttttgctcctgctttcaccatgcaatgtgcctgctccccctttgccttccaccatgattggaagcttcctgaggccctcaccagaaacagatgctggcaccacgcttcctgtagagcctgcagaactgtgagccaattaaacctcttttctttataaattatccagcctcaggcatttctttgtagcgacacaagcacggactaatacattgcacattcacattccaaggggcccaagccaggcagcaacttggaggacagataagaagttcaggcccttggtagtgggatgtcaggagagcctaggcagagtgtgagggtcctgctcagccagtaagagtttgactcaggcctttagccccaagaaactctcagattaggggacactaatcttgtggctgcacattctagggggtcagcagggctatcaaagggaaatgggctctcttcctgggtcaggactgacttagaaattggcatgttctcaatttggaaacaccttgttctggtcttcatttcccttaagtgggcaggactgggggaggcaatggctgccatatagctaggctcagatatgagtcctgcctcccctcctggttcacagcctggcttaccaggcccttgcttccatttcaaagtcaagtcatgatcatgccaccctgtaggccaccatttggaaaggccaatcccaggctgacactcattgcctgtaaatgacgtggaattagggtaatcagtggctcctaattccccaacaaatgcaagtgctgtgctaattgccagggtccacgccggcagatccctggttggcggcatcaaacaagagaagtggtaatttgggggctggagttggggacagcctgcttcgttggctgagccagctaaaaaccgcattaccccctgggtgagccacagtgcagacagccagggcctggcttccttatcagtaaagggaccaggtgagtggcccaaagtatgtttataggagctgaaccttggcaccagtgctcagcagttgcttgtccattaatgggttgtgttgttgttgcatgggttttggtgaattttttttgggggggggagttctttgaggaagattccacaagcagcctggcatggcactgccggggcagctcatcagggataaagcattccgaaccttggtctgctgttaccatggcagcatcacatgtccggacattccaggcaacccttactggcatctgctactgtgacagattcagatggagaaggaacactgctcttctccattataaacagagcaagttgtggagacaggggagccattcaccaaggaccagggtcttaaagaaaatgctattccatcgagttgggggcttcttgatgaaatagtatttgagtggttgttaaagcttttctgttgggggagagatgcggcatcagaagagacctcctggaggagagaagtaaggggaggtgggggcagcatgaacaaagtcctggctcaggggtggggtggtaaatagagtgtgtagatggggtacacaattgagtttggtgggagaacagaccttgttggaggtaggcagatgttagccatacctctctgaatcctgctggtttgagccctgtctggcaaaagtcatcacgccacccagattctacctgatgctttcctctcctgaggaacgggaagtgacggcctcacctcacttcaagtgggcacttctccctttctcttttgggtcacagttgtttgtgatatttctcgtgcccattagaataattgaatctctacatttcagatgggaagatgcttgcctaaggtcacccagcaatacagaggctgtggaactaggagttacaaatttaggatctggacaggctgacgttggtttgagtcctggctccaccacttagttttcagctgagcctgagcctcagctaagcctcagcttcttcaagggtaaaatagtgatccagaacattcctgccctcttggcttattgtgggtgtgaaatgagataacagaaatagtacagcatagttcttgatatatggtaagagctcaggaaatgttcattattaaatgttagttattttccacataaatggaccatcgtattcatctttgctccttcctccttctctttccttgcatacataaggtacccaaatatcactttatctagaattgatattagaggaatgtttgttgactagttgaatgtgcgaatgatgggaacaaggaaccatccatgttgctgggctctatacttctgtctagtgttttcacctttggtgcagtttagtctccatagggtgggagccaggccaagcttacagtctgtcctgtgtagctcagcttgcaagtcaagtgacttgctcattcaggtttcatatccagctgccctgtggcccaggacttaaacttcccagggctttgggtttcttgaaggacaaatgggatggattcctccctacctttgggcccaataaatggtattcatggtaactgacatctaactttataacatacaaaaggtttccattcactcttccatgagcctcaccacagcactggaattgtcagaacaatagccccatgttatggataaagacactgagtctcagtaatagggagtggctggtccagaagcacacacaggagagcaggaagaggggatcgcacccatcttttgactctaacactggtggtctttccactgcatgaagcttttagggtctgtagttcttttaggatatgatcccaatgaggtaaagaatactaggcttggagttgaaataccttgattttggtcatgaccctgtcacttacaagtttgcagctctgaaatgagccacctctcttcccaaggtgcttattctctgaccttcttgcttcagggttgtggtggggctgatggagctttggaaggtctaaaactccacatgagtgactgaggagaagagcactgtatccatgagccaccgtgagctcagcaaggctgtacgcccagcacagccagataggctgtagaattacagcctgggtatattgggaaagttacacttcattgtctggaacatcaaccatcagatccgggagggcccttgcagatcaccatagctggtgctttcagtttataggtgcagaaactgagaccctgtgagaggtagtgactcacccaagaccacgtgttgagttaatggcagagctgagacttagagcccaggtctgacactcagccccacactgccatggagccatgtggctgttaggaagggaaaattttgcattttctcttgcctgagtatctcatttgaattcatttgaaactgttagataaagagtttctcagagaactgtgtgcatcagacagtattttcaacagtctttgttttccaaactttttttgttatgaaagtaatatatgatcatggaagtaaattgggataatagagaaatgttctatttagaagacatcaaattgagggatattcttagccctcagaaaagatattttttagatggaggcttttagaccaatggttctccaaaccctgcaacaccttctggaagtttagttacagacagtaggagagtaacagtccattgaggcctctgaggacttaacttagttctatagacttgagatagttagatataccactaatggtagtaataataatagttgttggcatttatttgcagagtctcttccaggtaacaaacaactttttcataggtggtctcatgattatttgattgttagaagaatccagtaaagtagggaaaacaaatactatgcttccattttacaaaggagaaatctgagcccaagagagattaagtaatagtaggagctactgacttcaaacaaatacttggcgtaaagaaggaaggcacctaacaaatatttgtgaataaatgaatgattgaatgaatgctgacttctcttctagggaagcctctagaaatcattttgtccagtggttcccaaactatggtctgggaagctgtaggattccatggagccagttgggagtagtgggaggctgagtggatagggctctgagcctttcatccctgctccagtcagaataacttcagtgctgcctgtttcatgcactgggagattgaaaacaatttagcgagtctaactcctacagcagtggttctcaaactctgttgtgcgtcacagctctgagggagattctgacagttggtataggatgggcatcaggactctgattgtttaccagcacagatggtcatcgggccactgtttgaaaaatagtgtcctacttctgagagttggagattgcaagacccagggagaagcaggaattagccttggtcatacaatcctgtaggaacataggccccactaggtgtctgatccttgggtacctcttccactgcccttcccccggtaccacaactgcaaccgtgccagaaaacaaatgacacagcagagaagaacaaaatggtttccatagcaatgcttagtggcttgtgcctgtcagaatgcctcagacaaacagtaatctgaaccctcggctagaacttgtgtcaaatgttacctacttgttccatgcaaggggtccatggagatgggaagaaggagaagggatgacacaattttgccatgtgcccctgtattggacggttttcccagattcactaatagctggcctcaagatacaccagatcgaggaaggctgagaagtagatcctgggcaggagatgtgggcaatcccaacagcagaggggaagatggggaagggaacaagtgtccagtgagcgtgtgtcacgtgatggagtctgtgctgggcactttacatattcgtttagaaaaaggcaaggaaaagacgattgttcttatttacagatgaagaaaccaagaattaggtatatacagtaggtgacagaggcaagatcaaatccaagcctgtctggctccaaaactactgagcagcaacaactctctcccagttctctgacccactgggtgaggacttgagatatatactgcccagctggctttccttcatctcagaaagcagagggtcagcctacatgcagatggatgggtgctcatttgaagggctgggatggactaggctaggctaggcctgccaggacagggttgatcctagagttggaggtggtctgttcaacctctagctctgataactcccttcctccataactgaggctgcagccaccctacagaatgcctttagcatgggctaccctgactgccctgccacatgtgtgggtgtgcacacacaatatagcagttgcttcagattggtgatcccagtagatggtctgcccagcactttgatttgggttcccctcaagggaatgagcccctcctggggcaagtgacaactcttcattgctaaaacaaatatttattgagcaccttttatatactcataccttttctaagtgctggagatacagcagttgaataaaatgaaatgtttgctctcatagagcttttcattctggtggggaaacagacaaacaaaagtatatgatagggtattacgtgctgggaaggaaaattaagcagtataaagagaatgaaaggatgaaattgggtgatcagggaaggccctctgagaaagtgccatttgaatgatgccctgattgaagggagggagggagggagccatatggttatctggggaggaaggttccgggcagagggaacagctggtgcaaaggctaaagctggaagcatgactggccagttggaggaagagcaaggagaccagtgtggctgaagaggagtggattaggaaaggtgaggacgcgagtggcagcagtgggtatcagagaggtagctgggatcagatggtataggaccttataggctaaggtccagacttggtattttcttctgagctagaatgccatttgaaagattcacactctgagacaaatgtgcctcgcctcagcctcaaagtctctagcccccttgtctgggaggggaatctgccactaggggctgagcccacaggaggctgagtagtcccaggtggagacatgtatagtcatgcagggagggagcccagtggaactcactgggcttccttatcttcatttgtgtatttattcttagaaccaatgtttaagggtctttcagggctgcctcatttttgggtggcctcatactacctggaaattagatgtcccaaagagagtctggctgcagggtctcatgcaaacactgcatcctctgggaatgccactgctcctgctgacaccctgcttcaggagaggagctctgtgcctgggtttcccagcgcagcagtcctggcagctcagcagggttagagaagaatgctacttccaatgggaccagtaggagaacttgggtcggtggttataatgatctgaaatggtaattttcctttcaaatattatgtgtttttttatgaaacagggacattcacaaaggtaatttatattattagcccatgtagtatgtatgcatcccagtcaagcacttcattcaagaaaaaacaaaaacaggagctataatttagagtgatgaaggcaccaaattaggccccatcgaaccataagcacagtgttacctcttgagctgcccgctgctcacctggtagctcctacaatttgttattcacacggtttcccaggtctcaggtttatcatctcttaggctcaccagaggtctgtatttggggaatacattcattcattcatgtctaataggcacttacatcttaaaatgtccaaaacagaactcttgattttctcccccaagcctatctctcctccaggcctcctcaacttcataaatagcactaccatccactcattgctcaaggaatcagttttaattcctatctctctgtatatataatgtatcagcaggtcctagaaatcctatatccaaaacagtttataaatccatttatctccgtccccactgctaccagcctactttgagccaccttcctgcactgcctggttctctgcaatgcagtagcctcctaaatctgctccctgcattttgcctttgtaatccagccttcagagagcagccttttcaaatgtaaatcagaatttgtcattccctgcttaaaaccctctctagcttctcagcattctcaaacttctaactcctcacctggcatcccaaggccctgcttccccttgaatttttttttctttctttttttttttttttgagacggagtctcgctctttcgcccaggccggagtgcagtggcgctatctcggctcactgcaagctccgcctcccaggttcacgccgttctcctgcctcagcctcccgagtagctgggactacaggcgcccaccaccacgcccggctaattttttgtatttttagtagagacgggctttcaccgtgttagccaggatggtcttgatctcctgacctcgtgatccacccgcctcggcctcccaaagtgctgggattacaggtgtgagccaccgtgcccggccttccccttcaattttaaggcctgcctctcccttggctcacttggccccagacacacgtggtcaccctccttgctatatctggaactggcaaaatgccttcctccttccagcctttgtattgtcatttcttctgcctgccaagttcttcccacagatatggctggctccttcttgtcctacaggtcgcaactcaggggccacattattggggaggacttcccaactacctgcccttctaaatcatatactgtttttttataactcatattactagctgcattctgttgaattgtatgactacttgcttgttgtttctcccattagagtataagccccttgaggacagggaccttgtgtgttgtttggtgctatattctctgcaactgcttgaatattattggcactctataactattcttccactcatttattctgcaactctggcagatgaaaagataaataagtatgcaaaacacagaggatttttagggcagcaaaactattcagtatgaccttataattaggtggatccatgtcattatacatttgtcaaacccgtataatgtacaacaccaagatcatccataatgtaaaccacccactttgagcgccaatggtgtgtcagtggtgcgggatgttggtggggaaggctatgaagtaagtagaggcaggaagtattatgggaactgtccatactttctgcttaattttactatgaacctacattttctcttaaaaaatagtctatttaaaaggaaaaaaattcattaatatatattaaaagtattaacccattagttttctcctattttgtattgtaataatttttattgacaagaagtttaataaaattttactgtttagaaaaaaaaagataaataagagaaagactctcttcccttcggggtttgatccatctcaggaattagccactgcctggtcttcctgagcaaatctttccaggacctcatctccctgtgctgtcactgtgggatggacgctcagctctctaacccagcacttgggctttgtgggagcctagttgatgtgtacaaaatgaattgaactgaattgggcatagcaccagacacggaccagatactaagtaggtacaatatttattcagtgattggaacttctagggagaattctgtctcagatttgtgtcatccgtccccatgtgaactctagtaccctaatcttcctgcatgtggattcttctggacctgccactggattccagagcagaccttcttactaccacctccactattgccccaattccctagcttcctcttctgcacactggtgattcccaaacaggcttgaggagagcaaggtaaggaggctctggtggtgaccaggcttcaggaatggcaacagtgcagctgctcctggtcccagaatggcatccattcctccacccctctgctagtgcccctcggagattggcatgttcatttaataagatgacttttaatggaaacaacctgaaagtcccagccaggtctaaaccaccagcatacgggccaggccaggtaagagataggagaacaagtcctccagaaactgtttaagagtttttgcaggccgcgggttcagcaaggggaagtggacttggcctccaaagcagcgaatgtggcctcaggctaagctaacagaggtggaaccttggggactatgtgtgcatcttggtgggcccttcatctctggacctcagccagctctgggtaccatacttctagagggatgatgatgactgagaatctgctgagggggccctggtaggcaatggggacaagctaccaggtcatacagagggaggaggtatcaccaggattgaagaaatcttggaggacaggagagcaacacctgaagggattcagatccgaaggtgctgtgtgcatgcccttgctgctccatctgccagggccacctttcttttggcagcaccaggctccacagcagacctgctggtccacagcctcactcttgtaccacatcacagggtgtgcttgcttctggacctctcccagcctgtttcctcatccacagagtgtgaccaaaatatcttcttcccagagctgttaaatgagatgggtgatacaaaagcccataacgccatatgtgatcatagtaggccctcaagagggttagtttctctttctgccccctctcgcaaggcagccaataagcccagaaagccagcagttctgagagaacacagaattcagaaagacagtctgtagggaggatttcagttgtttataaaacaggccaacatgtttccaccttgtaagttctaaatccgtcatcatagctccctagatctaagaatagtcacccactggagccaacgtgccacagcacgctctcactgcaggtgactgaggaaatgtgtccacagcagcctcagcagcctcctactcctggggctgggggtggggagggctggcctctgcctgtcccagcttggctgtttctgaaccgcacccaaatgcagttttctcttccatgcagtgttgatccaatacgtgcctcactgggctgctgtcagatgaggtgcctgcagtgatgccagggggtggttgagaggagcggggaggtaggccagtggggacctttgcatggcattgccccactgtgggcctcagtttcctcctatgtagagggaaagtgattgacagagagaactgggcaaccttttgagcaagggggttctagaagaggttccagagcagtcctagccttgcagcttagaacccatcaattcaacacacttatttatcacttgagccaaggcctttcttttgtctggtttgaaggagccagcctggggagcgtgtatctgcccactctcctcttctgtgtccaccttccttctctttcttacacacttccatatccacacacaccaccacacaaattctccaggattggaaggacttttggtttgtctcagcccagcctctgcccactgtgggactgtcctgggggctcaggacctgtggcagagcaccagctatgttccagagcagtcttccagtcattgcagcgttcttcctgatagcgagctacaattgccgtgcccatggctgctgctttccacatccatgggttcccttttggccctctaagagagaagaagcagctccattctctcactgccattcattcatttgtcctttcattcacacaacagcattgagcgctaacctatgccaagcactgtttcaggtactgggatatagcagcaaacaaaacagagtacctaactctcaaagagcttgtgttttgttaggagagagagatcataaaataaataaactgtaaaaaaaaaatgaagaaaaatagagcaggtgaagagataagacgggagtaggggtagactgctatttcatataaagttgtcagggaaggcctctcaaataaggtgggactctcacaaatacctgaacaacatgaaggaatgaacctgtggctgtcagggccaagagcattccagatagcaggaacaataagtgcaaaggtcctgaggcaagtactgtttgaggaacagtaagaaagtcagtgtcactatggtgatgttagcagagtggatcatgatagaacatgatgttagagaaggagctggagacccgctgttgtttattctgagtaacaggagaagccactgaaggattctaaacagtgcagtgccttgtctgacataggttttaacacaatcactcaagttgctgtgtggagaatagaacatacagggaaacagaggcagcagagagaccagttgggcagcccttgaggggtgatggcactggtgagaagtggccagatcctggctgtattttgcacattaccttccccaaaccctttttccacaggccctgcccttttcttacctggtggacagccacagcctccttgctggcctccttgcctccaaccctcaccccccatctactcctctcacctcattctcagggctgctgtggatcttggtgtgaaggggaccctaggcctgtctgttttcccacatacagccttctctgaagcaatgtgggccacaaacccgaaacatccccagagtaatcctgtgggtgaacagccccacttttgattctggagtagcttctttctgctgcctcagctcctgcctcgagggtatccttggccctggagagtgatggatggactaattcctgaaagggcctgttttagtccatgttttgctgctataacagaataccacagactgggtaatttataaagaaaagagatttatttagctcaataaatggttctggagactgggaagtccaagatcacagggccacatctggggaagaccttcttgctgcatcataacatggcaaaagggcaagcaaacattcaagaaagagagaaaaagagaccaaactcccacgataattaacccattcccacagtgacagcattcatccattcatgagggcagagccctcatgacctgattgcctcttaaaggtcccgcttctcaacactgttgcattggggattaagtttccaacacctgtacttttgggaacacattcaaaccatagcagggcccaacactgacagtgcctgtgtcctctgccaggcccaataggaccatcatcctcatagccattctcatggccattctctgcatggcctcctgggtcagtgtctcctaggtcatcctctcctctttgctacctctgtccctggaaatactattatttttaaaatcatctctgtgttactgctttttaaaatatttgaacgaaatgaaaatgagggtcacccttcccccatttctccctgtctttgtcagagactgttctcaatttgggatgtattcttttccatttgtacatataaaaatatataggggctttgcataactttatgttaaaaaaaagttttaatatgtaaggatcctagtctgaagggggccgtggctttttgaaatcatcttctactggtgaatgttcttgaagccccccagtcttttgcagttgcaaacagtgctacagtaaacaccactgtccatgccccttgtgtacacatgccatcatttcccataactgtcttttcccatggctgtcttcctcagtggatggggaccctgagggcacaaaatgaattttcctcttctctgggtcttgtgtgcagcacaagtcctaaaccagaaaaggcacccacatgatgaaataaatggactcaaggttgggcaagagcatggcaatgtgaacagcctgggtgaattcggggagccgacagcaagcctgtggggctggaacactgagttggggaacaggggtgatgagagacagactactcagggccttgggagccagctaaggggcctggacttggtctcataggtgctgtggagacaggaaattttccatgggaggacctagaccaggctgtgtttctgcctgatttctcccacccaggccagcagcctcagcataaaggatagggcaagggacgtgaggacctgatcccctttttccatcctgctgttgccatctagacccaaagcactttaggaggcccacttcagggattcctcactccccattccttgctcacagcaggaccctagggacagttctaccagttgctgccaaaaggatgggatccctatgagcttgggtggctaaacactcagaagtgtctcccaaacttaccctgctccaaggcccgccccatccttcctgacatgtaccagaatccagagccctcctctctatgagggcgctcaaacctcacccctcctctccgtcagcctggtagtgcagaagagcagtcctgactgttggtctaggcctatgcgtgctcttagacaggaggagacaacatggaccattcgctacctaatttcttgtgcctatctctccctcctcttcccactgcccagcagatgcagaagggggcagggcctcagccccagcgctcacagggctcagggagatttctgctcctctgcacagtatctttctctcgccagctggagttcttgccttccattacttcctgcgttcccataggtggactgttactctgtaccttttcttaattacctgggaagcaacgtttttgctagagagaacagtataatattaaatagaagagggcctggagccagactgtctgggttcgaatccagctctgcctcttgtttccttgcacagttcacgtcatctctctgcaaaatggggataatattagattgcacttcacaagtttgttgtgaggattcggtgaatgaatatttgcaaagtgcttatcacagggcctggcatataccaagtattcaatgattctgttaccattttcacatggtttggaactagtgaaggcgcctgagatttgggagtcctggattctagtcctgactagaatagctgtgtggctatagacaaattactttacctctctgagcctggttcttcatctgtaaaatggacgtagtagtacctccgagggttgccgtggaaattaaggtgacatttttatgaaactgagaagcaccatccctaggtcgcagccctcatgctcatggtcagaggtagtggctacaactccagctatcgcatccacattcccagtgacaggatgcaagagggacaaagaagaaggagcaaagagtgtatgccatctgtcttttaaggaaaagtcccataagcaattacagaacatttcagcttgaccctcactgatcacacctagctagctgcaagaaaggttgggaaatgtctttattctgtggttcaagagacaaccaggaggctctgcacacatgctcaggtgtttattcctccttggcaacgtcctccagcagaaatgctgccccctccctagcactgggctgcagtcccagcaccataaggccctatgaggacttagttgccaagaagctcgggcaggtgccacagacctgaacagatttgggtattgtgtccagcttgtgccagggaccctgccagtcctgaggttccgttgcctgcagggctcttaggctgacgcaagtgtggtgggctgtgagctccatcactcgtcacagcctagattgagccctgtgagcaggaggcctgaactccaagggcctagggaatccctctgtaaatatggggctctccacccaaggctcagccatgtgccccaggaccagcaaagcagatctccgtcaaccaggtgggattctggtgtcttcgaagacctgacaagtgccaagcacactgcagagagccctctgtaaagccagggatcgtcctctaacttacctgttttgaaaactggacgttccatgttccatgtcgcttagggagaggctttctgtaggccactctccttcctcttacttctgtgtgagaacagcctgcatagtagcatcttgctgagtctggagggccttgccagcttcattgtgcccctgaaaaggtggccctaagtgaggttagggggtgaatgaaacctattctaaaatgctggaggagcttattactgaaagatgtcctgctgcaagtccttctgttaaggggataaccaatcctttgcttttctgagttcagcatcctggctttttttttcctataggcttgtttaaagtgtttggaaaccccaaacttcctatcattctactttagaccttctcatctgctgctgcccctccatctcctctttgctgtttgccactggtgtggctttccttgccttttcctcctattcccatgatctgctttccacatgggtttgagctgtcactgtgtcaggcatggtgctggggcattgctcctcctcatggcaaccctatgaagtcagtggggacctacgtaccattatcacacagttgtgtggtaaggtgggaccaggacagcatagcgtagtccataggccatagtctataatatgtgtggagcaggggatggcaaactatgaccaaatttgacttgtagcctctttgtgtgtgatgctgcaagctaagaatggtttttaaagggttatcaaaaagaatacatgacagagacctaacatggccctcaaacctaaagtatttcctatctgccccttatagaataagcttgacaagccctgggatgtaacatgcagacttcagcacagattctggagccatcctgcctggattctagagcctctgttttattctctctaaaatgagaataatctgtaaattgtggctgcctcacatggttcttagaattaaatgagataaagtacacagagcacctaacccaaagtccagctttctttggaagtactgcggggggatattactgggcctttaccaggcttctcgacccagtgggcatgaaaatcctggctctagtcctttggctaccccggtcccaggcgtagcttcctcagagtgtgttccctttggctggaggagaggcacctgccagcttcccactgtgctgtgtcctgctggtaggtcagctctgccttcctcccacccccatccctgctgacggtcagctggtgccactcaccagggccgggcacaaagcccataccaggtgccgaactaggcgcaaaggtaccaagcctcttccactctccctacctcgtgcctcagctcaacctggctggaactcctgcttaactgtaggagatgtggcctggggttcatcctctctgtatgcgcttccgcatttgtgggccaaacaggcagacatctgtgtttccctaaacccaagcttttggccagtgattgccttcctactaagggaaagggaagggaagggtaatcccggggcccagccagctaccctcttgatagagtggtctgcaaaacaagttttcagtggataatgagttaaatgtaaagaagatttaaaaattcaaatccttgaactatcaaaaagaagtttttactgcgtagaaccatacacttatcaaaagactgaaaacaaaattttaagtcaaactgaggaaaaaaaagtaatgctaaatatagcagagaaagaactaatattcttaaaatcaaagtctttcaaacaacaaagctcttaataggtgacaacaacaataacaaacatttatgtagtactatgtgccaggcgccattctgagtcttttgcatatactatacttactcatttaacccttgtaaacaactctaataaggtattactgtccccattgaacagatgagagaactgagatatagaaatgctaagtaacttgcttgaagcggcacaactagtaagtggcgaagctgggatttgaacccagttcatctggctcttgggcctgagttctaaactcttctgtactaaccaggaaaaagatataagcagatagtacacaaaggaggaaatataaatatctgataaacattgtaattatttttctgtttcaatggtagtccaaaaagtacatattaaaacaagagataccatttttgtcttcaaattaggaagatctttcaacattataatactattaaaaacttgcagtcctagagtaagacagagattctcacagattgctgaagttatatgcaagtagcctttctgaaaagtattctggcagtactcaaaacagtactcaggcatttcaaaaatgcctatactctttgaccaggaattcccattctaagaatctaatttgagaaaataattagagagacagacaaagactcatgcataaagatgttcatagcaatgctatataaaataatgacaaattggaaacaacctatggatctgataatagaatgcaggttaagtaaattgtttaatcttcataataggtaattaggcagccattataagtaaatgtgtataacaaaagacaccataaaccaagtgaagagacacaccacagacttctggaagaagatacttccaaatgcacataacaacaaagaatcatagaaacaaaataatacacaaagaatacttgcaaatcaataaggaaaaggcaaacaaccaaagaacaaaacagagaatgtatatagacaattcacagaagaggcaacttaaacgggtaatcaacagaaagcgctactgctccatctcactagtagtcagggaaatgcaaactaattgaacgtactcatgagaatggcaagagtctaaaggtaagatctaaggaaacaaattcatatctattgttgatgagaatataaatgtctagtcattggagagatatttggccacacttactaaacataaacatgcttacatatacatgcatgactcatatactcccagggatcaccctgtacaaataccagtttgtacaaggagatatgttcaaagactttcattgcaatactgtctataatagcaaccatattagtattgttgttgcataatactatatattttccattgttatataataaaacagcaacaatgatattattaaataactagccatcagaagggacatgggtaagtgaaatatgatttatacataatgggatactatgcacagttaaaattaaaataactgaactagatctgtaactaccagctcagataaatttcgaaaacaatgatgagtgtaaagagcaacttgcagaaaaaaaaaaaaatatgtgaatgattctatttgtgtaagtctttaaaacaaactaaacagatcacaatatttaaggacacatctatgtagaaaaatatgaaaccatgcaaatgatgtgcaccaacttcaaatagtggttacttgtgggaaggagggttggatagagggacaagaatgggaggtggggcataaactgtatctttaagattttttttaagagaagggttgaagcaaatatggcaaaatgctagctaatgttcttaatctgggtggagatctgcgtctttctattaaattattttctgttctttaatgcatcttgagaagaaaattatttttaatttacttttttgtttgtttgtttttgagacaaagtctcgctctgtcacccggggtggagtgcaatggcacaatctcagctcactgcaacctctgcctcctaggttcaggtggttctcctgtctcagcctcctgagtagctgggattacaggcatgcaccaccatgtctggctaattttaatttactttttgaatactttacaatccatggagaaatatttgtgctacaatgttaaaaagcaggacaaacatatatacaaatatttataaatttcacaaattaaagggttgaaagagatatccaaaatattcctagtagtggcaagggcaagattctgcaagtttgcttttccttacacatccatattgtccattgtttcttttcttttcttttgtcatgaagatgtattatttttatgtccagaagattttttttaaacgaccacagaaaaacatgaatgagtttagacctaggacagtgtctaaaacctaggaagacgtgttatgatgggtggactgttggagttacctgggcatgaatgttggcttggccactttctggctgtatgaatttgttcatttttgtatctattcagtaaacacctgttgagcaccaactgtgtaccaggcactgtcctagagatacagcagtgaagaaagtatacacgcttcttccctcaccacagagtgcagtctagtgaagaggggacagtaaacacatcaccacacaaatcatccctcactacagagtgccagatcctcatgagggaagaatacaagggcagtcatgagaatctgatttggattgggtggtcagggaccctggcctctgagcgacaactggaatggaaaacatgaagaggtctggaagcccagtaaactgagggctttgagagataggaaggccctactggacatacttaaggaacagaaaacaagccagggttctgcatgcaaagagggagggcaagagttgtgcagggtgaggacaccaagatagttaggagccagatcactcaggcctcacaggccaagggaaggcctccttaaggaccatggaaaggcactgaagggttttaagcagcagagtgacacgtgattagatttgcagttgtcgaagattgtcttgatgctctttgaagatcagggtggatggagtgagcagctgggttagttagttggctattggcatggcccaggtaagagaaatggtggcctggatgaggctggagctggctgaggagatggaaaaatatggggaaagatttgagatgtttttggaggcagagtcagtaggtctggtgatggattatatgtggtggtgacagtagggaagggccgaggaggaaagccacgcttggaacatgagcagtcatgagttttgtgggaatgggaagcatgcctcaggggcaggagggcagctgccctcaggggaagggaaggaagtagggatggggaggatgccgccatgtgtccttaagctttggcgtcttcctgagtgaactggggtttatgatgatacctgtaccctcagggtgaatgtttcagccctattatccaaaacctcttctacagcagtcttccctctccttcacaggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaagccttcccagagaattgttttgttgggctgtggggttggccgaagaagggctcaggaggcagtgatggttaggctgaccacaaaccagaatgatggcaggctgcttgcctagtgcctggggctcaaggagacagacatgctttctactcagcagaggagaatgaggggttaggtcttcactaaagatatggaaagctaacacaccagtaggaagtctccagcctgtcgctgcctggtggagatagaaaacccagttctaggtccttcattattttggcccagcagccttcaattcagcaaaacaaagggttcctgggccatgcctagagcagcccctcctggggttttatttttaaggcccagagcacatggttttctagttcaaggatatcgaggtaccctgatcagatgactggatacttaaacaggaaagagctcttatcttggtgactgcgggtgagggagaaggttctggagtaggggtggaggggaatagagaggcgtatgtggaggaagagtcaagacttccgggaagacccagtagaggaaaaccctaggacagcaagagaggctagaaccgacgaaactctcagatttttcttcatctgagtcagccaaggcgctggagcttgtttgtgtgactatacttgctaaaatatactgtttcagatgagggacaggccacagcatgtgaaggggagtctgtagggatagcaacgtcaaagactctgacccctgaccgtctgcccctcaagccttagcctgtacaggaagagggccctcgggtaagatggagaccaggccagatccccattccctgacttccctgtggctctgggggacataggacctttctctctgctgtgactcgcagcaagccttttgccggaggacctcagagaatggactttttctggagaaccatgtggcagtatcaccagctaggcagcccaggtctgtgacccatcccacgctgcctccttgtgactcagaatgagtctgtgagggctgggctgcagtggcttcaagttacaaaatcccaggataccaaagctagaggcccttgaaagaccatccagcctagtggccgtcacgctgcatcctttagagccctgggagtctcctgagaactcagtggccaccttgtgggtcaaggaggccaggtagatagaggtccaggttcccccgacccccgccccccaacacatcttattccaagcagctttagtttttctctatattgggcttcacataacatttcgtttgacaagaggtccttgagaaagtttaaaaaccactgattttattcaacattttcatttgttcatgtgggaaaatggaggccaaaaggggggaagggaccatctcaaggtcataaacctcactaccaggccagggtcctgattgggaagtgacccagctaagtccttgagtgagacaagggtttgatggagagtagccctgggaccaggagtgagttcagctcaggagaggaggatgaggacaatcttgagcttcccaggcctgaacatagagaccactgacagccacaggctgaccttgaacatcgtgcatggagtcctctcaatattgtaccctagaaacatggctgccctggccagcaaatcccttggttccccacctctcaggaccaatagaggccagtacagtctccaagaacttgaggaatgggaagaaggatatctccatgcactcggagcttgacttgccaaggtgaccaaacaaaccacagagatggagcagtcagatggcccagaggtgatccatatgggagcaagcccaaggacactggcccaccacccactgtcctaaaggcctgtatcagacacacaggccagaaagcaatcccacaccggatagcactcaggcccgtactgcctgaacagttactactcacaaagaaccaacgcactctctctcacaaggttccagttcagagctccctcctacctctttcagcacctgctggaagaaacca

SEQ ID NO: 17128 - DNA, 9447 bp, Human; identical to SEQ ID NO: 12602

SEQ ID NO: 17129 - DNA, 5884 bp, Human
ccacggcctcgtggaataaacttctcccatttcacaccccccagtttgtgttgcatggttagcacagccctaggaaaccagcacggatagtgagctccccgtcacaggaggtatgcaagcagagggtgggtgggcaggggcactgtcgggaggagcagccctggggactccagcaatctgtctttgattcctcccagactgttaaccctggggcacagcctccttcacccccagaggcccacagcagacaagctgagagccacacagcggccaagaggaggtgctggagggcccaggggtcccagtgctgcctcagccccacccgacttgggagcttttgtgttcagagagactgaggttttcagcttagaggacacctccgtggaacacatctgcaccgcggcaggggaggaaaggctgggggcacacaagcaccctccctcccgccctcaccccgaagctgaggggaccagggcggacagattcccccacctctgatgtggccaggggccctggggactccaggacaaccctcctcaggatgacgtcaaacccccggcattcaaaccttcccaagttctggctgcagctgtccctttccggggaaacaaaggcacctccagcgcccccacccccagccagcctcaccgatcaaggaggccaaaggcagctcccggccccgcttacataaagcttcctgtgtgtgctggtcacacctcacacctcacgcctcacgcctcatgcctcactcacacctcacacctcactcctcacacctccaactcagactttttagcttgaacttttttctcaataaaaccacagaagcccaggccgggtgcagtgactcatgcctgtgatcccagcactttgcgaggccgaggtgggcagatcacgaggtcaggagatcgagaccatcctggctaacatggtgaaaccccgtctctactaaaaatacaaaaaaattagccaggtgtggtggcgggcgcctgtagtcccagctacccggcaggctgaggcaggagaatggcgtgaacccaggaagctgagcttgtagtgagccgagatcgcaccactgtactccccgcctgggcgacagagtcagactccgcctcaaaaaaacaacaaaaaaaaaaacaaaaaaaaacaacccagaaacccaacagagacctgaagacgtgcctgcctcccccatctccgggacctctcccacctgggtgaagggggcacgtgagcctcacctgatcttgaccatctcagctaaaacactgaaccacccttggcacccaccagcagcagacggagaagaactgtatagggtgcaaaagcgccccgccaccatcaggtccagatgaaaacctacaagttgaatcagcaaggtgctgacggatacgcaagcagaaaccctcttataggaggttcaaggctgggcgcagtggctcactcctgtaatcccagcactttgggaggccaaggcgagcagatcacttgaggtcaggagcctcagaccagcctggccgatatggcaaaaccctgtctgtactaaaaatacaaaaattagccaggcatggtggggggtgcctgtaatcccagctactcggaagcctgaggcaggagaatcgcttgaacctgggatgtggaggttgcagtgagctgggacagcaccatttccctccagctcgggtgacagcaagaccctgtctcaaaaaaaaaaaaaaagtttgagaatgtcagacaaggcagcaccctgtgtaggtgctcaggttgggcggagtctctctcgggggaggggggtaacaggacagcgcctcccggggcctccttgcatgtctgtgtcctgatgcacagcaggcgggggctgcggggaccagagaaggaagaagcgccccagctgggcacttcccgaggaggaagtggtgccggaatttcccccaggtgtggcctcaggtataagagcggctgctgccaggtgcatggccaggtgcacctgtgggattgccgccaggtgtgcaggccgctccaagcccagcctgccccgctgccgccaccatgacggtgagcctctccacatgccgctcggatggatgctgcttggatgtgcagcctggcatggaagggctggggttctctgagcctgggaggagggtgttgggatggggtctgggaaacccctcagtctgggggtaggggaggcagctgcagatcctcggagcgctggcatgctgggtgtcttgggctgaagggctagcctctctgggcttcagtttccccatctatagagggagggctgtactccatctttccgctgggaacaaggaaagctgaggtggaagtgaggtgccccctgccctgggcacctcctaaccacccacctgcctgtttcaccagctcctccccggcctcctgtttctgacctggctgcacacatgcctggcccaccatgacccctccctcagggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccggtgaggacctggggattccgctgtggcgtggggctgcccctcccctggcggggccctgactgcccggagagctctctgggccttggcggttctcacctgtcaagtgggcgtggccacctgagctccctccctccggccctcctgacctggacggctgagctgctgcttgcggctggccgtgccctgcctcccactgtcctaggtggccagggtcccctggggaaattctgggcccgtcacctgagctcctgcagaagtggggctgggtgatgaagtggaagggaggctcctagaggcctccggaccctgctctgtgctcttggagggccctggggagacgtggattaccaccacatgtgagcccgactgcaccccaagcccgtgtggctcagccctcgctgcctcaggtcctatcctgagtacacggagaggggccctgaggggagaggggcctccaggaggacagggtagggccagagactcactgtgcaccccgtcccgcagtgtggacacggatgaggaccgctatccacagaagctggccttcgccgagtgcctgtgcagaggctgtatcgatgcacggacgggccgcgagacagctgcgctcaactccgtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcagtgtgaccgccgaggccgtggggcccctagactggacacgtgtgctccccagagggcaccccctatttatgtgtatttattgttatttatatgcctcccccaacactacccttggggtctgggcattccccgtgtctggaggacagccccccactgttctcctcatctccagcctcagtagttgggggtagaaggagctcagcacctcttccagcccttaaagctgcagaaaaggtgtcacacggctgcctgtaccttggctccctgtcctgctcccggcttcccttaccctatcactggcctcaggcccccgcaggctgcctcttcccaacctccttggaagtacccctgtttcttaaacaattatttaagtgtacgtgtattattaaactgatgaacacatccccagaggccaacattcaatgcgacattctcccgttcagccctggtccaggccagccatggacccaattctggggtgtccttccagaaaggtctacgcagccgcgagcagtgcatgcaggtgggactgagctgtagcacgggggggtcacaggtgtccctgctctgcccacacagtgtctcccctgaggacacccctgggaacaggaaccagcctccttcctcaagcagtgccttgagccctatgctttgtaatgatgtgagcgcctaggggcaccctctcggcccccaaggcaagtctctgaggatgaactgcagggctgtcggctcaaggcagggcccccagccttcgtggttcggatcaacatccaaggccaagcgccctccctgatggtgaactagccacgcttcgggacccaggctctgttggagattttagttaaggggccccggggggagcagccccagtcgtggaaagggggcccaggcctgtgacagtctcagggtctcagtctctaggcccccggccccaagggctgacattgccatggggctgctgggcagttgttagcccctcccctgcctggccccctggctcacccacctactgcgtccaggtgcctggagatgggggtgggggtgctgcacagaagaacaaggactccactcagactcccaaagcaagaggcctcagggaagacttcctggaggtggtggcccttgtccaggagatggaattttcattcaacacatttattgagtttcttttctttcttgaaaaagggtctcgctctgttgcccaggctggagtgcagtgtggtatgacttcagctcactgccacccccaccttctgagttcaagcgatcctcccagctcagcttcccagtacaggcgtgcaccaccacacccaactcatatttgtatttttagtggaggcggggtttcgccatgttggccaggttggtctcgaactcctgagctcaagtgatcctcccacctcggcctcccagagtgctgggattacaggcgtgagccaccgcacccagccatatgagtttctactaagcacctggcactgggaacaggccgagaacaaaatggtgaaaacccttcctgcctccacggtgactaatgaaacaagtggtgtgtagtctgtgagtgagtccaggacagaggctctgggggaggggctgcagttcttttttttttttttgaggagtctcgctctggcccaggctggagtgcaatggtgcgatctcggctcactgcaagctccgcctcccgggttcacgccattctcctgcctcagcctcctgagtagctgggactacaggcgcccgccaccacgcccggctaattttttgtatttttagtagagacggggtttcaccgtgttagccaggatggtctcgatctcctgacctcatgatctgcccgcctcggcctcccaaagtgctgggattacaggcgtgagccaccgcgcccggccaaggggctgcagttctaagcagagggtcagggaggcctcgaagacctgaaggggaggaggaaggagccaggcagccatgcagggaacagctccaggcagcaggaagagcccatgcaaaggccctgagaagacacatgctgcgtgtgtccaagggtcagagagtggcctgcgtggctgatgccaggtgagagggggaccgcaggggcagggcagggcgctgggggtgcagatcatgtctgccctggggccatcagaagcttgtggctgtcactggaggtagctgagcctgtgggttctgagcctgcggattctgagccggaggcactggggtgaggctttgggtttcaatggcagcatcaggatggtttcaggggatgagggcagagcgggaggcggcaggtggcctgggtggggatggcccatgtagctggggtctggatttgggccaggattggatgtgggggtgtgggggtttcaagggtgacctgaagcttggtgacctggggggacggctgaga

SEQ ID NO: 17130 - DNA, 158735 bp, Human; identical to SEQ ID NO: 11989

SEQ ID NO: 17131 - DNA, 23394 bp, Human
  misc_feature (1)...(23394): n = A,T,C or G
ggtctatcaacatgacaatgtcaaaaatgggggaggggagagaggatatggtgtctatgctaatttacagagattaagaaacataacaaaggccgtggttgttcttaattgactgttattttgaacaaaacacctgaaaagaaaaggcatttttggggaaacaatctgagaaatttgaatatgaactgagcattaaattatattaaggaatgcccgggcgcggtggctcacgcctgtgatcctagcactttgggaggccgaggtgggtgcatcacgaggtcaggagatcgagaccatcttggctaacacggtgaaaccccgtctctactaaaaatacaaaaaattagccgggtgcagtggcaggcacctgtaatcccagctactcaggaggctgaggcaggagaatggcgtgaacctgggagggggagcttgcagtgagccaagatagtgccactgcagtctggcctgggcaaaagagcgcaagactccttctcaaaaaaataaaaaaaaaaatttaaaaaattatattaaggaattattgtaaatttttttaggtgtcataacagcacttaggttatgcaggaaaatgtccttatttcttggagatgcataatgaaatatttagaagagaaatgtcatgatgtctatcattcatgtttaaatactaaaaagaagcaaatattgtaaaacatcaataaccattaagtatggatgatgagtatgtaagtattcattatgcatttctgtcctttttaaattttattttattttactggaaagcaagagaggaaggagatcaaatctgaacttaagaagctcactcccctacttattggatgactagagtggaagcaaaagagcagttactagctgattgctgcagtggtcgtggtgaaagagcacagtgtttcagttcaggtagtgaggatggacagaagtggactgatgggagatgtattttgcagggagaaaccataaaatgattgatagcctcgaggtggcacagacggagagaaaggagagtcaaagctaatgatgaggccaggcccggtagctcacacctgtaatcccagcattttgggaggcgaaggccgttggatcacctgaggtcaagagttcaagaccatcctggccaacaaggtgaaatcccatctccaataaaaatgcaaaaattagccgggcaaggtgctgtgcgcctgtaattccagctactagggaggctgaggcaggagaatggcttgaacccagaaggtggacattgcagtgagccaagatcacgccagtatccagcctggccaacagagcaagactccatctcaataaaaaataaataaaagctaatgatgacagctaatatgtatggagcatgtagtatgcaccagtccagtcatccttctaagtgatccatattagtgtaacgaacaaaatcttcacaatcactgtgtgaggcgggtagtaactattaacacctccactttgcagatcaggaaacttggacgcagacaagttaaacaaggtgcccaaggtcatacccttagtagatgccctgctagaactggaatctaggcatgcctaaccattttttcttaaggaagagaacagtatcttcaatgacaatgagtaagagtacttattctacccacttttctgcttcttgtcttcgggtttatcgttctggacccacctatctttcctggccccccacttaacttaacccttttcacccaccctggggcggggagacagaggtgatcctagaagagggctacagggatggggccaagtgggaattctagcgaggcgcctactatttgatggaggagggatgggctaggtaggtcccccgctccgacagggctcttacgccatatgtgacgcaaattagcttacgagccgggggtggaggtgtcgtcagcacccgcctgcggttggccgcgttgcagcgagaggggcatgtagaccccgcctcgtagggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggtcaggaggaaacttgggctggcgggtggtggggggcggggagcagcttggggcctggagcgaaactcggtgggggtgagggtgaaatgtcatgaagctcggggagaatatgggttgggggaggcatgcgagatgaggaaggtgagagggcgtctcggaggaaaggggcgtaggcctggaggtggggctgggaatacgggggcgggacctaagagaattgggctctggggaaaattgcaggttcgggagaaggacacggggtgcatgtgggcagagggacttagagaccggctgcgagaccacaggagaagccacttgttccgaggcgcctgggaggtggtgacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccttcctctctggtaaccgcctccaaggccagcccttggcggcgccagactcagagcttcagcaccgcggacagcgccagcggttcgggacagcgcgaggagagatgcctaagagacaccctccccagccccacccatgccctctttcccccgaccgggggaagtgtgctagaacctcttctgagttccaggccattataggatgcttttccatatttgggaaggaaattcctctttcagaatttggccaaaacctctcctgcagtaattctatgaatctctctccctgcacctggaaggtttcttccctatcactcagttaagcaaacagaggcttttaaggatacagactcacaaattcttaaaatccaaaacaagatcccatgcttccttttaagaaattcaggcctgattcctactctcctcccagcttaaggccttctttagaatgaaagaataaattgcatctgcttctcccgttcccagcctgtccacccatctgcccattctctgtgagtgggtgtctgagcctctgctcaccttttcctctacaggctgtctatttgaccgcaggctctgctctcacctggaagtctgtattcagggtgagtgaggcccaagcatagaactcacaagatcggggggagaggggcaataaaaaacaagaaggggagagaaggcccagaaaggaagagggctactgggcttgagaagaaggaagacttgcctggaggaggagaggtaggggagaaagtgaagagagtacagtccatttgcaacctggactttggaaggcctcttattcaagccccctgctgacaccacttttgtgcccttagatggcttgtttgggcagtgccaggtgggagtggggcaggcccggccccttttgcaagtcacctccccagttctccaacgcttacaaggtgtgctccgacaactcatgtcccaaggtaaggtctgggtgcactggaggagagagattggaacttggttagttatgggtggggaagaagatttctcttcaaggaatattcctatcacccccactgctggagcctcaccttcccatatcttgctagagtaagaggtggaaccctagagatgggctattcacatttggactctctggagaagcccagaggagccttctaagaagaagtcactggaaaaggccagcttccatcttcttaggaccagttcctctcactggcattgtctgagtgctacagagccaagaactctggaatcctcagccaggataatattccactcacccaattcctcattcaacaagtatttattgagtacttactatgtagcaggcatagttttaggtatttggaatgtatcgggaataaaacaaagatctctgcttactggagtttctgtttgggggataaggggaggaaacacgctataaaagttagaaaatacatagtgtcttagaagatgataaatagcatataatattatagcaggataaagtgatcaaaatggtgaggtagaaagctacagtattaaatgaggaaatcaggtggttaaggtggacattattgagactatgaaatctgaacagactttttaaggaggtgggggagtttgtcagaagattatctaggggaagagtatttcaggcagaccaaacagttaggacaaaagcacaattctgaagagcaccatggaggccaggggactgtagaagactgatggagaggaagagtagaaggtgaggtcaggtaggtaatgggggaagggatgtggatcactttagggcctcataggggaatgtatggacattagctttactctgagtaaagaaggaaactattacaagatttggagcttgggggcacatgatctgacttacacttgacaagcatcacttttgctgctgtagtgagactagaatagatggagtcaagagttggtgagggggaccactaaaaaccaccacaataggttgctctgtctatggagtgccattcttttgtttcttcacttctctaataaactgctttcactttactaaaacaaacaaacaaaaactaccacaataactcagataagagatgaatgtggatggggccaaggtgattgcagggaaggaatgaaggatgagagaattctgcatttatttttaaggtagtcagcattatttcgtgaaatattggatatggttataaagagaggagtcaaagtttttttgggtttattttgtttgttgattgttgttgttgttgtttgagacagagtcttgctgtgtcacccaggctggagtgcagtgatgcaatctcttgctcactggaacctccacctcccaggttcaagtgattctcctgcctcagcctcccgagtagctgacattacatgtgcgcgccaccatgcctggctaatttttgtatttttaatagagacagggtttcaccatgttgtccaggctggtcttgagctcctaacctcaagtgatccatctgcctgggcctcccaaagtactgggattacaggtgtgagcaaccgcgctcagccaggagtcaaaggttttatttactgaataactgaatcagtggagatgtcactaattataatgtggaaacttgcaaatggttcaacttggtgggggtgttcagctttgaatatgttgagtttaagatgtctactcaagtgaagcaggaagttgagtacatgagactggattctgagagacagagttctcacctggagatataaatttggaattcttggcatatagatggtaattacacnnnnnnnnnnnnnnnnnnnnacacccatgaggtggatgagataaccaaaagattgagtgtctattaagaagaccaaggatcaagtcctagataattcttctattaaaaggaccaggccaggtatagtggctcacacctataatcccaatactttaggaggctggggcaggcaggtcacgagctcaggagttcgagaccagcctgaccaacatggtgaaaccttgtctctacaaaaaatacaaaaattagccaggcatggtggcgagcacctgtaatcccagctactcaggaggctgaggcaggagaatcacttgaacctgagaggcagaggttgtggtgagccgagatcgcaccactgcactccagcctgggtgatagagcgagactccatctcaaaaaaaaaaaaaaatgaggaccaggataaagagaggaaccatcaacttcctctcagggagactgagaaggggaagccagtggagtaggattaaaaacaacagtgttcagtgtcccagaagccaggagaaagtgtatcaaggaggaggagtgaccaacagtgtcaaatgatgattacgggataagtaaaataagatatgaaaattgaccactagatttggacatgcagacaaagctgctcttgatgagagcagctttggtagaatagttgggaataaaatcctgaataaagtggattaagagggaatagaaagaaaggaattggatacagtcagtatagacaactttttctagaagtcttgctgcaaagatatggagtgatccctagagaagaaagtgggatcaagcagtatttttcttaagatggaagaaattgcatattgtttgcatgggaataatgtgaataattcagtagagaacaaaggaaattatgtaggaaagaagagagaattgcaaggagaatgttcctgaataggtgagaggggatgaaatctagtgctcagaggaactggctttaaataggaacacagacagctcatctaatgtgaataagcaaggaggcaggtgtggatgttggtagataccagaatacaagttaagagcagcacagattttaaatccagaactagagaagaaaaaatgagggtgaaaagtgggaaattattcctttagaataagtgactgaactttcctgagagcagagtttttttgggggaaagagtcaaacaggagagctgtctatgaataagatgatgatgataatggtgatgatgatgatgatgacgacaatgaagatgatgatacatgtttaaaacatgtggattatgctttagagttttctaagcactttgatttccctgatcacacttgatcttcacaacagccccctgaaatatgtatcgtttccactttacaaacagagaaagttgaggttcagggtcaacacaaagaataataacaatagtaataataattatggtaatagcatttgttaaaagttcactacatgacaggcactattctaaccgtttgatatgtatatgtgttattttaatgataataacaatcctaggaggtataaatccccattttattgatgagggaattgaggcttggagaggttcagcaacttgcccaaggttacataattcatcagtagcaaaggcaggattcaaacccaggtggtctggctccaatagctgtacctgagggtgggaagaagacagctcagatcacccactgagtttgtccctctactctgacaaaccccatgagctgcagggcagagggtacagttctgatccccaatggtccccgttactggatccccagactcctgaaccaacttacgctgtcctctttcctgacaggattgtcctggcacgatgacctcacccagtatgtgatctctcaggagatggagcgcatccccaggcttcgccccccagagccccgtccaagggacaggtaggcagcctttctctacaactctagcaatggtgaggctgatgaatctgtggttgtcctaattgatggagagaaggggaaggaagtgggcaccaaggccagcatgctggggcacaggtaaagaggtgcaggaatggtcactctctgacatgctcacatgaccaagaggagctgagctcatctctagggatccagaaaaacgggcattttttgaatgttttgaaaaacattgacattggctactttaaaagaagcatcaatgtagtcatcatgggagaaattagaatgctgttggactgaagttgttcaatattccatttcattactatgtgaatttctatatgacaggagccaccatcatctttttgtggttagggcctctaaaggcatcattcagactgcaaagcagaggaaagtaaatgaggtttagggagctcagatgatgataccaggatgaagatggcatagtggtggggggtggaggagcagtcctgaatatttggacatatacttggagagccaggtgtggggacatggcacacaggggcaacggggacagctgcagccacagttcatctagagaaattcctggttgccttcccctgctcctgtttgccccttctccatccccagcctcatgattacccagcctttgcagttgtttcagagactcagccatgctcaccagggaggcagatacctctgccctcagcttggccctctggtccctccccattcccacccagcccatctctcttcccctgaggtcactcagtttctaaagaggtcaggcctgctcttaaccgctgagcctgcctggccccgaatagttctgccttgcaggctctctatgccctttcccccgctccaacacacacactttgctttcctctacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccaggtaagtccttgactctggtcccaccccaaccgcagtccctcagcccggacttctgctcttacccagatctctggttttccacagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccaggtaacaaggtcctcagcatccacctccctgtgagggctgctttgggggaaccatggtggggcccttccctgacaatctatgcgtttgttaacttgtccttaaagtcattcatacatttaaggaatgtctactgacaagctgttctatgccaggcactagggaagtggtggggagtggagttgacgtgactctccttccagtggagagtcaagatgtcctgaagtttgatctgggtcccaggaagaactttcccccaaagtgtggacaagggctgggaaagggagggcatctcttggtgtcctggtgtctgggaagactctcttaacatgctagtcccttcccaccctcactcactcatctgcatccctcaagttcactgcgcaatcagccctaagctctgtgtctggctcccagcagatgcggctctgcagaggctggccgctgtgctggcgggctatggggtagagctgcgtcagctgacccctgagcagctctccacactcctgaccctgctgcagctactgcccaagggtgcaggaagaaatccgggtaagtgtccaggcagagggagggaccaatatctcccggctccatggaggcctcttgccctgcctcgagaccacttggagtagcctggagaggaagagtcaggcttcaggggaaagagttcctttgagacatagggtcattgccagcaaggcagggagcaagggggtagggtggcaagcttaggagttagatcaggaaaagactagatggtggaagtaatggaaaaagcagccaacagagggtgtgagcagggaaaaggaggcatcgggaaggatgggttggtgacaatgagggcctaaaaacgggcatagccagtactaagaagaagccagtaattgatgggtagagaaataactgaacaaagaatagctttgagagagatggccaatggtagagggaggagttaataaaacagtaaattgggaggaggaagcaaaaaggaatgaggccaggcttaggatgagaccagtaacagggtcttggtcactgactgagatgaagaccacagcaaatgttccaggctcagggtctctggccctttctcccacttgtgttgtgtagaccttggccatggccatttttccagactcttgtttttcctgtctcgcaggaggggttgtaaatgttggagctgatatcaagaaagtgagtccccagcacctccttgactcataatcaccccatggcagcacgcccccttgccaaacctaaatttcaaattcaggacctagaatctgtatcctcccacccctcattttgggggaaaccaaggcccagagaccgcaagttattgcctaaggtctcccatcaagttgatggcagaactggagccagaaaactgaattcttaattcattcctcttttcactacaatcatttcagaccatgctctgaggattcctaggggaggagggaagtttcgagcagagagcccttcctgagcttctgtagcaggaggagctctgcttctttctgtttcatgtgttggatttctaagactttgtggctaaacaaaagtctagaaaccatcgcctgcctgtttgtcttttaccctcaccccagcttctcttgctgcaggggttttctgtctccagccccattctgtggattagtacagaccattttcaatcattcaatcctttattcattcatgcatccacttacttgtctcagatgctctggtgtcctctctgtacccagcactgcagtggtccctgggggtagaaagtgaaaagcaggtcctgagctccactgtggagagctccgagtccagggtaccccttcccccagcactgtccagaggccacacctccaccctcttctgaacagacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagtaagggctgcatcctgggaagctttctggtctgctaggatttgggctggcctgcctggccagaagcagagggcagaaatccagacgtgcagggacagggaattggcaggctgctctgtacccctggagtggcctgttttaagaaagtgactgagagggttgccccactttccttcctctgccttctcccatctccaggcccctgagcctggctgcaggagtgaagctgctggagatcctggctgagcatgtgcacatgtcctcaggcagcttcatcaacatcaggtggggctggcatcttgctagggcagtggccgagatctagaaagcagcttgagcaaggaggtggctggaggggcctgcgggaggaagagcagacaagctctgagctcagggatgctcccagctgtactgaaggtacagccacacccagcccgttgctggccccacccagcatcttccttgcctaagatgcccctgtagggcatccccgatctgctccagccccatcctctaacggggagagggccagagctggcctcttttttgaagtctgcggtctggggtggagaaggcagtaacatagctcctatctggcagtgtggtgggaccagccctcaccttccgcatccggcacaatgagcagaacctgtctttggctgatgtgacccaacaagcaggtaaatatctctgcgacctcaatcccaggcttggccccagccccactcctaagaggatatatccaggcctgttgctgatgcccccttgaaatgttcccagcccacatgggccctgcctgctgcttggcagagcaagacagaggatggagaccacatggggctggagcaagcctgacctttgtcctccctgcagggctggtgaagtctgaactggaagcacagacagggctccaaatcttgcagacaggagtgggacaggtatgcgctaactggagaatcagtccaagtccccagagggctgatgttgtccgcaagagctggaggcaaaccagaggggagaactggagccgaaacgtgtccgtaggcacggctggctggaggcggccttcgcccaagcagcccctccccgcagttctctttctcaccagcagatggcgtaggtgtcccctccctgcaggaccagccctctgtagtaaaaaggcctgagaactagttgagccgcccttagtctgctggagcacagtctccaaattccaagggaacaccttgcacagaaaggacattatactcaaaatatgttttgtttgtttgtctgagacagagtttcactcttgctgtccaggctggagtgcagtggctcgatctcggctcactgcaacctccacctgccaggttcaagcgattctcctgcctcagcctcccaagtagctgggattacaggtgcctgccaccacacccggctaaatttttttttgtatttttagtagagatggggtttcaccatgttggccaggctggtctcgaactcccgatctcaggtgatccgccaacctttggccccccaaagtgctgagattacaggtgtgagccaccacgcccggcctatactcaaaatacctttgtcttctgcatccaacactgatgcctcacgttctacaattcaattcctagggttctctgtccgtttttaaatgcaaacactcctggtgggggcctctggcactgcactgtggttgagttgatccgatggggattgagaaggagaatctgagcccatctggctgtaccaccatacccctaatctcccagctttgccccaggagatgtcctaacagggggtgtggcatgggaccggggtgaggagcagctctgaaacctccctatgccactgcctcccttgattctagccttgttcccacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggtgtgcagccccagaagctgattgagcaaaggaaatgcaaggggcctgggagtctgggtcttgcgtggactaagggtcggaactgaatggggagtgagccctcatccctgggaaggtccagtggaggctggagaagccccagtgggagggagtatggtaggggcctttatgaacgcatgggaattgggagcatacagtgcctaaggttcttcttggtgctgtgcttctggggctctgggattccactctgtcatgtctgaggttgacataagcaccacccaagcaaaacagccctggaaaggatcagggccaggcagaagaccataccccagaggagctgagttccactgaaaatcagtcaagggcaagcctaggagcccagagttgaacccagggccctgttgaaaagtttcaggggactcttggacctcacctgattcttcctccacaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggtcaggacagggcctgggcccagagtgggtgaaggaatgggatggtgagagaggccaggctggctgtgtgggccagagccagaccgtggtgcccccacaggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctgtgagtgaaccctgctggcccacctggcccagccctctctctgctgcgaggtctggagggcttggggtaaggggttgggcttctggctcaggctgagtggcagaggtcccgcgatgccaatgaccagagggccatctggggtggggtgtcgggtctgtgcagatgaccatgcccgcataaaactgaaggtggagagcagcccttctcggagcgattacatcaacgccagccccattgtgagtggccctgactccagcccccacctctgccccatcattatcctggccctatgcactccatttccccgtggtcacctgccaccccaccaaccccctggagtggtggggcctgatatcctagcaagggggaactgccagccttctcagaccctgacccacttgctctgaccacgcctgtccatagtggcatttcccacactggctcatggtgtatcttccctgcctccagattgagcatgaccctcggatgccagcctacatagccacgcagggcccgctgtcccataccatcgcagacttctggcaggtgggctcttaaagggagggcttcgctggggtccttgtggccacgaggtcccagggaggttagagtggagctcaactgggtctctgtccctagatggtgtgggagagcggctgcaccgtcatcgtcatgctgaccccgctggtggaggatggtgtcaagcagtgtgaccgctactggccagatgagggtgcctccctctaccacgtatatgaggtcagcagggccccacagcaaggggacaatggatgtgggaagagtagatgatggccttttcgtaacgttttcttcaccaaatgagcactcaacagtctttttaaaaaggcttttattggccctgctcatgattcatacatatatgaatatatataaacacatatatgcatacccatatattcacatatatacatgtgtgtgtcctgtttacagaacatacatgtgtgtgtgtgtgtgtgtgtgtgtgtgtcctgtctagagtcaaaaagcgttcatagagacttatgataaaggcacagagatcaaactataaaaccaccaaaaccgaggtaagaagctaacagctaagtgtatattagacagggaagataaggatacccaaagactgagattaagacctacgttaattgaacctaatttagctctgagtttcctggtggccaaagcaaagaaagacataccacccgttacatacgttactaatgtaaaagagaaacaaactttttcattaggagagagactaggtggaggggtggagaaggagggggaactgggcagaggccaagcaggggaaagagaaatatttcagacaaatgggagaacgtgagtccccactaagacaaaaaaaccttaagaacacagcagaagcttctcatcaccagatgagcctgaatagtaattttttccccaccaaataagcacatgacggtttttttaaaaagcctttcattggtcctgctggtggttaacgaaaaaaatccagtaagaatactacagaatttcatccaagtttatggcacgtgtagcaccgatactctggtagaccctgcgaggaagagggaggagaaactccgacctcgagaggctcacgatagctgtgtctgggtggaaaagctactagtggtcctgagcagtagataagtgacaggcagccagggttcctgggaccgctggaacttagaatttgaaccggcctgggaggccgggcggtggttggagagaccgagaaggtcgcgaggagagcgcgcgcaacgcggggactggggcagcccgcggcgctcaggcctgggcccctgccgggcaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggtgagcgcgggcgcccccgcctggagggaccgcatgggcgggggcggagccggggtccgcccgccgctcggcctggagccccgggtcgggcctggagcctcggcctctgacttctggccgcccgctccagaccccacgctcccacccctaaaagcaggcctgaggctccggctgtgcccttccccgagcctccaccacccgcgtgggccagctccgcgccggccgctgctgctctgctccctccctctcacgctcccgggactggctccttctcctccacctgcttcctccagagggccctctgctttctgtctcccctccctctccaggacccctgcttcctttctccttccagttccctcctgccccgctgtctccaggccctgcactgcgctgccttgctgccccctccgtctctcactcccgcctgcccgtctcccctccttcatccctctccgtccctccttcatccctctccgtctcttcgcctcttttttctgtgtctttcattctttttcctttcctctttcttcctcttctctctccccatctctctctcactctgtctctgcctcaccctttccctctctctccatttctccctctccgcgcttctcttcctttctctctgccctctcccctgtttttctccacctccttcccctgtctgccagtttctctctgctgctctgtccgtctctccctctccctcccgctgcctgtctttcctctctctgtccttccctctcccttcttccctctttctctctctccctcacagctgccagtgtcatttttgtgatctgcagctagtattctcactccagttgcatagtcacaaaagtgatcattggcaggtgtggctgctgcatggacagacaggacatgtggcccggggaccaccccgagctgggagcaaggggtacagggaagaggcaaagactgtcgaaaggagtgtgggaggatctctggattctggggggctcagtggagcaggtggggactagacaggggctacctgagggacttacccttttccaacactgacaccaagacaggtcagccctccagcgtcccctgcttttcctagccccagacaggtacttgggaagcccactaccaagggcaggggcccacccacactgcgcccttctcctggttctctgtcccttgccaagctggcctgatgtctctaggtactggacagaggagcagagctgggggtggggacatgggtatagtttctgaacctcaggacagcagtttctaactggggtccctgaggcctgagacacaggcgtcttgaaagcagtgccagggtatcagagctatttccttttttccatatttaaaaaatcctggtagaactagtgcatggatctgttttaaagctgcacagataagctaaaagattgctttaggctggaattatgtaaactcagttggcattagacatccagaacaaataaactgttgcttaagaaatgcagttcggggccgggcgcggtggttcacacctgtaatcccagcactttgggaggccgaggtgggtggatcacttgagatcaggagttcaagaccagactggccaacatggtcaaaccctgttctgccaaaaatacaaaaattagccaggcagggtggcgagcgcctgtactcccagctactcgggaggctgaggcaggagaatctcttaaacctgggaggcagcagttgcagtgagacgagaccgtgccactgtactgccacttgggcaacagagccagactccctctcaaaataaataaataaataaataaataaatgcagtttggtcaagcccccctagaaggaaaacaaattaataaaagagaccctaagaaagtgaccctgagtaagttccttggcttccctccattccgctacctgtgagatggggatgattacacatactttagagcagaggttcccaacctttttggcacaagggaccggttttgtggaagacaatttttccacggctgggagagggggtggtttgaggatgaaactgttccccctcagatcatcaggcattagattctcataaggagctcacaacctagatccctcacatgtgcaggtcacgatagggttcgcacttctgtgagaatctattgcaatggctgatctaacaggaggcggagctcaggtggtaatgttcgcttgcctcctgctatgcggctcggttcccaacaggccatagactgacactggtccatggcccagggattggggacccctgctttagagggctgttgcaagatttgataaagtatgtaaaatctagtgtaagtgcctgatacatagcaagggctccgttaattctagatgctgcctattatcattattaaatgagcaaaaacaactattgtgattactcttctaccctagccctctgacgtaacagccaatgagctagaaaaccatgtggactcctatgaagccattctaagtcacctggtcctatagctgaaggactgtgaagttccaaacttcaatctgacaacccctaagaaggtcttccctggttctggcttgcagggatatcaggagtatgcaggtgactcccaaagcagaaaggtcataaaggacaagggcaggttagatgggtccattgagagacggagaagccccctgctcctcactgagttgtggtcaggggcagtggagaaaggtctgaggtccaaggggaccccaagtctgaatataacgcagccacagaatgcctgtgctgaagtgagactgctccagggagacaagcagtagcacaatgtcccgagttgaggggttggggttgtcctcccctggcccagggaacactatgcccagggcagcctgatgtcacaactggtaaggaccactggagcctgagtcgggaggaaaacagcctgggtggtcataaagaatggcagagggccagagcagggatgtggcaagactgacacccttgaagtcaccagaaagctatccccttggacttgggcagaagtgtctcttaatatgatgatgtattatcattaatagttgccacctgctaccatgtattgagcacctattgtgtgccagacctagcacttagctctttacatgggttatctcatgtgatcattgtaagaaccctaaggaggtttttcttactatcctccattttacaggtaagaaaactgaggctcaaagaggttaaatcagttgttccaggtgcatagcttgggcacctagcttgcaagtgacaaggcgagcccaatgccacccacaccagctctggttctttgcctccagccctggctcctttctccaaccatcttccctctctgccccgggcaggtggggagaaaaggaagaaagagaggcccacgtcatgtgtttcagcttccctttccctctctgctggtgcccactggccctcacacccatttcttgttgcaggaaggtgaacaagtgctaccggggccgctcctgccccatcatcgtgcactgcaggtgggtggagaggagattcatctctctggtcccactccctgtgtgcgtctcctgtgcacattgcctgcctgtccccttggtgctagcaaactgcaggcatagtccaaatccagcacaccacctgtttttaatggccaagacctaagcgtggcattcacagttttaaatgggtgaagaaaaaagaagaaaagtatgtgatacaaactgtatgtggcccacaaagttgaaaatattgaccattggccccctatacacaaaaagctggctgaaggctagagaggcccatccaattccctcctgctgcctctgcttctgggctgagccatggctctcctctttggttgtcccattgcccaaatgacacccacaggtcacagactcccctctcaaggcccaagtcccagcgtgcaggtgctatgagctttccttcatcctcggctcactgtccctctccaagccaaccccaacgggtcacccagtgtcctcccctcccccaggcctccaggcctcctcgcctcctccgtccctccccctttctgctgcatctcaagctaaacctgtcactaactcctgtttcagtgatggtgcggggaggaccggcacctacatcctcatcgacatggtcctgaaccgcatggcaaaaggtagggagcttccccacggtgcccgcagcccccaggccctttttagaggctccccagcacacagggtcctgggagctcagaaggagcaggttgtcaacctccaggctctgcccagccctccaaggctctttgcctccaggaggcctcaggttttctgggtcctgtcctcctctggacaccccctgagcagccccatccccacctccatctccaggagtgaaggagattgacatcgctgccaccctggagcatgtccgtgaccagcggcctggccttgtccgctctaaggtgaccatgccttcctgccccaaccccagctcccacccttccctagcacccacttcttggccaccccagggaaagcagcagctgccaacctttcccacctgcttctgcgcctcctccaggagggctcccttcctcccaggggacctgcccagggccctccccccaccaaaagccccccatcttgagggcagagcacaggtcagccctctccatgaccatcctaccactgcccttcctcaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaacccagactcctacgcatttctgtccgctgtgcatctggactccagccccagcctcagcccggagccggtccctgctggtctctcaggaggtgcagagagcacagcaggagagcgccagctgccagtaaggcccttctaggtgggaacactacgttagaacgaggcttcctatgcagccagcagtctccaaggtgctttacatgatgagtcccattttacagatggaaagactgaggcacagaacttgcttgtggtaacacgtaacacaacttgtaagattgtaaggtgcaatggctcatgcctgtaatcccagctctttgggaggctgaggcaggcagatcacctgatgtcaggagttggagaccagcctggccaacatggagaaatcccgtctttactaaaaatacaaaattagccggccatggtggctcgcgcctgtaatcccagcactttgggtggctgaggcaggcatatcacctgaggtcaggagttcgagaccagcctggccaacatggcaaaaccctgtctctactaaaaatacaaaaaaattagccatgtgtagtggcgggtacctgtaatcccagctacttgggagtctgaggcaggagaatcacttgaacccggaaggtggagtttgcagtgagccgagagtgtgccgctgcactccagcctgggtgacagagtgagaccctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaccaccaagcccggctaattttttatatttttagtagagacggggtttcgccatgttgcccaggctggtctggactcctgagcttcagacaatctgcccgccttggcctcccaaagtgctgggattacaggcgtgagccaccgcgcctagcctcctctcagttcttggcagctgctttgtgcccttctgctgccagattgaggtgaggcctgaacaaagtgatattagcaaagtgtctgccacaccttaggcaaaactatagcaaaactctgccagtgagtctaggctaggcctgtgagatgctaggacaggcgttcccctggggataaaggacactttctgtctcaccc

SEQ ID NO: 17132 - DNA, 37335 bp, Human
gaatatactacaggtatttcacttttggtagagaaatttgggcttggatggagagaactgattttttttaaggaagtttaggacttgaatggcatttttatttgagtcttctttagtggggctgtatacaaagatgttatttacatactggagtgtggctctcctttttagctctggctttcttaacttttgtgtcaaggcatttttgaacaagcaagggctatccctaaagtcatgaggcagtattgtcctggtgtaccattgggtaatagtagtttcaggattagtctacttgaaaggaaataagttctgagagtcgaagtgcaaaggaatacaaaagaaagcattcttatgatctaacactgtgaactaattggtgttttctggtatttggttaagtatagtataaggatttggcactataggatgtaagagaattatgacctcgttaatggctcctaagtcttgaactagatcatatatatatatatatatatataattttttttttttgagatggagtctcactctgttgtccaggttggagtgcatggcacaatctcagctcactgcaatctccgcctcccgggttcaagcgattctcctgcctcagtctccccaagtagctgggatcacgtgtgccaccacgtttttaaagcatggcctcctgtccttcctgtccaaaaaccaaatgaaaaatatggtctaggttgggtgctgtggctcacacctgtaattccagcactttgggaggccgaggtaggtagatcatctgaggtcaggagtttgagaccagcctggccaacatggcaaaaccctatctctactaaaaatacaaaaattagccgggcgtggtggcgggcacctctaattccagctactctggaggctgagaccggagaattgcttgaaccgggaggcggaggttgcagcgagccaggattgcaccactgcactccagcctggacgacagggtgagactctggggagtggggaggagagaattaacaaactatatgacacaaaggaacaaaaatacacaagacaggataagagagaggaaggatacagggagagctaacatacatatagcagtttgaagtcccgggaaaggagaaaaaaatggggaggagcaatatttgaacagataatatctgagaaactccccagactgatcaaagacatccagtcacagagtcaagaaactaggagtcctagaataaataagtagaaagccacacctagcaactcagctgtcagcctaattgaacttaatatgccctttcttctctggctgcctgtaaatcaccaatttttcaaatgctgttagaaccagctgtaccatcctgctgggtccttcattcctggcttgaatgtgatctttgaccctgtatttattttatacttgcgtgagttatgtttttaaactttttgacaactatactttgaatatacatgaaacataggattcataagacaatactttttttttcttcttgctgtacgttttccgtactatgttactctttccattttattaaaaataattctggccatcatctacgaaatctggtctcaacctgcagtttgaaatatcctgccttggcagacgcggcagggaggtgcgtggagggagaattgaattaaaaaaaaaaacaacaaaacacgaatatttagatttctttgttcagcggcccccctccagggatcagatgactggcccccctcgctccgaactgactccgggatcaatccggaaggccattgggagaagccgagggcagcttagccacggccggttcccgttccctccaggacgcgagggtcgccttgggtggggaacccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtaacccgcgggggcatcgcgtcctggggatgggagtgggcaccggaacagagaggctagaggtgagaagacgttggacagaaagtgaaggctgcaggaactcagctggggacccactgaggctatggtcataaactggaaatcagtagggagaatgggcaaagtgcagacagagccctttgagctgagataaacaggacgaggaagggcttaaatcaggacggcaccagtaagggggggatctggacgccggacttacagtgagcagaggttgaggagggagctgtcttgggaagagagtggcagaggcaaatgtgtaagctaacggatattatggaatcactaattctgggctgatattggctaccacagacttcttccaaacgaaataacttcaggaggattatagaaacctcttggttatttgcaaggtaaatttcctcttaggggaaaacacaatgctgcatctcagatcgtggaagcaaactcacagacagtaaggaaaaggtactttttgttattaagaaatcagtctgaggccgggtgcagtggctcacacctgtaatctcagcaccttgggaggctgaggtgggcagattacctgaagtcaggagtttgagaccagcctggccaacatggtgaaaccccatctctactaaaaatacaaacattagccgggcatggtggcacatgcctgtaatcccagctactagggaggctgaggtaggagaatcgcttgaaccagggaggtagaggttgtggtgagccaagattacgccattgcactccagtctgggcaacaagagcgaaactctgtctcaaaaaaaaaaaaaaaaaaagaaaaaaagaaaaaagaaatcagcctgtagtctgtgttcaggttagtggtgttgggggagaaaaccaatgtctaataagaaagttttatacagcagaacacagaaatgaggcagggatgaacagctcactgctcactgacagagaccggaaaacccaacactgaccaatgttggagaggatttagggaatgaaccaaaggggttcatacaggatctatcttcctaatgactatcaacaaatatgaatgcacctaccatgttctaggcatggttccaagtactgggattcagtgagatgaggcttctgccctcatggggcttaaatgctcctctgaagaagatggaggacaaagagataaagcaacaaaaagttaacttcacagagagaactctgggggagaagctgttctaaggttggggaagagggagggggcttcgattcggggtgcctccacaaggacacttggttgtcagggactgataggagtaggctggtcctgggctggggtagccaaccatctgctggtcatgtgtctgtgctgggaaggagtcaaaagtaaggaggagctgtggggactggggacaggactggcctttgaggacagccttgaagatcaagataagggccctggttcctctgaggggccatggtgagctcttgagcaagcatggggtgaagacggcctgcatggaacactgtccaggctgtggtgtgtgtagtaggagaggtgcagagggtctaaggtgatgaaggctcaggcgtggcaggatccaggatggagaggcagatctgagccacactccagagaaaactggaatggaggttgaggatgagggagaagatgactctgagggcaacgaagggcaaaactgactacaaccagggctgcatcctctgccctgtcctggtggctgctgtctctcctgcaatcttccctgttgggctcatgtttgtgagacttggggatgtgaaaataaataattcaaaacctaagctgttggaactttaaaatattttgagccttaagggaatgtgattatgtgattatggcactcaagtcacataagcaggctgctgtaacctttgtttctctgattttagattaactttctttacctctgttgttttgaaaatgttgtaaatgtctacaggaggccaaggaagatgccttccctcttcactgttgaacttcattatagattaacttccttttacctttctcacgcaaagatttcatgcctatcgcattgctttaagaagaaatgttaactatactattttaaattggaaaggaaatgaaaatgagacacatggaaaagaaaacaagtgataactaattaaattgtaacttataaaccagccttgtgtagaaaatgttataaccctatgaaactttgtttcctgtctatataagcaaggacttaacttttaactttggagcactgatcccatttttctggagtgtgtgcttcccaaatggctattcccagcttttcacttgaataaaatgtttaaaactggattctgattcttttgagtatttcaggttgacagggggcaggtcacaaaatactgagagatggttttgaaatcacttcttgtgaacccagatcctttaagccagtggtccccagtctttttggcaccagttttgtggaagacaatttttccatggactggggtggtggggatggttttgggatgattcaagtgcattacatttattgtgtattttatttctattattgttatattgtaatatataatgaaataattatgcaactcaccataatgtggaatcagtgggagccctgagcttgttttcctgcaaccagactgtcccatctgggggtgatgggagacagtgacagatcaggcattagattctcttaaggagtgtgcaacctagatccctcacatatgcagttcacaatagggtttgtgctcctatgagaatctaatgccagcactgatctgacaggaggcagagctcaggtggtcatgtgagtgatggggagtggctgtaaatacagatgaagctttgctcactcacctactgcttacctcctgctgggaggcctggttcctaacaggtcacagactagtactggtctgtggccccgttgttggggatccctgctttaagccaagaaaacagactcctgttaacttcttctgcttggtttaacctctagaaatgggagagacccagtaaatgcctcaagggtgagaactaaggatttctcaggggcagatttgcttaggatgatgtctagagcagtaactaaccaaagaaattctagatggctttaggatgaggaagaggaagcaggggaaagtcaggaagtatggctttttaaaggagagtctagggctgggatatagtagcagagccacctggtttcagtccttgtatcccaaagatcttggggcacacgaacctgggccatcccatgggaaatacattagtccttcccattacatgtggctagtgtgagttaatagaggagtgttgtacatctataaaactcagttaataaccttttaaaattagagaatgtgtttcagttactcactttgtatcagaatttgttaggttgccactcaaactggctcaaactataaagcagctttattggctcatagaactgaaaagaccaatagttgagtgtccttcaggtgtatttattctagagattcaggaagtcatcaaagctgcagctttggctgggtgtgatggcacaaacttacagtcccccagctacttgggaggctgaggcagaaggatcccttgagttcaggagtttgagaccagactgagaaacatagcaagaccccacctctaaatttaaaaaatggcagctctgtttttctgcagttcccttggctcagctgtcttgcaggagttggttgactggcttggcctgggttaattgcctatccatgagcccacgatagtggccaggtggagatagacataccctaattagcttacctctgtggaggttcaccctcaagctgggattagggtccctcccacccaaaccaggtgtctgccacacaaaggggaggacggcaatggatgtaggaacagccaaccacaatgtcccttgtgccctcagttgtcaaaaactgcattagcacacataaaagtaataaaaatcagctttgagaagcattgtagcacttaagggagtgtggtaggaattaggacatgtaaaagtcgtactacataaatgccaatgccagtgcctttctctttcctaataaaaattacattgaatgctggaaaaatggaatgtaaacatatgttgcatttatgccaaattaatatatttcaaacatattgatcctgagaattatgagatatctattctgtagctctttttgtgcactgcctggcttggtgacccttcctgtgccccccagtgcccaggagattaatgatttaatccctccaggtgccccaatgtcctaagtacatatgtgtcattttatgttatcatatttctctttcttttttttttctttttttgagacagtgtctcactctgtcacccaggctggagtgcagtggtgcgatcatggctcactgcagctttgacctcctgggctccagctgtcctctcacatcagcctcccaagtagttaggaccacaggcatgcaccaccactcctggccaatttttctatttttggtagaaagaggtttcgccatgcccaggctggtcttgaactcctgagctcaagcaattcacccactttggcctcccaaagtactgggattataggcataaattactgtacctggccatcatgtatcttgtttcttatcatcacttgtttatatggcttagagattgggctgtgaagctgtgagggctgggcctatgtctttcctacctctttcccccaagtgccaggcacggtcttaggcataggggaggtgccatgagtggtactgagcagtggatacatctgatggtaaacttatatgtgacactcttcttcccagctccctgatctgggttgtttgacataatatagagtgaagaaaagacaatgagggaggtgggcagattgaacaagcctgacccttcagttctcagtgtttgaggtttcagaaactaaatgttgtcatcacattcagcatgggcagattactggggactgacccacactggccaaatccagagaaacaaatgtgtggactggagtgcccaacatgattatataatgaggaggtgctatggtttgaatgtttcctaaagttcatgtgttggaaactcgatctccaatgcaacagtgttgacaggtgggacctttaagaggtgattggaatgattctgaatgattagttatcatgggagtggttactgataaaagattattttaacccctccctccccaccatacccacatgctctgctttctgccatccgatgacattgcaagaaggtcctaaccagatacagtcccctcaactttggaccttccagcctccagaaccgtaagaaacaaattgctgttctttataaattacccagcctcagatattctgtcatatcaatacaaaacgactaagacaggaagtcaagcctcccaggaatcataatactccattgcactagaaccctctgttctagttatctattgctgcataacaaactatcccaaaccgtggttgcttaaaacaacaaatattttgttatagtcataattttgtgtgtcaggaatgtgggcagggcacagtgtaaatgacttatctctgcttcatgatggagtgggccttcagctcaaatgggcaaaatggagaggattgctcaagtgaggccatatgtctgggccctgagtctggcttttagctgccatgtcacatcttctggggccggaatggccaagatgagttttctagttgcatgttttgtgcctggcctggtttggccagaacagctggttatctttctctcttcatatgactggcttgagcttccttacagcatggtggtcttagaacacttggacttcttgcatgtactggcttcccccagagtgaatgttccaagagacggaaagtagtagttgcagtttcttaaggcctgggcctgaaaaccagcacagtatcatttccactgtattccactcatcaaagcagttacagagcccactgagatcctggagacatggacttcacctcttaatgggaggcatgtcaaggaatctgtagctatctttaatccactacacccttttcctaggattcaggtacctagggagagaaattattaactacattactgaacagcttggaaggacccagaactaaaggagtagaatcgtatggaagaaaattccatctaggccttggagaaacccttttgaatatacttctctggtgactctccgttaggttaattatctctctcccttggactgtgagtgataaatgctgccaaattcttcctatttggcttccttcttctggattttgttaacaccactcccattctgttaacacattctttcttcagtttgacaaaaacctttgattagatagattttcttccttagcactcatgttaccatcaggccttccagagattattgtccagttaccttgactggacttaagtgtttttcagggccatctggtagacatctataaagttgtccttgaggatgtagcagaacagggaacatggcccaaaagcctcagagatgggaatatgaaactaagtattaaggtgaaatatgtgtgagttatgccaatttagcaattacattgccagaatgaatcatagcaatttagcatttgcccttacagataaactgctgtaggcaaagagacatgcaagaatattcaaggcagccttatttgtagtcaggaaaattagaatgatttaaatgtcccatagtagggggctaattaaattatggtacatccatatgatgaaatttcatgcagccattaaaaaggttagggacagatctattaatatttattgcttgctaagagatggaaagaacgtgttgaaaaagaaaaactttagctgaattaagtttaacagagtttaaatgagcaaagaacaattcacaaatcagacagcgtcccgagccagagtaggctcagagactccagtgcagccatgtggtggaagaagatgtatgaacagaaaaaggaaagtgacatacaaaaaatggaagtgaggtacagaaacagccggattgattacagcttggcattagcctaatttgaacacggtttgaacagttggccacctctgattggccaaaacttggtgattggcacaagagtaggctacagtctgtatacaactccatttacgttatagtttgtaatgtgctgagaaacctttaggccaaacttaatatataaggaggcagctttaggctaaacttgaacttgatttaacaattccccactttcggttatttcagttttagaggatgaccaagactttactcattgatgtcattatcaccattgtaaatgtatttatttggtcttggaacccactgggaaatagcagagcagtgggttttgtaaggtgggaacaaggacttcaggttatttttttgtgaaggttagagtagagggtacctccttatggtgggatgtcctgtttacagaagaaaaacaaaacttagtctgttctaggatctatttgtttccttaaagtcttagtttgattatgtcacatttagcataaatgactctattttggtttggtgtggtctgttggaggctagtgcatgagcttagtcgaaaacaatggcctcccataatttgtttccaatttctcctcttttggtcagtttcttacttaggtaagagtatgagcaaaacttagggccttagcactgctctcagttacctcattttgtgtttctggtctcagcacatcattcataggttatggtgcctctcatggtcacatatatcttttagctcttttcattccagttgaagagagaccatttgacattctagagatggctgcatgcaaacatttaaaacttttgagagaatacagtgcaccacggagactactgttatgactatcaagaggataatacctagagtttggactatgctccttagccaggttccccataaaacaaaccaactaaaatcaaatagatcaaagaatcagctaaagactctacttgctttaactaagcagtctctttgttaatcccctacaactgaatctctaaaataccagatgtgatggaagtgccaacagctgcatagatacttccctgtttagccagcaggtaatctagagcaattctattatttagcataactttcagaagagaattttaagtctgttgtgtaaccatatcctttacagtagaatctgctagagagcctatcatgagggataaatttctttctttcttttttttttttgagatggagtctcgctctgttgcccaggctggagtgtagtggcacgacctcggctcactgcaagctccacctcccgggttcacgccattctcctgcctcagcctcccgagtagctgggactacaggggtccgccaccactcccggctatatttttttttgtatttttagtagagacggggtttcactgtgttagccaggatggtctcgatctcctgacctcgtgatctgcctgcctcagcctcccaaagtgctgggattacaggtgtgagcccctgtgcccagccaagttttgtatttttaatagagacggggcttcaccatgttggccaggctggtcttgaacacctgacttcaagtgatccaaccgcctcggcctcccaaagtactgggatgacaggcatgagccactgtacccagctgagggataaatttccaatcattgcctcatttactccaaaccatggaaaaaaggacctaatacatgatgccctttgagaagagttaagacctcctggcaatgatctttttaaaccatgatgtaggttaacaggagtggaccagtgctctgtttctgacagactatgaggcaatgtatgtgtcattaaaatttcccacctacattggccctttgtcttccatctatcaaggcataaggttatccatgtaataaggctggctgcaaaatctttcacaaataaaagtacaccccatgagtgcacacaacagacccccttttcacttctattattcgtaggggcataaacaaagaaaaaattgaaagataagagtctcgtgatagtaaagaagtcttgatctgtgatcttgggaaaaagtctacatcaaggataccgtcttcttctggggagaaacttccctggttagctttaccttaaggtttctaatgggtgtacagttccaagtatgtggagggacccttctgagttatgaaattatgaacccaaggttcaaggtctcaaagtcttgatgcagtatggatggcaagtgcagtctttctgtgacattctcagaagacctactctttgggctctagattgtgaagggcttcatgtcctcagtcagtgaaccatgaaaagctttcttttcctggtgaaaatacacggtggcatgatgagctactgttacaacatcagtcctcttgtgtgggaaagcttttatacaaccagacgacctgcattgaaaaatgacaatagaatgaaatccctctataaatgtttaaatgtcccatcagctagcgaaatgtacctgaaatttttattgtcttcccaggaatatgggtttgacaaaccaaatattggtcataaactattttagcaatgtagaagtcactacacacacacacacacacacatttaatttggatcattttatgtttttcatgatgagttatggaatgcagaacttttaataaaaaaaagctttaaggactcaggaaggacaaggtggctgtcctggttctctgtgagtccatgcttaacattggacttacatcctcttggataccagttgtttctccaatttaggtgcatagcactaataattgataagttatcataggtaatttgacttagaacatggagttcattcaaactgtatatctaaacaatttcagtactggatgatttagcatgaacatctggcaaggtgttttttttggtatttaattaatttttgttctgcttgggttagcagttttataaaccagtcagtttcttcactgaagtttcaagaattcttacccagtccaaatatatgattttaaagttattataaccttttaaaataattcaagagtgcttctcagggttctttctgtcctttcatgaacctccttaaagacatcatattctaggattttgcgtgtttgtgaaattttcataaactgcatcagaattaagcaattaattggggaaatgacttcaaatagtcatagttaatgacacaactgacaaggaaatttggttatttctgtggcctacaataatataaatatacattagaattttagaaatcccatacaattttggaacatatattaataacattcattaaaatgtaacctgaggaaggttaaacattgtttctaatttgacaatgcttcccatgtaacttagcatgtcaaataattctgtttacctctcttttggatgcttcagggaacctctgtagcatcccaaagttaaaggtcaaaaaagacttaattttgaagctgaaatctgatttttgggaagcctgacaaatatgtcaaaggtttaaaacacttgaccaaaatagaatcacaggtcaccataaaacaatagtcattcatttaaccaaagtgataattaaaagattctttttatttgtttgtttgttttttgagacaaagtctcactctgtcacccaggctggagtgtgatggcaccatctcggctcactgcaacctccgcttcctgggttcaagtgattctcctggctcagcctcccgagtagctgggactacaggcatgcaccaccatgcccagctaatttttgtatttttagtagagatggggtttcatcatgttggccaggctggtcttaaactcctgacctcaggtgatccacccaccttggcctcccaaagtgctgggattagaggcatgaaccatcccacctggcctaaaagatacttaaaaacaaaaaacctgtactctttgataaaggagactcagttttccgaacaatcaaaagacataagacagcatgagacagaatctcttctttcctctctcttttttcttgttgcagtttatgtaaaaagtgaacaaaaatattttactgtcttattaacactacagaaaattttatccaaaagagaaatatttcacttttgtattagtatattatcatattaaaactaattttaataaaacttcataaatacatttatcaaatttgtcatcttttaaaccacacatttccataaaccttttgtttcacattttccccaagtttctctttctttttttttttttttgagacatattctcactttttcacccaggctggagtgcagttgcaccatctcggcccactgcaacctccgcccccaggttcaagcaattctcatgcctcagactcccaagtagctgggattataggtatgcgccaccatgcttggctaatttttcgtattttagtagagacagagttttgccatgttggccaggctgttgtaggactttcttcttagttcaattaaaaatggggtccttgtcacacaaccaggaaagattaggctcgcggacacatagaagggtgagaaaaatggaatttattgggtgaaaaggaaaaaaattcagtaaagctagagaggtgcctgttaacaggcccccatctcacagattgaatccccaggttaccaccctggtacgggagaggacaagctcctccctctgcaaacgggtaaacctcccgaggctccaccccagtgcgcggaccagtcggagtttctccagggacctctttttacttggctgtctcattccccactctaaagaagtacttctaactgccattagaataaggattgggataaggatgaagattgatcttaactgcttcctgctgacagcgggcatagttttgggaaaatggcagtcatatctccctcagaggcctaagggtccccggcaaaacgggccattgtcagaggctctggttgcatgaccatttggagtttgatggcctgaaggtgagaagagacaaaccaggttattagaaaacatgtatcaaaaggagaaaagggcgggtaagatcagctcaaaaatcccaaggccttttaccagtttgcccagggagagggaggccaaaatcctgactggttaaaaaaaactttacccttttgccggcgtgttgggcttctgggttcccttcccttgagcccaatcctgaaccagccagtttaaggtttgggaaattaacttttcccagtttggaggatgcatctgaggggagtgtcctgtagtacagagccacaattacctatcagtgaagagaggacagaggaggagaaaagaaaaaagaaggctccttttcaaaggggtcctaggggttcaggatgcatttgaaagggtacagactgaagaagaatggctactcatctagaaaagagaggagcagacatctctggttcccttctcttcctagcaaatatctggggtacatgaagaagagaaggaagagtattctctttccctcttccatccttgcatccctgaatcctgacaactgcgacagggtgccacccatgggtgtcaaagcggcctgaacccatgaagcagggagggcctagagaataggaattatccactctcacctatgtctctattcccactagtgtcagtagccttggagttccctagacctcatttatgccatggatactagcatgactttatccatgaaatgagaggcttggcttaatcagcagaaattagccatgctcacctgtgctgtgccttttaacctctgttatcatctgcctctggatcctgtagatccagttttctttcctagggctttgacccgaagcttggaattgagtttgggacaaaattgtgtctcagggggtgttgcatggacttcttatcataagccaaatgctaaggtgaaactgtggaatcgagtcctcctgcaacaagggagagaaagggatgtcttgtgacacacccagataactggtggctatggttatgcttgctaagacttgggtgcatggtgcttggttttggttagctcccttggtcttcctttcccaaaaaggaaacctccaagtgatgggcatcctacttattcctgtcacctgacaggatttgcaggataattgctcagaaccagaatattgacccagatttttacattatccatctgagctgcagccaaagattgctggttggttcacaggagcaggcagggttagtctaaaatgtaggcaaaaacttaagaacaatgaatgagtttagaatttaattacaaatgtataagttttgaaacataatttctctctctccagtcctcatttttgttaaaaaaaatcataataggactgagttgtttgcaaagtagactttagtcttatacttggcctgattatttgcataaagtacagcaagaataattatttctacataggccttttagattggctttgatggaactctgttccaaaaggaagctcagataagaccttttaaagctgagcccagccatgggtttgtatccttaaatacctgtgagttgggtgatcctctcctttaaggtcccaagataaactcggagctcctgggcctgttagaaagtgacattctttactgaccacgggtcaggaaccctgtacagggactgtgtagtcgagggtataaggccagtttcttttccaaaaggggcttttattggcttggcaagtcgagcttgactccttaaagggaagcatacctttctagtcaaagccttggtaaaacaacagtttctccaattgcatcctgttgcaaaagaaaaatggattcttattgcactgatgcaaacaactatattgccataaattaagaatactctgctgggtgcagtggctcacgactgtaatcccagcactttggggggctgaggcggatggatcacctgaggttaggagttcgagactagcctggccaacatggtgaaacccccgtctctactaaaaatacaaaaattagccaggcgtggtggtacacacctatagttccagctacttgggaagctgaggcaggagaatcacttgaacccgggaggcagaggttgtagtgagccgagatcacaccactgcactccagcctgggcaacagagcaagactctgtctcaaaaacaaacaaacaaacaaaaaaacacaactcacagatagtttccaaattctagaggaacctggcagagagaaacaaacatgctccaagttttgttcacgggcatatagcttactcaattattaaggctgtaaataattcaaaataagtttctttgactctgaaaaacaaaacaaggatcagcagtattacaagcaaaagtcaaaaagacatgcttcagtttcctgagttctttcagttagctcttgttttgcttgatatttgtgaatatttcagctcttcctttattccaatgtcgcaatatccaaagttatcagaaacctgcatttgagaacacctgtcaaagtcctatagcttactataaaccgtctttcgaaaaggagtaaaacaagaaaacaattgtctgtgaaaaacaaaattcccagggtagttacagttagaaacacagttgacaaagaagtctggttatctctggtttacaataacttaacataacaacctgaattataatttttttttgagatggagttttgctcttgttgcccaggctggagtgcaatggcatgatcttggctcactgcaatctccctctgcctcccagtttcaagcaattctcctgcctcagcctcctgagtagctgggattacaggtgcccaccaccacacctggctaatgttttgtattgttagtagagatggggtttcaccatgttggccaggcaggttttgaactcctgatctcaggtgacccacctaccttgcctcccaaagtgcaaggattacaggcacgagccgttgcgcctggccttaattatgattgatagcatatactcagacatcagaatttccgagatcccatacaattttggaacatatatcagcattattcaccaaggtataacctaaagaagatcgaacaccattttggcaatctctaaacatgacaaattatcctgtttaccttttccagagaccctctgaaccatccaaaaagccatgcatcaggaaagacaattttgaaactgaagtttgatattgggaaggctgttaaatatgttagaggtttagaacacctgatgttatgaaatagaattccagattatcataaattatttattttgccaaaatgatgactcagaaacttaaaagcaaaaagccttttataacccttcacaagttttgctaaagagcagattagtgccttaagagtatccttgtgcttttatttcaatgctcaatttacagaaaaagcatataataccctttggaatttagtcaatatgttcacacacagaattttgcaagattaatttttataatcctttcactacttgtttgaatttttagcttttcttatctaatttaaaacaatcttttaaccctaggcaagaatttacattttcatgccttcttataatctttttttttgagacagagtctcgccctgtcacccaggctggagtgcagtggtgtgatctcggctcactgtaacctctgcctcctggattcaagcaattctcatgcctcagcctcccgagtagctgggattacaggcatgcaccaccacacttggctaatttttttgtatttctagtagagatggggtttcaccatgttggccaggctagtctcaagctcctgacctcaggtgatccacctgccttggcctcccaaagttctgggattacaggcatgggttaccatgcccagccttcttataatcttttattaaaaatacattttgttgttcttacacaccttgcatataaatctattttcagttgtttcaattacatgttataatggtaactcctggcaattttaactttaatgtaaagcctggtaaattgttttttgtgctaggtgtagccaaggtttgaatccttccagcataattaagggtgtggttaattccatatgtcccacttaccaattgtgaagtaggcaagtcaaatagttctcaaaacccaaaaggcagtttagaaccttaaaacatttagaaagcctaggccgggtgcagtggctcatgcctgtaatcccagcactttgggaggctgaggcggatggatcacttgagtctaggaattcgagaccagcctgggcaacatggcgaaaccctgtctctactaaaaacacaaaaattagctggacgtggtggcatatgcctgtaatcccaggtatttgggaggctgagagatgagaattgcttgaacccgggaggcggaaattgtagtgagctgagattgtgccactgcagtccagcctgggtgacagagcgagactcgatctcaaaaaacaaacaaacaaacaaacaaacccatgaaattggtagactttgagtaaagcagattaccctccgtaatgtaggtgggccttgttcaagcagtggaaggccttgtgcaaaaagactgaagtccctagaaggggaatgaatctgcctccaggccaccttcagattcaagattggattattgacctctgttggaatttccagcctgccagcctgtgctgcagattttatacttgccaactgttagggacaaactgccccaaaaagtttcttggtgctgcccacccctccccctaatgctctgcaactcttctccatgctgcccacccttcccccaagcctctttatgtttctaagcccttatctagacgccgcggtgaagccagcagacttcacttatcagaccttgctgtgataaggaaaccccaattacaaaccatccagacggcacagggggaggtcatgggaagcataaacaaactttacctacaccctcctgtaagttcctgttcatctagctgctaccataaacgtcacacggtgatatgtggcaaaattaaccagcaaacaacctcgggatgcggccataccaaagaactgcctcaaactcccctccccaatataaacccctccttctgtaagtttggggctgcttcctctctgactgttaagggggcagccggcaggttaacaaaaacttgcttgcctgactttgagtctatttttcctttctctcgggtaacctcacaccaacctccataatcatgtgagccaattctgtaaaataaatctttccctatatacatacatcctattgtttcttttttttttctggagaatccttattaatatatccacaaaattacatcagtccactgtccaatctgagagtttcttccaaatccagttaaagtaattttttgaccataaccatgggtatttctcggtgccccaatgacttgtgcccagtgtcggaaaaggctgaacaggttcgacaactgtggttgccatcaagtccccagcacaccttgatcagtgcataaagcctctgatcctccttagagaaggagggacttgggtttctgccctagtcctgttcatcttgacgggggtaagatcttgccaaaacacaaggagacagatgactgcaatgcaagttgtggggtacctccattgctgagaaactcctgctagaccgcagccaaggggttttatgttctgcgactcttttctgagggagaataaggcagaaagtccatatctcagaacctgagaggtgatgagaagctgtcttgggacacctctgaggaagatggggaggccagtgaagagtgggaggggcctcccattcttcggtgttccaggaggatcacagggcaatcagtcttcaaggctcagggaaggctgagtccaagcctttgtttatatggaaggtcttaacggtgctatggcaaagtaacgcagcctggtagaagaaataaagataagacactccaagtcagccagtgttattttgtgtggtggctcacaaaaaaataaaaataaataaacaaataaataaaaacacatgaccatgagacaagcactttcttttcctataaaaattacctttaaaaaaatcacataaatatgagttacgattacatgctaattttgtggctatataccacatttaatagaaaatgccatttagaattgaaataacttgcagaagtagtgtatgcacattttagagaaatgagaaaatataaagaaacaaaaagaagaaaatctaaatcttccataatcccaacacccatcacatagcacaatgccttatacccataggttcttaataagcgcttgtgaaatgaatacataaatacacccatatgttgttataagcatatggggaaagcattatctgttttccccatatgtcatctacatatatatgttttttaaaataaaagcataccatatgctctcttttgtaacttgccattttacagaaaagtaaatatgaatatctttttcaataaacacacttatataacaatttttaatggctgaaaagcatttcattggatggctacatcagaatttactggaccctgttggtatacttttagattttttatgtataaagctttgattaacattaatctatctagcactaaatgtttgtgtacattctcaattattttcttagaataaaactcctaaaatggaaccattgtgataaaggattttgttcggatctttgatatgtagcacctgccaaattgtcttccagaaaagttacaaagaaaatagttttgcatgacaaagggcagtccaaaaaacaaaaacagggccacatgtggtggctcacattgtttgtaatatcagcactttgggaggccgaggtgagtggatcacgtgaggtcaggagttcgagaccagcctggccaacatggtgaaaccctgtctctattaaaatacaaaaaaattagccaggcatgatggtgcacacctgtaatcccagctactcaggaggctgaggcaggagaatcgcttcaacctgggaagtggaggttgcagtgagctgacacggtgccactgcactccagcctgagcaacagagtgagactccatctcaaaaaaaaacccaaaaaacaaaaacaattattttttgcaaataagtacatgcagaatatatatcacaaagacataccattttcaactatgatatttgcaaaaacagtctctgcaaatatcatagttgaaagtggtatatcttcatgatacatattctgcatgttcttatttgtaagattggacctattttctgcatagatatactatttatatttctttttttgtaaattccctatttctgtttttatgtctatttttctaacgagtttttgaattgtgtagtcatacatattttcttcttgtatttttgtagtttcttttaaaatctttatcccacctgggattagtttctgtgtatggtgtgaggtgcacaaggcaggtgcctgaccaaggggtcacatgaggagcaggaatggagcctgcatttgacttgccaggccctgggctttggctggggctgcagctgctagcaggcttttttttttttttttttttaattcctatttaaggcactctttaggccagcaatgaccacggatgtgggttctaactatactttctccccaaataatcaactagttgctttaatgacatttgttcacttatttgtttcctcttatttaagactaggctaagaacaatcggaattagtttagcccgtgcggcctagccctagccaataggggaacgacacagcagcaggggccacgtgcgtcacggataagaaccccttcccctcccttgtccaagtgtgcgctcaccattgctccatctgtaagggtgcaccctccatagaagtaacttgccttgctgagaattaaaaagaaaattaaaaaaaaaaaaaagactaggttaagatgtgaagaaacagaactacttgcgttgttactccatgctttttccatctgctaattatttatttacttcctataaggtctttactatttcttgctcattcaaagagctttgattctcaggatgcatgagtttgtgctgctttttggaacgttgttctagcagcttgtcaaaagtgaggaagcactcacatttctgtttactcttccagaaggctgcttactacgagtttgttgctggaagaaaaatagtactccatttcctgtagaaaagagagacagccgatgttttcttcggagggcaaataaataagaataaacccagcctctgctcccttatctaggatctaggaactgatactgttattttctttttttctctctttttaagccattctagtggttaacagtggctttggtttgcatttccttaatgacaaatgatgttgaacatcttttcttgtggttaacagtggctttggtttgcatttccttaatgacaaatgatgttgaacatcttttcttgtgattataggccatttgcatatcttcattggagaaatgtctattcaagttctttgcttatttaattaattaatttatttattttgaggcagagtctcattctgtcactcaggctggagtgcagtggtttgatctcggctcaccgcaacctctgcctcttgggttaaagtgattctcatgcctcagcctcccaagtagctgggactacaagtgtgcgccatcacgcctggctaatttttgtatttttagtagagacagggttttgccatattggccaggctggtcttgaattgctggtctcaaactcctggactcgagtgatctgcctgccttggcctcccaaagtgctggtataatgggcgtgaaccaccacgcccagccattctttgcttatttttaaactgaatttgtctttttgttgttgggttgtaacagttctttgtatactctggatattaaacccttatcagatatatgatttacaaatattttctctcgttctataagctgtcttttcacattcttgataatgtccttcgaggcacaaaagttttaaatttcttttttgagaccgagtctcgttctattgccaggctggagtgcagtagtgcgatcttggcactgcaacctctgcctcccaggttcaagcaattcttctgcttcagcctcccaggtagctgggactacaggcacacgccaccacacccagctaatttttgtatttttaatagagaagaggttttgccatgttggccaggatggtctcgatctcttgacatcgtgatctgtccacttcggcctctcaaagtgctgggattacaggtgtgagccaccgtgcccccgtcttttttttttttttttttttttttttttagatgggagttttactctgttgctcaggctggagcgtattggtgcaatctcagctcactgcagcctccacctcccgggttcaagtgattctcctgcctcagcctcccgagtagctgggactacaagcatgcgccaccacacctgcctaatttttgtatttttagtagagatggggtttcaccatgttggccaggctagtcttgaattcctgacctcaggtaatctgcccacctcggcctcccaaagtgctgggattacaggtgtgagccaccatgcctggccaaaagtttttaatttttatgaagaactatttatctatttaaaaaaaattcctcatgcatttgttatcaaatctaagaattcattgacatatccagggtcatgaagacttacccttatattttattcagagttttatagttttagctcttctttttagattgttgatccattttgaattaatttttgtatatggagtgaggtaggggtccagcttcattcttttgcatttagttatccagtggtcccagtaccatttgttgaagagactttctttccccattgaatggtctgtgcacccttgtcaaaaatcagttgactgtagatgttctagtgtatttctgaattctcagttgtattccattggtctatatgtctacacttacactagtaacttactgttttgattactgtagctttgcagtaagttttgaaatcagaaaatgggaatgttccaacattgttttcttttttaatattgttttggctatttagggccccttgcagttccatattaattttaggatcaggttttccatttctgcaaaaaggctatggaattttgaaagggaatgcattgaatttgtagtttgccttggggagtactgctgttttaacaatattaagtctcctaatccatgaacatggatgactttccacttatttaggtctttaatttccttcagcagtgtctagtagttttcagtgttcaaatgtttcacctccttggttaaatgtattcctaggtattttatcttttggatactatcattagtctgtttgggctgccataacaaaataccacagactggatggcttaaacaacaaatttattttctcacagttctgtaggctagaagtgagagatcagggtgccagtggttggtttctgatgagggctgtcttcctggcttgtagttggctgccttcttcctgtgccctagagggcaagctctctggtgtctcctattatgaagacactaattctatcagatcagggccccacccttatgaccccatttaaccttagttacttccttagaggccccatcaacaaatgcagcaacacggggtttagggtttcaacataagaatttgaggggagtgcagacattcagtccataacagaggttattgtaaatggaattattttcttaatttcctttcagattgttcttccaggttcttaaaactctagacgagctactgttaacaagtttcctacgtatcctcttccccaccccctttctatgtctgtctctgtctctctcatgttctttgcattgtctgcaacatgtttctttctgctggattcattgacaactgttaagtatgtactgagtgtcttattaatgtgcttagcagtgtgcccaacaatttgggatgtcataaagaagtatgacatggttttcacccatgaggattttcaatttagttgaagagacaagacatccgcaaaataattagaaaactgtttaggaacatatgtaatcaaattctcaactgtctggcccatgcactaggataagaactccttaagaatggtcttttatgctgtgcttactgctgtatccctagccccttgaacagtataggaggaacaggacatgagattcataaatgaatgttgaatgaattcaacattctcctgctttggagttttgtcaggtgggggctaaccctcccattcatcctgaaagatgatctttgttctgcaaagtggctcttagacaggacccatccgagaatgctgggactttccaactggctcaggttacgatctaatggtaggatcacagacacagcacgcatctctcagcaagtatcctgctgtctttctaaaataacttcttacataagtagatccttgttaagttccactaagtaaactaactgaggagcatgaaggaagaaggcatggcttagctaaaaggagaaatgtcccagaaacctccatactgacagccaggaagtagtctcagaggctttggattccaggaaagaagctggtattgtttttctactttaaaaatataactttttttctgctgattccaagaacgtggcaaaaaatttttgaaaaataaatcacagtatagagaagaaagtaagttaatttgtaaagcactgtttaccaccattgagataactgctgttcagatttttattaaaatgttatacataagtttacttcaacttaacagaaggataagaaaccaaactttagaaaaatatttcttcaaaatggtatatatttgttttaaacaggtcttctaaaattaaagaattaggagacatattaagaggctggacttattgcagtagttctcaatctatggtgatttcatcccccaggggacattttggaaatgtctagagacatctgtggtagccacaactcagagggggtgcggtacttgtggggagaggccaggaatgctgctaggcacccggcaacgcacaccactgtcggctacaacatagaattatccactccgagtattaacagtgccacagttgagtaatcctgggttgttattgcataatattgtggttttaaaatagtacacgcttttcaagggcctacgtttgtttccagttagaaggacatagttgttttctcagggatccgtggagtaagtggttcagagcatggcctccagccaggtgtttggagtttgaatcctgactctgctacttaatgataaagtgaccttgagcaacttctttgggcctcagtttcctcatcggcaaaattgtggtaatattaaacctaccccaaacagctgtagtgaggattgaatgagctaatataagtaaaattcttggaacagtgtctggttcatggtcagctctatggaagcacgtgcaattattattgttaatgtcttaaactggaaacaaattaagcctacttttaggacaggtctcctagggaattttttttttttttttttttttttttgagatggagtctcacattgccacccaggctggagtgcagtggcatgatcttggctcactgtaacctcctcctcctcccgggttcaagcgattctcctgcctcagcctcccaagtagctgggattacaggcgcccaccaacatgcccagctaattttttgtatttttagtagagacggcgtttcaccatgttggccaggttggtctcgaactcctgaccttgtgatttgcccacctcagcctcccaaagtgctgggattacaggcgtgagccactgtgcccggccctcctagggaatttaatagaggaaaatagatgtgtatgtaaagtattttttaaaaagcaacctttaaggaaaaaaacaaaactcactcacaggaaaatgatatggctggggcacttataaatctaaggagtatttacaggaattcagaggctcagcaaggattccctgccttctagaactatctggtcaatgtcaggtgacttactgtttcagaaaacatttctttttgtacctttagactttaaaaatttgaataggtaatacattatcatagttcaagactcaaacaatagaacatgatacacactaagcagtctgaccccctccgctgctcccctgaccctcccatagtaatcactttatatttatttatttagagacagagtctcactctgtcatctaggctggagtgcagtgggtacagtcatggctcaatgcagctttgacttcaagcaattctcccacctcagcctccgagtagctggaatcacaggcgcacactgccatgcccagcgaatttttttttttttttgtagaggcagggttttgccatgttgccaaggctgatctcaaactccttagctcaagtgatcctccagccttggcctcccaaagtgctgggattataggggtgagtcaccatgcccggtccagtaatcactttcactagtttcttatgtatccatccagtatttttctatgaaagcaaatacaaatactatatattcttattttagacctcctttcttaggcaaaagatatactttttcacataatctatcttggatatctttctgtattagtacacaaggaatttcttcatccctttttaaggtgacatagtatttcattatgtggatatctcatgctttgtttataaatttgctcgtacttttgtaaatattaacaaatcgtcctccaagtagggatgtgttattttggagtcctaccagcagtatattttccttccaggaaaataggcatattcactgcagtttgcagacgatcagctgttcaaaattagaacacactggcaggtgttcctgggaggtagaaatgggaaacaggtctaaatggatgttaggggtttgtcaagactgtccttccaggaactggcagaatcagccatttgttcaaggtgatgtctgggtatatgggtgatatattggaggcaattatgttggattggtcctaggagaatccagtttttaacaccaaaactaagatccagtaaagttggagtttttctggactatgggttgggtgacgtttccttctgtaatttgaatgatagatttcatctccacaattggtaatgtctcttttatagaaggtctttggcctaatttctatactggaaccgattctgatcctctcaaaatctcttcagtaactgattaggaaagatgaagtgcccaggaaaccactgtgtttcattttctttcagtttgtaggtgtaacttacctaggaaatatagtcttaggatttgtgggttattttaaatttttaccccccaaaacgtgtttcttttccttctcattttcagcaactataagactatcatagcaatgtcaatttcatagaggccgtggatatctatcgtcaagtgctttagaaattctaagataaaatatttgagaattatattacataacatggccagtacttttttttatttctttttttgtcatgttcttagatttcaaagacaaaatcatatggaagctcaggaaactcatgggaaataaataaataaataaatatcataccgcatggcttacttacttatttttggaccctgactttctcatccagcttattgttttttctgttttctcatcagtcttcttttttcttgttgattacataaggcattcatcatttcattgacagcaagctgcagtagatttaaatacaaaaaaaggagctataggctttctatctcacctcactaaagggctcagtttccctcaaatgctggcctccaacatacacctcaacgtacctcagtttgccatatagcccatttttccaaactttcactcctccaaggacctcaatgcctccagttccaccagacacgcattgctctaatattctagctccttgtgtgcccattttttaaatttgctcttcctctggaacaacaggccatcctggtgcctacatcatacacaatgcccttttttttttttttttttttttgcccagctcatttgctcttgtgtagccatcagacccttcctcacctcatctcctgtcctgggagcacctgcccagcttggcccagttattcagttttgattgaactccacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacgtgagctggggcctgaagggactggaacagggccccagagggccagggcgaaagacagtgggcacagggcaggcaggtggataaccggcagaatagtaccctctgcatcctctgagcctgatggtctagagagcagttgttgggaggtgctgaagcccagggaccattcattggctctccactaataaatattaggttggtgcaaaagtcattgtggttttcaccatttaaaattatggcaaaaaccacacctgtaatcccagcactttgggaggctgaggtgggcggatcacttgagttcaggggttcgagatcagcttggccaacacggtgaaaccccgtctctactaaaaacacaaaaattagccaggtgtggtggtgggcacctgtaatcccagctacttgggaggctgaggcaggaggatcgtttgaacccaggaggtggaggttgcagtgagccgagatcatgccactgcactccagcctgggcaacagagtgagactccatctcaaaaaagaaaaaaaaaaaaactttttaacttgacatctgccactgagggtaagatttaggttgcaggttttcactgggccaggccacctatgacatgacagctcagatttagaatcggagctaaacattatgtagagccctttgtaatctatttacatttttttctctaaagccagtttcctgaatagatgatatcatatgcatgcatttaaaagctcttttgtgaatctttgagtcagatgactggggaaaaaaagctattctgctaactcatgataagtttggggttctcaaatttttgttttaacatatatatttttaaaatatcattttatgaagcattgtttcctccaagtgattttttaacaaccacgtttaagttctgtatatccgattcctactgttgagagagttttacttttggaacaacgtgaagtcccaacaaataggtctattctggttttcatttctttttcagcaacactttcagtttatctttttgcaattttcccttaacataataaaggcagctcctggggtggggtgttgaaggtcattaaagaaaaaatatatattaaaaaaaatttgactgggtgcggtggctcacgcctgtaatcccagcactttgggaggccaaggtgggcggatcatgaggtcaggagatcaagaccatcctggctaacacggtgaaaccccgactctactaaaaaaaaatacaaaaaattagctgggtgtggtggcatgcacctgtagtcccagctactcaggaggctgaggcaggagaatcgcttgaacctgggaggtggaggttgcagtgagctgagtgggtgacagagcgagactctgtctcaaacaaaacaaaacaaaacaaacaaaaatacaactttattggttttaaaaattcaaaagtaatactcaccgtggaaattccaataataaaatatgaagtctcttgcccttccacccctattgcatcctccttagcaaccagtactgacagtttgttgtgtattctcccctctttatccaggagcatgcaaatatacatgtggataggtaggattttgtctcctcttaaaattggaccatattgtacttattgctctacagctagccttttaaaaaaatggactcatacccagcttgcttaggaaaggaaataggtttgaggaacagctgggagtgggggcagtccctggacattaatcttgcttatggaaagtatgtttccacccacgtgagcacccttgcctaaccaaggaggaggcctgaccacctaccttgcctaaccagggagggggcctgaccatctaccgcatgactgaggcaagagcctacagcatcagcctcgtgggcctccctgtccctctgacccactgagccaagcagagcatgaaggcttagagcctgagcactccgggaaccctaacttggtcctcctttattcctcagcctctgcagctcccccttatttgacatatggaagattccagagctgtataattccaagataatcagtcaatattcactaagcattcattatgtaccaggcactgagctaagcacttgaatgatgtgaacgagcctactcagataggcactcttattatccccattttatagaaagggaaactgaggcacacaggagttacccacctagggtccctctgccaggagtggtcagacctgtgatttgaccctagacagtctggttctagatgcccgccatacccacttccactctgctatagcgagattctggtttggggattctaagattctgtcacttgagattttggtgattctataattctaaattctaggagtatgggatttcccttgactctggatggagggggtggtggacttcagggtgagaagatctcccttaattgaacccccatagaggcttatctttgtgctgttcctctgcgtccctgcagggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaaggtacccttgctgggagaggggctggggaagggaatgggtcagggagaggttgtgctccctctcctcaagggctcctggattccatatgtcctggttctgcctcctgtgatggcctctgtgcactactcagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttggtgaggactcccagatggggcccagggaagagagatgggggtgactccaggtctgtgcatcagcggtctctcccaggccttttccctcatgctaccagttgtcggagtggctcttggtccttggagatcatgacttttggctttgtcctttcctcttctctgttgctttcacagggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacggtgcgtgaagggggagggtgagaccaggggcccccagctcccaacctgaaccagttccctattatccctcacctgatcccgaccttcatccctccaaggacctgcttctttttctgtaacatggatacagccctagaaggaaaatagagggcttgctcagcttagccgaggtgggaggacaggggatggtccttttgtaagaaggatgccatcacctcctggagcctcctcactctctctgacagctgggaagtacatctcccatctatccaactctcttgctgcaatttgaatggagagttggaagagctcattcacaagcactttctttcttttttgttttttttaagatggagtctcactctgttgcccaggcttgagtgcagtggcttgatctcagctgactgcaacctctgcctcctgggtgcaagcaattctcctgcctcagcctcccaggtagctgggattacagttgtgcaccaccatgcccagctttttttttctttaaattttagtagagacgggggtttcaccatgttggtcaggctagtctcgaactcctgacctcaaatgatctgcctgcctcggcctctcaaagtactgggattataggcatgagccattgtgtccagccagcaccttctttctttatggttcctatttccagtgctttcatcctgttgggtttctctgtgttgccgtcccctcctccactgaaggtgcgattcttcatcatatcggccctcatcccactgtggattcatgtttagcatggagactgccatgaacctgcatgttttttcctgctaggctagtggcaaattcatttctcccacattttgcatacacccactcatacaccctcccattactggcctctttcctagaaatcgccctcacctgatctcccactctatcttctagacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcggtaggacagaatgctgttctggggggcacaggatctctttgtggggagggaatcagaggaggaaatctgaagtgaagacaggtgggctggggctagtgacaaggatgagatgggagaggtaggggagaaggagtggggcactttgtacccccatgaatccagagcagactccagacattcttttccctgcagtctctaccctgtggtccccacaaactcccggatcatagaaaaggaaattgaagttgatggcttcctcttccccaagaacgtgagtggggctagagagcccgattgcccaggagtgccctatgcccccgaagagaggcattcatgctgcccaatcttcctttatagacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaagggtgagctgggagaggctagtagggtgtgtgggcagggaggggtggaggagtcctgggaggagaggaagggaggcacagggtaggagtgtgcagagcggggagtggatggcaaacacacaatccacccaaccacatgtgctctttaccccccagctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttcttattggagacctttgtcattctttttgactacccagcatctgagggaattcctctcctccagtgagtcacggtgagaggcacagccgcccctgtccttggaaactgagaacaccttttgctttcccagacctcacagagaggccttggtttcacgaggcactggttgaggccacaccaagcaggaactgcagtgactcccaagcactgtgtcagtcaagctgcggttgtagagaatataaaccaccctctttgaacagaaaaagcagatacaggcaatggggtgctacaaaaattattggaggtgctcgagaccaggctagagttgacctccagcaggcactgagcagcttggggagcaccatgttggccacaatcaggaggatgagagtctagaagctattgctacaactattggctctagagctactccatgtcaatgaagttcaagtaggtctgtgccggcaaaacaaaacaaaacaggtcacgcaggatgacccccatcctgtctctcaatacccatgaagccagcagtaactggacttggacctctgcaaatgcctcgcgactgctcctgacagcagaaagggcaggagcttctacctctcttccacctttcacatctctcacatacagctgagaggaggaacctaagtcctgcctggagcactagctgtaagggagcctagggattatagcttttaactgtccagcctccttgcaacaagaagcccacttgaaggaaagtgggttgccattgagagccgccagtgcatcacagcactagcctggaaattcagagtccaagccccagcagtaaattttggtggagtcatagaaaaaaatgaagttcactttcttttttaaaaattaatttgattttttgagacagcgtttcattctgtcacccagactggagtgcagtggcaccatcttggctcactgcctccttaacccaggctcaagcgattctcccactttagcctcccgagtagctggaactacaggcacgcaccacctcgcctggctaatttttgtattttttttgtagagatggggttttgccatgttggccaggctggtctcgaactccggagctcaagggatctgcctgccttggtctcctgaagtgctgggattacaggcgtgagccactgcgacaacctaaagttcactttctcaggcctgtgggaatgatagggtttgaactcatttaaaaaattgtgtcattgcccggattaaaatactccacaactgccctcagccctcaggtcaagttcaaagttgttactgtggctcataagacctaccgtgccctggcaccctgcaccctgaccgtggtcaccctttcacagctgagcctgaattctttgcatgtctctgaacacattatgttctttccagcctcaatactttgtacctcctgtccccactcttggaacaccctcttccctaactgtcatgtcatcacagagagcttgctctttcttaggattcagctcaaatgtcactgcctctgcagggccctccctgacctctctgagcaatcctgtgccccaccttcccctcctctgcttacagagctgagctgtcagcatgctcaccttgttagagatccagctctctccccaaccaactgtgaatcccctgaaggccacaagtcaggcttctttaatgttggatcccagtgtctaactgtgtctagcacctaggaggtgcttagtaaatgtttcctgaaaaagagatcagaataaggggaagggaagagaagggaaggggagaggaggacacagagttttctacattgagaaggggaacccagcttgtaatcccagcactttgggaggccaaggcgagcagaccacttgagatcagcctggccaacatggtgaaaccctgtatctactaaaaaaaaaaaaatacaaaaattagctgggtgtggtggcatgcacttgtaatctcagctactagggaggctgaggcaggagaatcgcttgaacccaggaggc

SEQ ID NO: 17133 - DNA, 11090 bp, Human
  misc_feature (1)...(11090): n = A,T,C or G
ctgcggcagtagcgctgacacttcctcctccagacactagaggccgctgttggccccatcgcctccaccgccgccgcagaaatgaattcctaaaccagccttgctattccgtgacttgctccagattcaaagtcccagttggagcatccgattggcggagctcatgtcttctgcctgcaaccccagagccgagtcagggagagcaagcattggggctttgtggcaaatggtggcctgctttccattagggcccttgcgatgggaattccccaaatgtaggcaggaggttctgatggtgggcagccaggaaaccaggacactcacaccaccttcttctctcacgtccgcctcaaacccttctcgttggcgaagtattcctgggtcccccagcctaaagcacttttctggactcacataaccattattgcttgagccaatcacgatgccagcaggaccgcagtaacacctaattcgtaccatgtctcatttgactttcaaacaaccctaggcactacctatatttagtgagaaaaaaagagtgctcagagattttcccaagtctcacagtaatgccaggttgtactctgtttccaaagcctcgggtttcccagcgggctacactgatgggctggtatcttatcaagttcaagctctgcaaaggcagggcttgggccacattcttctttatacggcctggcagcatcttgaatgcagaaaaatgctcagctaacgcctttggattggcctggatgggatcaagcaggagccagttctggaaggtttcctaactctccaatgaggcctgaacccagggagcattttgaagtggaataggcctactcaggatcagtttgggaagacttgaacctggggaattccgttgtacggccccctttacctcacctcccccaaatgtgtcaaaactgtcaacaagaggtttgcaggtgttcattatttattcatcccacgggtagttttgaacccctacgactgctctaatagaccagtgagaaaaaacacacaattcctgtcctgtgaaatcgacattctagtgggggaggtgaatggtaataaaaaataatcaaaccaataaatgctaatttgtggctctaacaagcctgatgaaggaaatgccacgagatgctgtaaaaggcagttctgacctactcaggaaagccagggcagcctgctgggggacctggggctggagctgggagctgaagaagggggaggagttagaaccgtggtgggggnnnnnnnnnnnnnnnnnnnntgagtcctcgagtgggtgagtaagcatgggatcatcgctcatgtttataagaaagtgacagagggaacctgggggccgagcggcttgtttgtgggctgccccagcctccgtgcgagcgcttctcgcttggatggaggcggggccgcagtctcccaggtcccagctggggctgacgtcgtcctggtgtgtgcccaaaatagccggctccgccctcttctcccggcagcccctgcaggcccccacccccccaggggacaggcggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggaggtgcggccgggggcccgggtcaggctgggggccctggatcggactgctggagttggggggccccgatagggctcctgggcctgggcgtcgagatagctcttggccccggcctgcgggggcagataaggctgccggagggagcctagtcaccggccgcaagcagagcccgctgtgctccgcttccaactgggagcgccttccgccacccggggagggggactgctgcagccacagggtggggctcttggttctttccgcctgactccttctcttctgcagccccaaggaggcccgcctgacgactgaccagttgccatggcatcctactacgagatcctagacgtgccgcgaagtgcgtccgctgatgacatcaagaaggcgtaagtgcctccgtatgcaacagaagacctctcaccctccacccgccaccaccatggggcacttcagagtgacacctgtaggtgtctgagggaaccaggtcgttagaaagcactggggtgcttcttccgagtgacacctgcagggaggaaagagacccctggtagagtacaaggagaacgtccagagagtgaagtagttagttcctctgggagctgcactgtgttatgggttgttctccagttgatcttcccctcctcctcctcctcctcctcctttcccctcccctcccccttccccctagatttgggcattctcaggctgcagtgcaaagatgcagtgcaaagaggctctatgaggaggaggggccggtgtccctgtactcttcgaggccacatgtgccccaacctttgcagccccagtccagtgagccctagggaggggctagggaccctggcattgtatccgcttgtacatgtggtcccagcactggtggcggaggagagagggtggaacttgatgaaaatatcacagcagcggcagccctagcagctggggtggactgggacccgggggtgaaaggacagtgataggctaatgggaaaacaggtcgttcggttcctgggtgggaagtgcctgcatttgtcccccgactctctcctctgcacccactttctgcaggtatcggcgcaaggctctccagtggcacccagacaaaaacccagataataaagagtttgctgagaagaaatttaaggaggtggccgaggcatatgaagtgctgtctgacagtaagggccggggtcaggcaggacccagcacatcaccccctacttcatgccccagctcacattttcttaaagcaatgtctctgccacctagtttcctctgtgcctttttccagcctgacatttaagctcccccctcccacagggacagctcagtgtctgctccccagagtctggtaggagtggctggcatgagacctgaaaggggaaggaagcagggcaggtaactcatgtgagctgagcctcctgcgtgccaggcattggtgggtgtcatctccatgagttctcacagccgtcctatgaggcaggttctatcacccctattttacaggcaaggaaactgaggctgagagaggtgaagtaacttgctcaaggccacgcagagctggaatatgaatccaggtctgcctttttattgattcattcgaaaagtaattcagtgaatggtgacagtgtccggcactcgctgggtgctggggaaactggaggacaagcaggcactgtctttgcccagaggggcagggaagaccaacacctaccaggcacacacacagacacagttacagcttgtgaagagtattccgagggaagaaacagggcaggtggagtgctagggaataatgtgcacttgctttagttctggtggttgtagaaggcctctccgagaaggtgacatttaggctaagccctggtgaataataatgtagtaatcattagctaacatttattgaacactttctatgtgtcaggcactggtaggcagtttacgtggatggtctcatttgatctgtgcaacaaccctgtgcggtaggtgttgtgatgacagccattttccagatgagaagaggccagctgtgtgaaaggctgagttgctgcctaaacctatagcccgtgtcccctgggtcccctgctgtgcctgctttcccccgccaagtgtcagagtgtcagtctctggacaatcctttgaacgtcctagcctgggaggggagcccatcccagagggagggtgaaatgatctggtctctttttgcagagcacaagcgggagatttacgaccgctatggccgggaagggctgacagggacaggtaggtggagtggtgaggcccaggaatggaggtggggcagggaggagaggggcagggcagattcttgcaatggaggctctctcaggctcctggctgtgccttaggtgaggtcccccggctcagggcaggatgcatgccctaagctctctcctcatcctgcctttccaggaactggcccatctcgggcagaagctggcagtggtgggcctggcttcaccttcaccttccgcagccccgaggaggtcttccgggaattctttgggagtggagacccttttgcagagctctttggtgagtggactctggaagcctctgaatggctcaacttccccctccaggcctgtccttccatcagctgggaggccctgaggtggaaggctgagaggggacgggaatgccacggacagaagattttgtggagctgggtccagtgagagccgggacagaacctcacgtgtgccagaacccccgtaatccaacagtgacacttcacagactcaccttattaaattacaacaataatacattgttagacttctatagtaacagccatgaaagcaagactcaaagcatcttgtgacaatattgttattattacctataaaacagatagtggtattttttaatgatagatatgtgccaaatattttacatttcgtaagtctctagtgaaccctgacaggtgggcaattttctccccatttgcagatgagaaaactgaggcacagttaatagcccagagtcacataacacatggcagagctggactcctagctgtgtctgcctgtcatcgcgtcatgatgatttgcctgtactgaaagagccatctgtcctccatccctcttccccctccttccttcctttattctttattgtggacagaattaaccagtgagtgttttcgaattcaacattaaaaaggaatttataaataagcccaactaaaaagcggaaaagaaaaaccctacccagttgcttagtggtttatacttccagacttgggctcacacacttttgaggggaaatgtcattaccagatgactgctaatctgtttacttgttgcagatgacctgggccccttctcagagcttcagaaccggggttcccgacactcaggccccttctttaccttctcttcctccttccctgggcactccggtaagttctgccccttcccacgtttgcaagctccgattcctggaacccctggcttgagcttgttgcttttccaagcctgtctcctgtgttgggagccctgcctccagcagccctgcgaggcggcctggagcctcggtgaccacaacaggcagcgcagtcttcttctaaccacctctcctcctcctcccttgtcccgatgccagatttctcctcctcatctttctccttcagtcctggggctggtgcttttcgctctgtttctacatctaccacctttgtccaaggacgccgcatcaccacacgcaggtgagagctccttctggggccatagaggggtgagaggtctgctggggagctgtgttcaaatagaaagttggctccttgagggcagggcccagtctgcgctctctactgcggtggccagaactgggaccagcgcctgcaggattctgtcactgctcgttgcctgaactgtgctgtctcccacagaatcatggagaacgggcaggagcgggtggaagtggaggaggatgggcagctgaagtcagtcacaatcaatggtgaggagcagctcccctacccagcccctggcaggaagccccagccccaacctcagcagcctcctccccaaactgctgctctctgaactcacttagggcttgggagggagtggcaacaggccagactggtaggatcagagatggcaatgtcgggaagggggtgaaggagtctcacgaagccatcgccgtcactgtgagtggggtgccttacatttgcaaagcactttactatttttaaagcacttccagatatacgatatcctctgtattcttcaagcatctgggggagtacacagggcagatggtatccacttagttttaatttggggagcctgagctgcagcatagttaaatgaccctaacttccaagtagcccaggcccaagactctttccttccaagtaaggagtagagccaggagtcaaactcaggacgcacgattcccggagcagaactgcccctgcaacaccatgctgtgcagggccgtcaccacagctaacctttcacgcctgctgactcccagcactgcgtaccaagccctttacatgggctgacatatttaatcattggaacaatttgagtatgaaggcactatcatcattcccattttcttttttttctttttttgaaacagggtcgtgctcagcccagcacgattatggctcactacagcctcgacctcctcggctcaagcagtcctcccacttcagccccctgtgtagctgggactacaggcgtgtgctaccatgcccagctaatttttaaactattttgtagagatggggtctcactatgttgcctaggctagtctcgaacttctaggctcaagtgatccttctacctcggcctcccaaagtgttgggattacaggcatgagccactgtgcccggccatcattcccactttctagatgaggaaagggaggggtagggatgttgagtgacttgcctaagggtaggagcttctacctggtagagctgaatacttccttgtgctcaaaatcacaagcctaggtgccaaaatgcatgtgtgccaattccaaataagagactctaagtggtcagggttgttactgtgtgaggcagcctggcagtaatacccctggctcaggttggggcctcatggtggctgtgactcttgcaggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctcccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggccttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactccctgcgggccgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaccgggggaccccagagggaggcctaggaggggactgcacccatactgcttccctaccacaaatcagggctcagggagaggccatgcggccagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttggtggtgtgttgtgttcttgggttcctactttccggggtggcccaggagggcctctaagggacagtgggtgacacctcaggcctcacacctccctttatgcccctacagctagaggtgcaggccttgccagttgaaggcagaaatgccctctttgaccaggctgccctccccaggtatgttatggaaccccaagcaatgcttcattctttgctttcacctcttgggggcctacaactggctttccctagcagccgatgttccccttatgagtggcctcaccccctagtactccacagcacagctaggaccatactcaagttaagacttaactgaggctgggcgcggtggctcacgcctataatcttagcactttgggaggctgaggcgggcagatcacttgaggccagaagtttgagaccagcctggccaacgtggcaaaaccccatctctacttaaaaaaataccaaaaaaaaaaccccccaaaaaacaacaaaaacacaaaaagctggatgtggtggtggtgcatgtctacatgcctataatcccagctactcgggacgctaaggcaggagaatcacttgaacctgggaggcggaggctgcagtgagccaagatcaagccactgcactctaacctgggcaacagagtgagactgtcacaaagaaagaaagaaaaaaaaaaaaagactgaaagcacagaaagctgagaacacacagtgaaacctttaaactgtacctgcatgaggcccacagactaagcccctgggtaggtttcattggctcagcccgaggtgtgagccagtggcatgtggtgtggcatgagtccagcccacccagggcccaggccccaaactcatcagggcccacggaagaaaaagccaggtaccccttccctttcatctctagccgctgtgctgggacaagcacctttccgttgtcaggcagggccaggtggctccccaggcctctcttctattccaggacaggctcttgcttcaccgtcaatcaccaaagggcctctactatatttttctcaaagtgaagaagcagcctaccctgaaagaggaatttcaaacctccatcctgagtcgggtggaagtttgcaaatggctgtttcttctacgtctgtctagcccttgagatggctatcactgacactgagcctcagcagagcgtgggtgagacagcgggagggcctgtggtctgctggcgggtcccttcactcctgctcagggcagatggtgcttgccctgttttttaattaaggagactgagtctcagcacaggtaagtagccctaacttccaagtagccccaggcctaaggctctttttgccttatttcatgtccaccccatttgtccaaggacacctcctgacatgcaggtgagtgtgccttctgggactatacagggtggagggttctgggagctggggtgagacagaaagtgtcctttatccccaggggaacgcctgtcctagcatctcacaggcctagcctagactcactggcagagttttgctatagttttgcctaaggtgtggcagacactttgctaatatcactttgttcaggcctcacctcaatctggcagcagaagggcacaaagcagctgccaagaactgagaggaggctaggcgcggtggctcacgcctgtaatcccagcactttgggaggccaaggcgggcagattgtctgaagctcaggagtccagaccagcctgggcaacatggcgaaaccccgtctctactaaaaatataaaaaattagccgggcttggtggtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17134 - DNA, 24665 bp, Human
atcccctgtgacttgtacgtatacgcccagatggcctgaagtaactgaagaatcacaaaagaagtgaaaaggccctgccccaccttaactgatgacattccaccatcgtgatttgttcctgcccaaccttaactaagtgattaaccctgtgaatttccttctcctggctcagaagctcccccactgagcaccttgtgaccccccacccctgcccaccagagaacaaccccctttgactgtaattttccattaccttcccaaatcctataaaacggccccacccctatctcccttcgctgactgtctttttggactcagcccgcctgcacccaggtgaaataaacagccatgttgctcacacaaatcctgtttggtggtctcttcacacggactcgcatgaaaccttggtcgtgggccctcgtggtagagcccatgtcccccaagatttctttggctgtgttaccttagatttgaacaagcactgtacctaaggcgggcgccttcctcctcccgctttcaggaatgccctgctctgccattcttttgctttctcacttctctaatacacttgctttcactttagtccgtggactcgccccgaattctttcctacgcgacatccaagaagcctctcgctgggtctgagtggagacctctttctggtaataaacggactagggagattcgactttgaaggtgaaaacaaaaaccaccatccagtttataagaaggcgctcgaggccgggaacggtggctcaggcctgtaatcccagcactttgggaggctgaggtggtggggcggggggagggaatcacctgaggtcacgagttcgagaccagcctgaccaatatggtgaaaacccgtctctactaaaaatataaacattagccgggcgtggtggcgcacgactgtaatcccaactactcgggaggctgaggcaggagaatcgcttgaatccgggaggcagaggttgcagtaggccaagatcgtgccacttcactccagcctgggcgaacaagttaaactctccatctcaaaaaaaaaaaaaaaaaaaagggcggcactggaaacagctgggagtgacagggccagggatgagggatcgcaagctgctggtgagaaaggagctcagaggctgcctggcctacgggccaggagacctcagcgcagaaagcgcaggactcgttcccctgctctacagctgagtgcccaggacggatctcactggctgaaaaaaacagaagagaaggcacccaatgcaaaatcaaatgtcagcgaacgaggggtcctttaacaggcggcccacacggcccctcctggcgccgagacccagcccctccgggccaccccggccaggtacgaccagcagggtcacctgcgcgcgtcccccgagacggggcctcctgatgtgaagcgaccccagtggcacctcacacgattcccgagggttgcgggcggcctctcctcagccctgcagctcccacacgcggacaccgcgggcctcggccatgtccactgaccgaccttcctcgccggaactcctcgcgcatcgccggcccctcagcggcgactagcgcgcgaacatcctggaagacgcgttgccggccgcacgtgagccgacgccccaaagcgcggctgctggcgccggctacgagatcaaggtcggcgcgtgcgcgcttgcgcgagaccggcattctcagccccgcgccggtttccagggagctgggcgcatgcgccgcgtaaggggaccggccggcggaaggaggtgctactgccggaagcgccggcgcgcttgcgcagtagctgaacgcgggcgtttctttcctccctttttttcgaattggttttgggggtagattcgagttacaaaatggccgcccggagtgtgttcggcgcggttcccccagctgtctctggctgaaccggcgctctcgcctccctgccgaacacagcgtgaggagcccccccagggacatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggtgaggggcggcggcgggcgcgggaggagaagaggctgagggcgggagcctggtgctgagagcccagggccgggagggcgggagcgggctcgggcctgggaggggagtgcgagtgcagggctggggactggaccctggggagggaggtgcgggttcagcgccgggggacgggcccctggggaggggtgcggggccgggggaccagaccctggggaggggcttaaggggctggaggacgggaccctgggaagtggggtacagggctagaggtcgggactctagggagggagcctgggtcgggcgcacgggccgggcggggcgcgcggtgggggagcgacgggtggagggtggggtgggatgacagcggcgacgcagccccggctgtttttgaagcggggcccgggcctcaccgggctgcggcgtccgactcgagtgagactctcccctgcggccccgccggaggcagggggctggcagggctgtcctggcgtggtcttctccgtttccttcctagcgattcctctcgagcctcctctccccctggccgcccctcgtctctcttctcttgggcgcattacctctctggcctatcttactgcgttcccgggtcattcatcacccatttgctcggttccattaagaaccagcttggagattaggtatttctgtctccttacttggcccccttgttgttttcctccaacaaggcacttcactattaagtgtagccaaatctgtgttttcgttttaaggtgatgttgacaagttgagctttccaagggcagagctacaccagatgccagagaccacataactatatcaggcacaaataatgtttttttccagtttacctagactttcagtctcccaccacgttgcttcatacctagaaatcatgtctaatttggttttttacccacaaacgcaaacgttttttaaattcccttttattgattgtttgattgagactgggtcttgctttgtcaccaggcctcagtgtagtggtagctcactgtgtagcctgaagctcctgggctcaagtgattctcctgcctcagctttccaagtagctgggaccacaggcgtgcgccactacgctcggctaattttttatttctattcatctaatctatgtccatctttattttcgtagagaccaagttggtttccaactcctggcttcaagagatccttccgcctcccttaagttcttcataacagtagctagacataagactccaggtgccaggccttgttctgaatattttacagagggttttttctcccccccacttctagcataaaagtaaaatgtattgtctgaagtgtcatgctttgaaataaaatagggatttggtaaaatatttgtaaaaatctggtttgtaatccaagttattcttcttccatgctacaacttttacgttttggagggaaaatgatagtttatagcctttgcttctaataaaacttgtttctttaataatttattaagcccttcctctgctccaggcactgttctaagccagtctttgtttatcttaactttcttaatacttcctgttccacagatgaagaaactgaggcacaaaaattaaatataacttgcccaagttctcacagctagaaaatggcaaaactgggatgccagcatcttttagtattttttgaaatactttatgctcactggggaaatacttccccagctcactgatctaatgacagacaggacacctgctgtttgagctgggcactgttggggcatttggagtatatctgtaaacaaaacaaagatccctgcgttttggttatatactgatttggtgagtatgttaggacgtggaagcccctacatttatttagactattttactgcgtcacctgtctcttcattgtgggtatgagttagaagttacaattttactattacagtttttgtgtattcagctccatcccttttttctccacagctaatttttttttctttttcttttttttttgagatggagtcttgctctgtcacataggctggagtgcattggcgcgatctcagctcactgcaacctccacctcctgggttcaagagattctcctgcctcagcctccggagtagctgggattacaggtgccaccaccacgcccagctaatttttttatttttagtagagacggggtttcaccatgttggccaggctggtctcaaactcctgacctcaagtgatctgcccaccttggcctcccaaagtgctgggattacaggcgtgaggcacttcgctggccctacagttaatcttaaatagcaaacgtgaccgttggtgacttcttacttctccaaccctctggtggagacattagttaatgagtaggaaaattgccaaaaagaatccgtacagagacctggtttctgcacagtaaagaattatgtctattcctgtatttgtttttgtttgtatgacaaagattaatggcaaaacttaacgaagtgtttttgggtggacattaaaaagagagggttcccagcgaatggaaagtgtatttatttctcatcctttatattttagaatcttggactttaatatcatttgtaatcagaaaaatagcataaacttacaaaatttaaaaatcactaaaatgtattaaaagctgacagcccgtatgtaattactccactggccatcaaattgtagaggcctttggaataccagcatttgcattttacttttagatactaaagagtgatatgtcacctcatatcttagcgaccactttgtggggttgtaatacactctgtattacacaatacaccagaataaggaagcttactctggtgtattgtggtgttgagagcaaacaagagtggggagagtatcacgaaggagttcaggcaggtttaacaagacctggcaggtccccaaaactaatcagtaagtttttgggcgaggtgggtagcaggggaaatggaaaggttttttgtccagctggagagttagtgaagaaggcagcacaacactcatagcggagctctgggttgtgggttttctttgttttgttgttatgatattaagatcagaaaacaaatcgtaaattttaagggatggacaggagcaccctctttggttaggtgccggaatccactgcagagttcacgccgttccccaactcctgccccttccactaatgccatcgtattgaagagttaagccaatgatttgtttttgaaaggttgtaagttcccagaatactaacacacccatgttaatcattttggacttctaattgtcttggcaatatacaatttgaagcaacaaaatgttcagtcttgggaaccatgtatctctgtcggctgtagcttaaagaacagtattcgtgttgtgaaggcgtttccagcccgttattcgtattcttactgaaagatacacttctttaatgggtcatctttaagagaattttaaatattaaaattattttccttatgacaagactttcagtatgtatatgcgtagaataagttaaggactttctgattatatatacagtacttcagattccagatttttaaaaaatcaattgatatttcattttaatttttccaaatggagtcggtttagtgttgttcaggactgctggtgttccctaggaatcttcttctgcctcctggaaaaagcctttattgatttgtaacactgggagcctaacagcaccaatgtaaagttctcattaaagcagtttccagatgctttttttccctgataaaaaaaccagagatgtttttatctcacttcatgctagagtgaatttttaaaattctttataagaatttattcttctagaaaaataaactcttctgttttctataacttaggttcgaaaacatggccaaaagaaatgccgagaaggaactgacagataggaattgggatcaagaagatgaagctgaagaggtaaaaagcagcttccctaagaatgatttcctgtttcttttgccttttacattcattttggggttcctcatgaagacttgtgacagaactaaaagacctttctaagaacatcatgaatgggagatgacaagaaattatatgacctgtacttagtgtagatatttattaattacatttctgtgacctctagttagtgtagaaatgtattaattacatttagatgtgcttttccactagtgcctgctccttaaatattctccttagtagaagcacttttcctcctgagtttcgtatacttgaagcattctgaacccatgtttgcagtaagccattttagtcatgactgaaggctgagttaagtgatgtagtcatgaacttagcacactgcccagatgtgaaagtggtacaccatcaccatcttggtctgtggtactccgtttccctaatgcttcttggaggcctgctttatttccttttcttaatggtagacctgagacccctaacaattgcatttataggaatagaattgagattggcctagttccttttccagcagaataaaaatggtctcccctgaggaaatctgatcatttttcccttataaacagtaggactgggcagcatagagagatcccggtctctataaaaaaaatttttttttttttttttttttgagacagagtctcaccctgttgcccaggctggactgcggtggcacaacctcggctcactgcaacttttatctcccgggttcaagtgattctcctgcctcagcctcccaagtagctgggattacaggtgtacaccaccacacccagctaatttttgtatttttagtagagacagggattcaccatgttggtcagactggtctcaaactcctgacctcaagtgatccacccgccttggcctcccaaagtgctgggattacaggcgagaaccaccgcacccaaccccccaaaaaattgttttaattagctgaacatggtggcatgagcctatagtcacagcaatttgggaagctgaggcgggaggtttgcttgagcccaggagttcaaggctgctgtgacctatgattgcaccactgcactccagcctgggcaacagggtgagaccctgtctaaaaaacaaagaataaaacacagctgtacttataggatgtgggcgaaggattacccaggtgccgaggcaagagactgaaggcacaaactgtttcagtataatacataaaatagttagaataagaatagtcataatacaaattagatacagagatgatcacgggcattatcaatcattagtataaacattactagtcattagcttttaatattactctttgttgtactactaatataaccaaggaataaccggcagatacagggtcaggtgctgaagggacattgtgagaagtgacctagaaggcaagaggtgagccagccctctgtcacgcccgcataagggccgcttgagggctccttggtcaagtggtaacgccagtgcctgggaaggcacctgttacttagtagaccgtgaaagggagtctcctttacttggaggagtcagggaacactctgctccaccaccttcttgtgggagattggatattgtccaggcttgccagtagtcatccagaggcttgaacccctccctgtggtgctgtgcttcagtggtcacactccttgtccacattcatgctcctcccgtagtcctggttcctctttgaagttcttagtagatagcagtagaagaaatagtgaaagttttaaagtctttgatctttctgataagtgcatagaagaaaatgctaacgtacgctgccttccttctctgcttcagctacctaaaagggaagggcccctgtcccatgatcacgtgacttgcttgaccttgtcaatcccctggacgactcatcctcctcaccctgctcccttgtcttgtatgcaataaatatcagcacgcccagccattcagggccactgccggtctccgtgtcttggtggtagtagtcccccaggcccagctgttttctctttatctctttgtcttgtgtctttatttcttacaatctctgtttcccccttcgaggagaacacccgcaaagcccagtagggctggactctacagtcgtaccttatcagcagtgtgttacccccaggccagatgactaaggaaatctgtaaccacgactttcaggttaacagcatagtgctaagtgaaaaaagaaaaatgttaaaactgcaactgtttccaagcttattcttagacggccatcttccttcttttggaatctttctggtactagtactttttttctctacaagtgtatctcctcacatatgtttagggaaaccagaatcccaaggatgtgagtgttttgacagggtcaaaactgatttggtgctttttaactaaaatctttggttatgggggtttttggttttttgttgttgttggtttaagatcttaagcacagttacattctgggctatagtaacatctagattaccatgtaactatttgcttagacattaaaatattcaggaatgaaagaactcccattcgaacatatgccaatgaaatgtgtggaaagattacatttagttaagtacatttaacttggggcaagtgcagccagatggtcccctctatgagtgtaggagcccgttaagtttaatatgatctgaaacaactataggtgagaatttttgcatgagaaatattttattccgaccctacagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggcaagttgggcaggactcatcttaaaaatcatgtgtatgttataaataacaaaatttatttatttatttttttgagacagtcttgctctgttgcccaggctggagtgcagtggtgctatctcggctcactgcaacctccacctcccggagggttcaagtgattctcctgcctcagcctcccaggtggctgggattacaggtgcccaccaccatgcccagctaatttttcatttttagtagcgacagagtttcaccatgttggccagactggtctcaaactcctgacctttggcctcccaaagcgctagtattataggcgcaagccattgtgcctggccaaaatttatttttgagaggccggacacagtggctcagttctagcttgttgttgttgttgaggattttgtcatctgtttggctttatcttactgctgcttaatttgtattgtattgcaggtgggaacattctccatggccagtgaggaagtcttgaagaatagagccataaagaaagcaaagcgcagaaatgttggatttgaagtgagtgcccccttacagctcttgctattaaatactcatttgatttctgggttgcacagcaatccctccgctgggagcaatgatatcaacaaatgctttcttaaaatacttattctttgatgtaggtcatgggagatagaaaaaaataagaaacgtcaggtctggaccttaaagagagcttatccagttgaggaaataagataaatatagacaaattcaagttgagtgacaatctggagaagaaaaatgagcaaagcaatacagaggtgggcgaagtggcatcagattggaggaagaaaggaaaacgcaaggatcttctgagagtcttgtctgctccctgcgattgaggccttggtagggggagccctttcactatactagaggcattttaggtgtggattttttgctagtatagtatattaaaatgattcattcctgtgctaagaaggatggaagatgagttgtaactcctaaattgaaataatgtgctgattattaagcagtcactccgcatctaagaactcgtccccagtacatcctctcccttcagatacattctagacccaggagagtgtggtcttggtggcctggacatctggtgttaggcaggagatgccgctttgaatatcctgggtggcagctttgaaataaacctaccctacctcacgttttgcagtgtttaaaacatcaagaatagactatattcttgggtgtctctaatctggaaatccaaaatgctccaagatctgaagctttttgagcaccaacgtgatgctccaaggaaatagtcattggaggatctcaaatggtcaggttagaggtgccgtgccagtaagcataatgcagacttcctgggagcggaaatacttactttcctgagcgttctccttaagggacatgcaagcttatttcccttttatttccaaaaaaaaaggataggaaaggtgtatcattcacactttgagaagcaatgaaaagaaattgttattacaaaaatattcattacattgccaaagttttgatcataaaatgtattaaagtttgaaaacgtaaggaagggagccaggtaggtggcagtggtggggaggcagtcagtaagacgtttacaacagccagtcactcagagcgtctcataaatggtggtatgtgttaatgggaaaacaattcaaattataaaaataaagtattcgcaattttcctaaaatatattactgtatataccaatatagtgtaattcgaggcagagatacgtaatcctacatgaaatcgattctcaggtggttctgggtagtcttgaacgtctttaggatgccatggctaatgtcataagtgtgtgctctttctctgctccattgcatgcttcagatgcatgagaggagcttcatttcctgacgttgtaaaagctctttcatgtagaattcaggttaacgggttgcactgccaagaaaggaagtaggtacagaggaagcatatctcagatccaagctagagattaggtcttgtgttttgtaattaattaattatattttgcttaaaaattgtatttcttatttgacaaaaattatatacttatggtgtacaacatggtcttattttcagatgcataatacatttctacctgcctgttgtacagtaaacctcttgaacttcaggtgttttttttttttttttgtctggtttgattttatgaattgccttgactggtgactaggtggtagacgtaggtgttgagctgagtgatatttgatggctctttcactgggaagatacatggggggagggacagtttaattaaggaggaaatggttggtcttggaaatgctgtatttgaaaggccttggtacactcaagtggagtgccctggaagaccactaggtatacaacaggaattatggcaaggatgggcacagctccggcagctttcgtcatgtgggggattgaggccatgggaatgggcgacaggaggcatgcaggtggagggtcctacgaggagtgagaaacaaagctcactgcagaagccaagggaagccattctgaaggaggggcagtcacctgtgcaaccgaaggaagttcaagaggtagaaatagtacagaccataatctacaacttaagctgaagggatgagggaaggagagggcaggagcccttgggcaactaagggaaattaagtgtaggtggataatagaaatccacagataattttagctgtaactcttagcctgaagttttcatatattaggacaattaaatgtcatgtcacccaccagaatgctgaaatgcggcttttcctaaatagtggattcagtagatctgctaagcactggagatgtattggtgagtaaaaaagaccaaaatcatcttgccctatggaagagaacaaatacatagtattaatttttcctctgtaagtgccatggggaacagtaaaaccaatgagggaaattgagggatgtggggctgtgtcagtgcccatggaggagcccacatgggtattttccctttttttttttttttgagacagggtctttgtcgcccaggctggagtgcggtggcacaatcttgactctctgcaaccgccgcctcctgagctgaagcaatcctcctgcctcagcctcctgagtagctgggactacaggcatgcgccaccacacccagctaatttttgcatttttgtagagagggggtctcactctgttgcccagggtggtttcaaactcctgggctcaagtgacctgaatgtctcggcctcccaaagtactggtattataggcatgagccaccacacctggccccttgatgaatatcttaatcaacttttactctcatttttctgaatatcttttttttgtttaacttgtggttcttgaatttttgttgtgattctagagccaatttactatcagcaatttctaaaatccctacaagtgacttttaactttgtgcaaaatcggaggctctgaaaagccacttaatggctttatagtttgtccatgaatcattgttttaaaatgacagctatcagtgtggtgggtttggaattttaaatgatgaaaaatcaaatgtagagcaacagaatctaagctctgtttattatgtgcattaaaactcatacaagttacaattttccattctttgcctcattttattgccttaaatatatcagtggtcagtaaacatctgaaattctgtagatgagattgaaactttggttttggaaaaacatgcagtaatatttaggctgactggcccatttagtaaatgaaggggttccagtttaatttttttttttttctggtgaaatcatggttataattcactcatgtggaaacttaagatttgtgaactgtctcttagatgttcggtctaagaagcagatcacttcctataatgtaatcacttctttgaacaacaacaaaaaagggcttctaaaaattgtggtgagtttatttagcaaagcactataaaccgaggaacctttctccaaaagttccaggggcagagaggagctttagaattcatacggaatgccacacatttccagagcatcttaggttagagatgtgagcaggctagcacaaagggaaaaggcctactagaaaaaccttgttaaaacaatcgagtttaaggaagcagtgaggaaaaggagagtaagaagttgtcccgggttgttcagctaacaggaacatgtagatttgagactcgatcatctaagtttttgtaggctgaaagcagttgcaagccacagatgttaagaaattaggcaaatggatatttttagttaacctaccttgatgtttttatcatttctttaggcagtaaatggtctttgactgagtagtacatgaagtatctttcatttgggatttagttttattgagccgcttcagtaattctgaggctgggtggtgggtacataggtttattgcattagtctttcttaccttttatgtcctaaaaatacacataatatattttttaaatgtccttcctgcctgtttcaggaaagcagctttgggttgcaaagctgttcttatgaatacaatcttcccatctcatttcttatttctgcttgtgccagcagtttgccttataacgctgactgcatgtggagtctaggtgctgtttagccaagatgctgttgtcactcacttgctttttggtaatagaaagtacacttacctaatgtgtgctcctccttcatacttcagtctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggtaagtagctcccatcccccagccgcctgtgtaagtatcatctatggaaaatagctttacaaagatgtttttcttatagctaccctgtgtcttggaactgtgtgagcaaaaccagggtgataatgaaagagatggaacttagggaggtgtcggttacttacagagtaagtgggtagagcacaggcttttgatccaaaacatctcagctttgttctcagctctgctggctaccagttgtgtgaccctggcctctaggcctcagaatgttcaattttgaaaggagagtggccctcagaattgacctagagtcgagagagaaaagaaaatgctatgtagaccctttgtgtgccaagggctttctgtgtgcctcgcaccaaactggctactgggaactcagatgcggttctccgtggccagggtgcctcccacgctaggtttgtttgggtatgggatgtgttgattgcctgatcctgttttgagggagtcagtcaaaaactcttggaattagcaacagagaataggatcacgggttaaaagcttggaaatgatcctgactggttgggttgtatttagctgattattctgagagtatatactgtttgattttaatttggcagaatgtttagtgtgatgtaaaataagtgttctctgttaagttttgttgttgttgttgttttttctaagttggagtcttgctctgtcaccaggatggaatgcagtggcgcgacctctgctcactgcagcctccgcctctgggtttaagcgattctcctgcctcagcctcccgagtagctgggactacaggcatgcaccaccatgcccagctaatttttgtaattttagtagagacggggtttcaccatgttggccaggatggtcttgatctcttgaccttgtgatccacctgccttggcctcccaaagtgctgggattacatccgcgagccactgtgcccggcctctgttaagatttttaactacagccatcccctagtatcctggggattggtttcagcacccccttggatgttcaagtcccatagtcagaccagcataactcttagataggaaaagtgagtgttcgtatccactggtttctcatccccagagtactgcattgagacagggtctcgctctgtcacctaggctggagtgtattggtgtggtcttggctcactgcagccacaacctcctgagctcaagtgatcctcccccatcagcctccccagtagctgggattataggtacacaccaccacactcagctaatttttacattttttgtagagatggggttttgccatgttgcccaggctggtctcaaactcctgagctcaagcgatttgcccacctcagcctcccaaagtgttgggattacatgcgtgagccaccacacctggctgaggactgcatttcacaggtgtagaacctgcaggtacagaggggcgactgtactttaatactgttcatcccaacaaccttggggattaagtgttaatgctgacctgctgttctaacagtgctgtttgaaataggcatccttttgtctactgccacaccaccctcgacgcgcccgatcacatctcagataggcgtccttttgaaggaaaagattatttttaaaatgtgtagagcaagcatatggtggttagtgttcttgtataaactttgacttgatctttattcatcggctttactgataactggttactaaattctactccttgaacacatactttttgagcggtcacaaaaatagggcacagtaggtcgggcgcagtggctcacgcttgtaatcccagcactttgggagtccgaggcgggcagatcatgaggtcaggagttcaagaccagcctggccaacatgacgaaaccccatctctactaaaatacaaaaattagccgggtgtggtggcgggtgcccgtaatcccacctactcgggaggttgaggcaggagaatcgcttgaacctgggaggcagaggttgcagtgagccaagatcgtgccacggcactccagcctgggtgacagagcaagactgtcttggtgtggggggagatacagtaaaagcagaaagtatgaaggcagagtggcaaaaaaatctagatgatttaatcaaattaggctaaataaatggttcaattattaactttctataggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtaagtaccagctttgtcgttgagtcgaggtttgcataagattcttgtttcttgggaaacccagagactttgattccaaatatgagtctggattcacattgagacgttgttctctccatgtgtgatctcagacagagctaatcagcttctctgagtttcagattcctgctttataaaagagtaagacttttgtagggttgtttataaggattaaaaataaaatgaatttgaaaacacctgactttgaaaagtctcaaacacacatggtttagcatataaaaaacaagtgaattaaagacgttttttgaaaattgtgtttttggaaaagttcatcaagttcatcatgaatgtcccctgaattgatttgtacttaggagatctcactgtaaataaagtcatgtggcaaaacagtacttgactatacattacaaatgtagacttttcatagccatagagaagaaatcaacattgttttcctcctgtgggtttggaggcgcctcctttccagagcgtggcagtggtgtctaagtgatgtttcctgtgtgtatcgtcagtgccccagacaaggcacaaggtctgggccctccagacctctgttgttagcttaaaaagtggggtgatgtcatgatgctgcttcctcacatggtggttgtgaacaggtgatgtctgtgaagacacctacttctaagcagttgaaagtgaggccaggtgaggtggcccacacctgtaatcccagcacttcgggaggccaaagtggaaggctcacctgaggccaggagtttgagaccagcctgggcaacatagcaagaccccatctctacaaaaatttttaaaaattagccaggccaggtggtgggcgcctgtagtcacagctactctagaggctgaggtgggagtatctcgagctcagaagttcaaggttgccatgagccgtggttgcatcactgcactccagcctgggcagcacagaccttgcctcaacaaaagaaaaagtgtacttctcagacatatggacatactgatccttgaggaagaaaactgcatttgccaatttgcctctgaaatattacggttttctatcaggagtctagacttccattactgttttgccttgccctgctttcaagtatatcctcaggcacgggccctctgggcacagggtgaaataagggtctccccttttctttcttctctgcctcccataaataaaacaaatggggagtctttcctgaggcaggcactggggatttgaatcgagtcccagtggaggcaggatgcccctcagtgagcgcctgttccttgtcccttggttatcacagtttaagcatcagaagactcgggagattggagggataagacggacagtcgtgtgacctaatcatctgagcatcacagttgtttttcttagaattgctttttggtgagtttttatgcaactgccgttctctttaagaggatccttttatatatgtggggttttttatttttttgagacagggtctcgttctgtcacccaggctagtagtgcagtgacgcaatcatagctcactacagcctctacctcctggggtgaagcaatcctcccacttcagtctgccaagtagctgggtccacaggcatgtaccgccacacctggttaacttttttattttttgtagagatggggggcgtctcaccatgttgaccagactggtgttgaactcctgggctcaagcgatcttcctgccttggccctgcagcgtgctgggattacaggcgtgagccactgtacacagcctaatacatgtgtttaaatgatggcctaggtctcccgtgtttgggagaccccgttagtggggatacctttggtaccagagcagtgacccatgtggcaattcagacaaagcttaaattacttacactggggctttggaatgatttttctgacaacttgtcccctgttaaaaaaaaaaaaagtatttttctatctttggctattactgatacttgtagatgtagtcacaggaatattcaggggtgaaggtgttaaaaactcatccgagatggaattttccagtgggtaatttgcatatagagtgttgattttttttttctgtcataagcatggagatttttccattttaaggttttctatatattggaagttattttagaattaagaggtatgttcccattaaaagggattcttatttttcacaaaatagttaaaatcctgcaggtactcccttctggcatcccccccccccattaagtgtgcattttagtctgtcagtttacatggagtgctccggtggaggtttagggtgttacgtaacaaaacttcagtcacttctttaagctctggattggaatcttactgaattattgtcatttttataaaaggtggagatgaagaagagaatgatgagccacccaaagtagtagttaccgaagtaaaagaagaagatgctttttactccaaaaagtaagaatccccacaacctgctggcgcatgtgttttgcaggcatggtggcatgcttcaggctggagaatgtcctcacggcacttgactgagcttccagtctcggggtcaagctttgcctgctctcaagtaacaggaagaattcttggccagttattaaatccagttctagaaatgtcctggtgggcaggtctcactcttttctgtcactttagctcttttaaagtgctttagagacaggatcttccatgatcttcccaaccccatcccatcccatcccattccatcccgtcttctctccctgtgtctttctccctccccttcctcctccccaacaaagaaatcgcagagtcagtcagtgatttcaggtttggcctcagaaggcatctctcatcccttcctggagacttggttggcctttctggattttctcatagtcaaaaagttaagcacagtaaccgtcccttcctgttgaggacttataaaaactttcatcttcctttcaattaaatgagattagtttttacaaagatatttgctgaaaaaacatttgtgccatttcagaagctttcaaagatgtgtttttgtaatgcaaaaatttccgaataatgagccagcagttttccatgaacaggtcaccacatcctgtgggattcccaggtgttagtttcaagaacttttaaaagaggccaacaatttcttctgtgtttaaatttcattactcacatgacataaaggagtgacccaactttaagattttttttttttttaattagaatcaaatgaggccaggcatggtggctcatgcctgtaatcccagcactttgggaggctgagacaggcagatcacctgaggtcaggagttccagacaaacctggccaacatggtgaaatcccgtctctactaaaaatatgaaaattagcctaatgtggtggcgcacgcctgtaatcccagctgtttgggaggctgaggcatgagaattgcttgaaccctgagaagcagaggttgcagtgagccaagatcatgccactgcactccagcctgggccacagagtaagactgtctcaaaagaaatacataaatcaatacatgagccatggttttgtattaataacctcaggagatgcatagcacaggaggctgggaagatatttgattactttgttattagttagaccctacccaagaatgttttccaaatttatttaaaaatgttgtgcaatcaaaaactgaaagagccttgaggtttgttttttttttttttttttgagacggagtctctttctgtcacccaggctggagtgcagtggcacaatctcggctcactgcaagctccgcctcccaggttcatgccattctcctgcctcagcctcccgagtagctgggactacaggtgcccgccaccacgctcagctaattttttgtatttttagtagagacggggtttcaccgtgttagccaggatggtctcaatctcctgacctcatgatctgcctgcctcggcctcccaaagtgctgggatacaggcgtgagccaccgcacctggtcgaggagaatttttaaaataagaaataggccacaaaaaaaaaaggagggagaggtgggcgagataggacagggtctttgtcctttatttgttcctgtctttagaggaccagatcggcgatcttgagctcagggccaaaggagcagaatggtaggggttgggggcggggcggggggggttggtgttgagccctgattttgactgacttgagaacacagtttcagaaagtgttataaaaagtttcatggggcccactgtttaatttgaaaaaatggggaggagttttaaaatctctaagcagattttcttattctggtttttgctcaggctctgtttggatcaattaaagatttatcctgaagcttcctgtactcatttaatagagattttccacacaagtgtgaagagtggttgttagaaaactgtgtgacttgattcgtccttgaatgcttgatggtccctattatttttctccataggtgtaaactgttttacaagaaagacaatgagtttaaagagaaaggcataggtactctgcatttaaaacctacagcaaatcagaagacacagcttttggtgcgggcagacaccaatttaggtgggtaccttttttcagttggcacaaaatcatcatcacatagtatataaaagcgtttaccctgctgactcaaggttattaatatgtttttaaacagagcgcattcaggccaaattcatcctgtatttacttatttatagttttgagtcccaggataatagtgtgtaaggaaacataaatgtgttagaagctgtaaacaaaatgatttttcattttcctttgtgttagaaatgtgactaagaagctagagattagaccatttaatgaacacccaagggaaattaaccttttaaaggaatcctttttatatagcaagtaatgactaactgattgctgtccatcctcagttttaacctgaaaagagtccactgcaaggatcctagtgcccggaggaggaggaagacggggcaggcctgcggtggagcgggcagtagtggtagagaacagggggctgtgttgcagaaactccagggaggcatttttctttcccgtgggcttgactagggagtaataacatggtcgtgtcacttttgcccagggagctgtgccggcctgtgacagaggtgtcctttgtccgtgtggcgcagtgaagacactgggttgtgccaccgtgttcttccttcagtgcaaagacggacagtgttgagagggctgacggttctgagcgaggctgctggctctgagagaaacgctgtgtgggtgcagagacccgggctggagggaggacggaaggccactcctcacagtgagggcaagtcctccccgaggcctcccagttctcagggaaccagtcctgattttgtgctgtcctgttggctccctgtcttagatgtattaagttatttcagcatttaatgtttagcatattacagactcctttggtggagctatagcttctataattttgatgggttttgtttgtttgaatgcaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagtttttttgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagcgtatcaatttgctttcccaaaggctcttccaacccgtgggttttggggtccaccgccaccaccagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtgaaggagttttttggcttcatagtttctattcatgaggtagtgttacttctttatccccctaaagacaaaatgaagataaagggggattgccaggaatgggtttaaaagcacaaatgtggtagcttatcatctacaccatggagagtgaacccttacgaaatgaaagtcaaatgagaccatccgagaaaaagatgcgcataggcatttgtaccatgatcaaccccacgcacatgaaaactgtgaccaagtgacgtgcctgggagctttgacacacgagccgtgtgaattcactaggaaacatgtaataaagtcatggaagagaaaatcgtgtgtaaattttgcctttaactttagaccgcagtatattataatacatttgatatctgaaatatctttacttttttaagagtaagattccatatgtctgtctggaagggagccatggttattcacacgaatatccctgtcacttctccagaggtgtcaggtaactaacacgagcattctttgaagactctgggcacatgaatgatacacagaattgaatgtttaaatttccactttgagtcctcatgaatcatttgagactagtaccagctgatcttgtgtacaggctcagggtcagtgcccaagggctcccgcgtgtgtgttctgatcttcagtgcgtagcacattctccatttagaaaagagtggtcagaataattgtggacggtacagtggctttttaaaactacagtctttaggtgtaaggtttggcgccgggagcaattttatgatcaaatatgatgaactcctaagtcactgaggtgtgattgggccaatgttggcatgaggttcttgctctacttccagtgttttgattccactgggagaatttggcctagtgtgtggctttggatgaatccgtgtagagagaggtgagcttgtcctgttacagatgctgtcagacatagcgatagtaggcacctagggaggaagtggccgttagttttacactgactttttaagaatggagaatgcacgtgggtttctgttgcggatgattcatagtaagcaagcggttgatgctgttaataccggccccacccgattgacattaagtttattcagcttttaaaaagatgaagaactaaggggaacaaatttaagtttgttgcaacttagccacacatgcttccctggtaccagctggaatcagcagctcacaggcatcttcaggacacttcagtgtatatgacacagtactttgttagcgtctgcgtgtgtatggaaagttgacaaaaaatggcatgaaaagatcatgattggattttcttttaaacctgcccttctgtaaaaaatagtttatatatttttaaattagtaggtatgtgtggcttccttttttcctaacattcccagcaaatttttgctgctaagactatcactgttaaagtgaaaattacagggaaaaatgtgatgaatataccgtaactcaaaatgtgatattttcttaaaatcactcttttatgctttaggaactggt

SEQ ID NO: 17135 - DNA, 51022 bp, Human
gaaactgttgggctttgctgtggcacgaaacttcacccttacccacgccactgcaggactcctcctgccagcctcggggagccgggtgagagtcagaagggtgggtctaccttgcactgcagaaagcagctctgagtttcctggaagccctggggaaaagggaaagcccagaagttgtcactgggggacatggttctaggtgagacccccctcctcctggccttgtggaatggcctggctgagccctagctcattcgtgcactgaccttatccattctggaatgtttctgcaagtttcccctcctcccctgctgagaacgggatggagcatctgaaggacgcatagtctagaagtgcttacagtggctgatgactgatagggtggtttagcaaggtgctgcctcacccagcagacagcagccgccctctgggccaccccgagggcccagcctggaagaagaatgtattcaggcagggcacccacagttgtgtgtgcggaaacgctgccaagcccagtgggatttaccctctaggggctggaaagccattaggaaggaaaagtggtgcttcttaaagcccagttttgtaacatcctgccgagaggtgaccttctgcccagcagctggggctgtcgtgctaatgctttctggcatttgagtcctttagaatgaggtccaagtatgtgggcacctggcacccggccgctcctcccttggggcacaatggggtcttctcccttccgtgagctgaggggctgggagggtgcccactggggctgtagcctgggctggggcatggggcacaagggcctgtgtgcccagctcatttgggccgtggcctggctctgagggtgtgggccggctgcttggagcgtgatcctttcatctgccctttttgcgagtgggagataagatggccaggctgcggttactcctgaacctgtgctctctgctttgccagtcctgtcctcaccagacttctcacaggtccccgtttctgtggaagaggggatcttgtggtaagtcaagggcagaaaccatcaccagcctcggtttcctcaatctgtagcttgaggcttatgtcccccctcctgcccctttgctcccaagattaaaggagaaaacacggatgtgggtcacagaagctggtctagaaatggtggtttttaggctgggtgcggtggcttatgcctgtaatcccagcactttgggaggccatggctggccaatcacgcaagttcaggagttccagaccagcctagccaacatggtgaaaccccatctctactaaaaatacaaaaaagtagccgggcgtagtggtgggcacctgtaatcccagctactcaggaggctgaggcaggagaatcactcgaacctgggaggtggaggttgcagtgagctcagatcgcgccattgcactccagcctgggcgacagagactctgtctcaaaaaaaaaaaaaaaagaaaaaaaaagaaaatttttttttccttcttacttgactcagctcgttgcattttgaaccccctccctgtttgcagtctctcctctggaaagagtcatgtcggctgttccctgacctgctgggctgggctggccggcagcatggccgtgcctctgtcatcaggggctgtctttcttgcctactggactgtgaaggcagggaccctgtctggacagggaccgcatcagcatctccagcatgtggctggagcagggatccatgtgtgcttggatctcaggggctgagccgcagccctgtccaagctggattcagatgggggaggattcaggtctttcttctaggaaggagtggggtgtggactcgcagctggggtctggtggggttttcagtactggtttgcagagtgactaagggatgtgcccccagcctgatgctgtcgtcaagacagaaggacgtgcgtgtcctggtggtgcatctgggagggccctccacccgctgagtggtgagccacctctcagcttgttctcttccctgcacagtggacgcggatgtcctcctggaggcctgctgtgcggacggacaccggatggccactcatcagaaggactgctcgctgccatatgctacggaatccaaagaatgcaggtacgtttgccagtggccactgtttcactggaacaatgttcctttagagaaaagtgggggaggaagggacagtgtgtgccagacctctcgggagaggctggacacccaggcccggatccatccaggctgcgggtgctgcagtgggtgactcctgcctccctcctggcaccggcctggcaccgggccttggctcacccttcctgtgccactctgtgattgtcggggtatgtgtctctttcactgggctgggagcaagaagatctgggcttgcagctgtgggcaagtcagttttctcttttaaaaaaggggggacagttgtgggggagcaaaggagatgatgtgactaaagagctttgcgagtggaaacacggaccacctacagaccccaaaaatgccaatgagccggcgcagagtgaagcgttccaccagccggtttttcagcttctgcagcagccaacatctggatcgaccgtttttattcttctctccctacattgactccagctctctgaaaattctgagaccgtgtaagcttagaataaataatgagaagccgggcgcggtggctcacgcctgtaatcccagcactttgggaggccgaggtgggtggatcacctgagatcaggagttcgagaccagcctggccaacatggtgaaaccccgtctctactaaaaatacaaaaaaaattagctgggcgtggtggcatgcgcctgtaatcccagctacttgggaggctgaggccagagaatcgcttgaacctgggaggcggaggctgcagtgagctgagatcgcgccactgcatttcagtctgggcaacaacagcgaaactctaactcaaaaaaaaaaaaaaaaaggaataaatgatgagattaggtcatgctgatcatcatcataaaaataatagtgaaaaccccagaatgcccgtgtggagcacctactttctgtgtaccgtctgcacggacagcagccagcctggccccgggaaggacaagggctggggaggtggaccaacctggttgggtttcaggctgggtgacctgagccagctcaaaggcaccatgatacctcctttctggggttgttataatgatcagagatcacccgggcgcggtggctcacccctgtaatcccagcactttgggagaccaaggcgggtggatcacctgatgtcaggagttccagaccagcctgaccaacgtggtgaaaccccgtctctactaaaaatataaaaattagctggctgtggtggcgggcgtctgtaatcccagctactcgggaggctgagacaagagaatcgcttgaacccgggaagcggaggttgcagtgagctgagaccgttcattgtactccagcctaggtgacagagtgagactccgtgcccccaccatcaaaagaaaaaaatcagagatcacctatgaaatcagcaccacaaagccagactgtggcaacgtattggttttctaggactgccagagcagagtataaggggcagggtggctcaaccaccggttcctcatagttccggaggccagaagtctgagaccgaggtgtcagcagggtgggctccttctgaggctcctctcctgggcctgtagatgccctcttctccctgtgtcctcacacggccctccctctgtatgtgtctgtgtcctgctcaccgcttcctcgaaggacaccagtcctttggattacagcctgccctaacaacctcatttaactatgtcacccatttaaagtcactgtctccaaatagagtcccattctgagatactgggggttaggacttcaccagatagattttgggaagacacaatttagcccataatagggagccactactattaatacttagtgaaataaaagaaagtgaggcatcagcccgtgtaacccctcaacgtgcaggcagaggaactgaggccgcagattcagcagcactctgggccttgcttgtgaatggggattttagtcactatcaaatgtattactgacttctactcactaatgtctttgataaattttggagttatcttttttctttattttttgaaactgagtcttgctctgttgcccaggctggggtgcagtatgttgatcttggctcactgcaacctccgcctcctagattcaggcgattctcctgcctcagcctctcgagtacctgagattacaggcacacactaccacaccaggctaatttttgtatttttagtagagacagagtttcaccgtgttggccaggctggtctcgaactcctgacctcaggtgatcctcctgccttggcctcctaaagtgctgggattatgggcatgagccactgcgcccggccaattttggggttatctttaatctccattgagtcccagaggacaaacacattgccttcttagaaatttcagacatacattagatttcctggaatgtaagaaataccatcagaatggctgagagggcattccttctctctttaagtgcgggtgcaagtccagactcctgggtatcgtgagtttccatatgacagtgtccctgaaacacgtggctcaatgcccaggacaccactccagggtcaccagatgcaagtgactggcccattgtgtcacttaggccccaggaggcccattgactcatcccagtggacacacaggccaggggccacatacctgtcctaggctgcctctcaagtgagctactgagctgcccagctctgcctgcgtcactgccctgtggccccaggtgctgtccgctgccctccagcccttcctgtgtgcttcccctttaccctgttctcactggggtccaaaccccacgcagcctgtgccaatcagaggccaagcctgggctccaggtcacagtgagacggagcccacataagggttcaggaggcagtcactgatgtggctgtgggggtcctcgggtgagcaggaccccgccccagcctccccaacctggggaggtcagagctcctgtctggttgaggcaagggctgtggatgcggggtgtggccagcagtgcagtgatgctaatgaagggattttctaatgagttttgtatagattttcatttttaatgaaggcagggaagggatagggcagatcagaaatcaaatcttatttacaagaatcctcttaatagtgatatttaaaagatgcaaaaaacagggatcactgaccacctggtttgtctgttgtgttagccagctctttttttttttctttttgagatggagtctggccctgtcgcccaggctggagtgcaatggcgcaatctcagcttgctgcaacctccgcttcctgggttcaagcgattctcctgcctcagcctcctgagtagctaggagtacaggtgcctgtcaccatgcgtggctaattttggtatttttagtagagacgggagtttcaccatgttggccaggctggtctcgaactcctggcttcaagtgattggacgcctcagcctcccaacatgctgagattacaggcatgagccactgcacccagccaaattctcttcttttgaagtggctttctgtgaggctcaccagctgaagtaaaatcagtttttgttcattcaacaaatctttattggttcttgatgctcaggaagaggcaggatgaaagccatgagcaggcaggcaagcccaggccagccctcctggcagcagtcgagggtgtgaggccctgagggtccatagggcccaaaggagggggtatcagctccctgagtgggtgagaggctcagagaggactgcagggagaggccgacctctccgcaaccatgggctgtagccaagcaggggttaagcagcctgcagcttcaacaaggacgtgtttggggtggtcagaagatggcagctttgatgttttcccatcatgaatcatcttgactctaggtctccaccaaggcccgacattccttgggatccagatctaaatccacctaaaactttggattagattaaacccacatgtccttcagcgtcttttggaggaatctggacacatccagtgaaacctaaagcaagtcccaagctgacattttccagcccagcatttctctaaccccttctttattttgcaaatctcactgagagcctgctaggtgccaggctccgttctggtgagtggggatcaatcggtgaacgaaatatgcaagtcccctggcctcgtggaggcggcattctataggggatgcagaatgcaaagaaagtaataagtccgtctgatggtttgtaggaaggcaggatgtgccgtgggggaaacagggaggcataggggcttctgctcatggtgggtttataattttagagccgtggggttggcctcactgtgccaggacctgaatggggcgtgggcagtatggaaagtgggaagagcatcccaggccgagggaacagccagcgcaagagcccagaggagagggtgtgtacagcaaggcggccagggtggctggagtggagccagcaacggccagtcccagggaggaagcaccagatacaagggtaaccaggtggctgagggggccatgagatagaggctggggtgttgggggtgagcctgaggcagctggacaccctgaggtgcctgggacacttgattgcttccaccttttggatgttgtaaataatattgctgtgaggccgggcgcagtggctcacgcctataatcccaccacttcgggaggctgaggcgggcagatcacttgaggtcaggcgtttgagaccatcctggccaacatggcaagatctcatctctactaaaaatataaaaaattagctgggcatggtggcaggtgcctgtaatcccagctgctggtgaggctgaggcaggagaatcacttgaacccaggaagcggaggttgcagtgagccctgatcgcaacattgcactccagcctgggcgacagagcaagactccatctcaaaaacaaaacaaaacaaaacaaaaaacaacaacaaactgctgtgaacatgggtgtgcaagtatctgtttgaaaccatgcttcagttctttggatatttacccagaagtggaattgctgggtcctatgattattctatttttaattttgggaggaactgtgctccacggcagctgcacccttttccattcccaccagcaatgcacacgggttccagcatctccacatcctcaccaacacttgtgattttctggctagccaatagtttttgaatggatgcacgcatggctggtggctcgctctggcagtttagtgaaacgccgttatttgcaaatccaccgaaagcatgagtgaaatgtgtgctagctcagctcggtaattccatcctggagcctgaaggcagttttgagacacacgggcagccgggttcagacctccagtcccccagggaaggttgggggaaggtgcactggcagctgccatttttgtgcagaggtggcctggctggcagtgcagggaagctggggaggcccccaccctctctcctggaggcacgagttgggtggctcttcctgcccttgctggctttggctggagctggggttattttgggtctggtcaggggccacccgtgacacactcctctcctgctcattgcctttggagcccgcccacgccagcccctagctgtcacagcctcatggttgtgttggaggagctgattttggcaggtcgaggacctctccccagagccccggcagggctgggaggtgtgggctttgcagctaggtgccactgcagccaccatccctccctctggggccttgggcaggctacccaacaggactctcagaagctgtttgctctgagcctggaagatggaacgagcactgagaagagcttgacctgataaaggggtggaaggttgggcccagagtcagccccccgccgctttttggttttcaaatcagcaggaacattgtgcgggtgaagcctagtgctcagaggagtgacgcggccactctggtgacaaaactgggcctcctggctctgactccagacaccatactacattctgtctttctttttttaaaaaaagaggccaggcatggtagctcacgcctgtaatcccagcacttcgggaggctgaggcggggggatcacccgagctcaggagttccagaccagcctggccaacacagtgaaaccccgtctctacaaaaatagaaaagttagccaggtgtggtggcgcatgcctgtagtcccagctactggggaggctgaggcaggagaatcgcttgaacccgagacgcagaggctgcagtgagctgagatcacactactacactccagcctaactccatctcaaagaaagaaagaaagagagaaagagagaaagggaaagagagagagagagagaaagaaaaacagagagaaagaaagaaagaggaagagaaggaaagagagaaagggagaaagagagagagagagagaaagagagaaagaaagaaagagagaaaaagaaaagaaaagaaagaaagagggtcttaccatgttgcccagactggtctcgaattcctgggctcaactggtcttcccacctcatcctctcaatgtgctggcatgactggtgtgaaccactgtgcccggccaagcctttctaactaaatgctaattgagctccttctgtatgccactggggcactgtgtatttctctctctgtgtctgtgggagcagggaaggggaggctcaaaggtgagagcacccccacccccgaggatctcgtgccctgggccccctgcgcacagagccttggcccagcccacccctcacccacaggatggtgcaggagcagtgctgccacagccagctggaggagctgcactgtgccacgggcatcagcctggccaacgagcaggaccgctgtgccacgccccacggtgacaacgccagcctggaggccacatttgtgaaggtgagagccaaagaccatgtggggtcgctgcccgtccccactagtcggcagacccaggccctcccagccaagcggcactgtctgtcagcgctccctgcctcaggccacctttctttgtgagcagctgggggttcctgggccaggagggaggtggaaaaccccactgtttctccccctccactgtagccgtaaaccccggaggacacctggggccgagtctcccacgaggccggggggtgaagtgagctggccttgccctgagaaccgcctgtctccaggcattgggcagatgcagaagtcaaagcagggctcctcctgggcttccagaatcttcttctcaattcagggtcggcaccctcaccctacccaggaggctctcaggcttctctacccacagactcgtcagggtccagaggtaaaaatgggccctcactaagacctctgataagatctgacctctataacgaccctaaaagaggaaactgaggttcagagaggcccagcctccaaaatggcctctctgcagtcctgtcagggacccagacgggatcctgccctgaaggtaagctgtgaataaatggcatagtcctcttccctgagtgctcctaggaccctacgtgctagcaggtcactcaggaccgctatggccgtggaagggctgtgtctttgcaagaggtggaaaggtgcctgacagcattgcctacaggcagtaaacccaaggtgtccaggccatccctcccttaccacccagccagcaaggaaaacaagcccggccaggaggaacttgggcctggaggagctcgggtttggaagctgggcttctgttggaggtgccagatgacgaaaatgcattccctggaagaagcttcccgttcctagttaggaaggtgatggaataattttaagaagcaagaatctgaatgaagtctggattccaggagagggtgtgggagctcctttgtggggattctccacatagattgggctgtggagggactccgtgtggaggagttgggggtcccgagtcccctgcccaccttggcctgtgtgggctttcacagggcagggctctggcccaggagagagctgggtggggtgatggtgggggtgcctgggaaccaggactttgggcgtttcatgactgcccccgcaccctcccacccaacacccaatgcagggctgggccttgcagatgccgtcggtccggcacacagctgtgcccatgtccccagacttgagaggtgtggaaaaagcacagaacattctagcaggagtgggaacagatcgctctggcagatgagcgacttgtgtttccaggaaggattactcacaccccaaaagatggatgaggtgactgatgctccctacactttctggcagcggagggcgtagaataagcagcctggaagacccatcagtgccacataactgaggcaaagctacacctcctggctcctgctggggactgtttagaaagttctgtgctcctcttaggataaccacttaataaagactgaaggagggcttttcgtgtgtcagggcaaatgttgcttctgggactcaggtgtgaggccacagggacttggaagtaactattgggacctgggcccaggtggcagacagccaccctgtcctttgaccttgcttgatgactcgtcttgaagttcctgtgctttcaaatgcacggtgcaattcctgctgccagaacccctctaactcaaaaacggagaggcagcatgcatgtgtgtcatttttccgggcatggtagagaaatctcagaccatgcaaaaggaacagaactttggagctggtgcatggtgctataagaagctccctcttcctggatgtgtgcgagcagagccgggtggtctctgggcggggcagggatgttgaggggtgcaattgcatgttggggtggggaggggaggtggatgccaggccctttaagcttcctttcaaaactgggacctagatgatttggagtagggggatggccttgctttgctatttgttgctgacatttagaagtggtatctaagccagacttgagtcatcactctacaggttgtgtggacagggggctcagagaggcctcccctgaggcctctcgtggaccccgctgggctgtctgcccgctcctccatctgggatctccacctgtgtttgcagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacgggtaactttcccccttccttccctaatgagcagtgtattaaggttctccgggatgtgtatatagagcgagagtggagagagagagattttaaggacttggctcatgtgatcgtgggggctggcaagtccaaaatctgcagggcaggccttcaggctggagccccagggaaggaggggcattgcagctggagttcaaaggcagtgtgttggcagaacgccgccttccccggggaggccagtcttttttctctgaaggccttctgctgattgagtgaggcccacccacggtatgaagatgatctgcttttctcagcatcaacagacttacatgttaatctctttttttttttgagacagaatctctctctgtcacccaggctggagtgcagtgcagtggtgtgatcttggctcacggcaacctccgcctcccgggttcaagtgattcttgtgcctcagcctcccgagtagctgggattacaggtgtacactaccacacctggctaatttttgtatttttagtagggatggggtttcaccatgttggccaggctgatctggaactcctgacctcaggtaatccacctgcctcagcttcccaaagtgctaggattacaggtgtgagccatcgtgcctggccaatattaatctctaaaatatagcttcacagcaacatccaggctagtgtttgactaaatatttgagtaccataccccagcccaattgacacttacgatgaaccattacaggtaacacgtgcatccgtgtcaccattgccttaactcagcacggactgactccggttgtcggagccattcatgtttgtgaccttatctgaaagccgctgtcctggagtgacgctgagtgcttggagtctgggatcggacaaatctgtgctcccatccgggtcctaatgtgtaccttggtcccctcatctgggaagtggggatagttgcagtcctacttcatcaggtgctgggaggatggagtgcgagattgggtgtcaagggttgggtagagcacctggccccataaatgtctgccctcaccatctgcccttgtcccttcagctgcccggggcagcatgggtggctggccttgctcccacttcttgggtgagggtctgatgctgaagatcgcacagccgacacgtggaggagggagagcctggccttccacctcctggccagtgccctctccatctggagctgacgatgtatgggcgagcagctgggggccatcgctggctaatagctggctatgctctgtcaaatcatagacacttactcagcaaaggggcatgtgaccccaagagcagcttcaagagcgctctcagctgtgtgcccccccgttctgtgtcctcgccctgcatttctgtgtggttcagttacagggttcaggagactttgtggctgtccagtagcctcttacacttaggccacggtttcttgtgctgtaacagaattaacctggaagaaggcaggactccgcctgggccaagcttgctgtgtagttttcggcctgttccctcctctctctgagctttgcccccactctcctaaaaaataaaagaggtgtgagctgggcacggtggctcacgcctgtaatcccagcactttgggaggccgaggcaggcggatcacctgaggtcaggagttcgagactagcctggccaacatggggaaaccctgtctctactaaaaatacaaaaattagctgggcatggtggcgggcgcctgtaatcccagctacttgggaggctgaggcagggagaatcgcttgaacctgggaggcggaggttgcagtgagccgagatggcgccattgcattccagcctgggtgacagaacgagactcagtctcaaaaaaaataataaaataaataaagaggtggggaggtgccggaaggggcgaaagggaagaaccctcagacctgtagtctctaagtcaaggtaatggctgtagggtcctgggtgacacggaacctttcacttcttgttcttaggttttcaagtccaggctgtagggcccctggtcacagaggacccgggtcacccgggactcatctttcacttattgttcttagtttttcaagtccagggccccatggatgccactgagatgatttcagatgttacagtcatcaagagggattggggccgcattctgcctcattccttggcttttgaaatcagagacgacattttcactttaaacaaacccaaaccattcctgctggtggaggatttctcctgcatctcgggggtggattttcactgatttatgtctgcagcgtgagcagtctctgggcttttctgcagctccagatgttagatgttttatctctccgtcttttatctgcttcagtccttgccccagactatcctcgcatgctccctcctctgggagggcttcctgtcttcacagccgcaccttcctcccactgctaccagtgccatggacccactgtatgtttcctgggggccatgcagaaggtccccagaccagtgctggcctgcgacaaataagtacagaaatggagaataacccttttcaaacacataatagcatttgatagaatcaatcaggagactcaagtttttactgcgtgcattgctttagacttggagggcgtgtgttggttgttagcaaggctgtgactgcatttgctgagatggtcaagtaatttggactatgggaatatcacccagcatgaagtcaatgattacaggcctttgtgtctgtggtctttctgttataactgatcttttttttttgaaacggagtctcgctcttgttgcccaggctggagtgcaatggtgtgatcttgactcactgcaacctccgactcctgagttcaagcgattatcctgcctcaacttcctgagtacctgagattacaggtgcatgccgctacacctggctaatttttgtatttttagtagagacagcatttcaccgtgttggccaggatggtcttgaactcctgacctcaggtgatccgcctgcctcggcctcccaaagtgctgggattacaggtgcccgccaccacgcctggcctataattgatcagatatcaattatacattttcaagtgtaattctagcttaaagaggataaagttaatacttagctgtttatataagatgttcaaatgggcattactgcctgatagtgacaagaagagagaatgttgggagtttcttttaagataagatgggtgtttggataaatgtctgacttggtctttttcccccttagataagatcattgaggttgaggaggaacaagaggacccatatctgaatgaccgctgccgaggtgagactcgggcgtctcccatcagttggtatttaaacaaaccccaaggggccagcaaggtggctcaggcctgtaatcctagtactttgggaagccaaggcaggaggattccttgagcccaggaggttgtggctgcagtgagctatgactgcacctttgcactctagcctgggcaacagagctggaccccgtctcaaaaacaaaaaaacaaacaaacaaaaagcaaaaccaaggaatctcggtgctgatctcactggaagttggaatccaggttttgctttggtttaccctgcaaagtaccctttggctgggagccagccatgagccacttccaccctgaggagtcgtggactcccagctcctccttccctttccccttccagatctagggctggctggggaggggaagggtgggcttaccaaggaggggccctggtgaggccctgctggggagggtggcccaggcccagggccagagctggtgtggaaagcctgcacgttaccgagcccccaggccttgtgaaggtgacagaggcctccctcaggctctcaggggagaggagggggctcagcgttccctgcctttgtgcccctggagccccagccacggttctgtcaccattggtgatattcatttgcctcacagggagatgtctgcacatttaactaagggcctcgcaggtttgtttttcatatgataaaactgcttttctttcatggaacattctggcatgtctagacctgcagatctgcctcacaagctctttcagtggttccccctgtggttagggtgttaattaggggccagtttaatccttaaatgatgcagtcagtgtacagtgacagttggtccaggggcgctgtccaggggcctggtggagggaggaagggagtgacctagagccccagcaagcctcagggctatgggaggagctttctgggaaggggagagctggtctgcaaggaggaggtgggattagctgggaaaataaccctgaaacggtcctcagggagacctgaagccttgtaaagggcacggacccactgtagcagggtactgggaggcagtgggctggggaaggaggtggggttacagggccagagagaggggccctagaaacaggcaggctggcagcagttagaagtgtatctcgtagaatctttccctggttgaggcttatcctgatgagatttgcactctgagcatcactctggccaccctgtaggaagaacaggttgtggggtgcttctgggctatgcagaaagaccaggtaggaggctgtggccacagccaggtgggcagctgcaggaactgaggccatggtagtgggcttggagcagtgggacagctcgagagttcagtgaggagcaggtacatgaggcctagttggggcctggccttccacgtggagcccacacccccatgtctgtgaccggcagtgagctcttctctgccttgccccttccaggtccaccccagcctacaaagggcaccctgcacaccacctgattttccagacggggaggttgggacctgaagccgcaggccctggggggtgtccagagccagagcctgggggtctcccagtagggcagcaggtgggctccagccaggtcagcctgccttcctgggttcatctgcccagagggcgttttctatgacccagcctgaacggagctagaaaccaggcggtgcctgggtgcgtccatccctggctcatgcacgctgtgcttccaggaggcgggccctgcaagcagcagtgccgagacacgggtgacgaggtggtctgctcctgcttcgtgggctaccagctgctgtctgatggtgtctcctgtgaaggtaatgtccctatcccaggtgccagcaggactggccggtcactgtgcttgggagctctgtgctggaggactgaccagggcctgccttctacaacccagaccccattcaggggtggagagcagcccaggacgcgctttctcgtgttcgctggagtttgcagcgcagaggcccctgccgagacttccctccaagacaatataagcactggggttgggaaagaggatggagttggggtctaaccaggttccggatccaggatctgctgagtggccttgggcacatccttcagcctctcctggcccctgcgtctgtgagatgggggagatggagaagatgctgcccctccatggggttcttgaggaccacataactacagtctcagaaaaagcagtagatatgaacgttagcaggggagagaaatcactgctttcgactccgtgcagtccacagcccggatgtgcacatggtggacctgagctcagtttgcgagggtgcagggaagcacttccaccgtggctttggcacattccttcctaggatgtattaggatgggtcgttcttgctggtcacccccgcactgcctcggtctctcctagatgtcaatgaatgcatcacgggcagccacagctgccggcttggagaatcctgcatcaacacagtgggctctttccgctgccagcgggacagcagctgcgggactggctatgagctcacagaggacaatagctgcaaaggtacagcatgcgctccgagtctgcaaacctggtcttccaggcgtagatacggcgcggtgggaagggcagctctggggtctgggctcccgcagtcctgcgccctctgtggctgcctgggcgactgcctgctcatctgcaggagggaggtggttatacccaccagggtgtctggacaggtgggatggaaggtgaaagtgcttgccaataatgttcagaacattgaaaaagttgacagtagtgcaccggtgccagctagttcagctgttaggaaagatttacgttcttatggtgcagagtaaacgatggcagatttgggtttctaaaaaggctcagtgcatgactatttaaaatcaagaccagggatgaatttcaggttctcacatgtactttctacaaaaaaaaaaaaaaaaaaaaaaaaaagcaaaaacaaaaatcccacaactgtttttgcacaacagctgccttccatccaaatccaggcttccttgaagttcaaagcatatccccttccactgcataaacacatggcatttctggctgccagcctttccccgccaagccttaggtgttatttggcagatggggaggctctgatgaggatcgtttagaacacagttttgcagagggtttcaagcctttcagaaggacaaatccacttgtgtaaaaatgtcactcactgtatcatgagagtgacttcaaagcatggcacaccccttctgacatctgagggccacagagcaaattctgtcctccccacccccgcacaccagctgggtggtttggacccctagagcccagtggctgagccagctgagtatacacatttgaccatttgacagccatgaacttcaagggaagggcagcccatcacatcccatcatgactgtaacccttgttaatatctggattattgtgaagacttcagaatggatatgtttatagagactgtgtttgttgccactaagataattgctttatgatctaaactaaacatacacttagcctgaatgaatactaatatatatatacctgccaggaaaatgccagggtgatttattataacagacagtttgcctcataagagccttgggaaaaaaagtcagctttttaagtctttagcaactggagcacgatttggctcagtgaagtcttttttgtgtatgatttctctattagaatgttttgggttatagtctgagtaatgcgcattagaaaaaagctttcttgtgattttaaagtgttgtaagatgcttctggcaggactcttgctaacaatttcctttttttatgatgtaccagatattgacgagtgtgagagtggtattcataactgcctccccgattttatctgtcagaatactctgggatccttccgctgccgacccaagctacagtgcaagagtggctttatacaagatgctctaggcaactgtattggtaagaggtgtgccgccaggattagcgggttattccaggaggggtcagcgacctagccttggggcaggcctctagaatctgcggggccgcatggtatacagaacaggggttggcaaactttttgtgtaaagggctggacagcaaatagagcaaatactttagccgttgtgggccatatggtctctgtcataatagtcaactctgctgttatagtctaaagcggccaagggccatctgtaaacaaatgggtgtggctgtgttccaataaaactttatttacaaaaataggcagtaggctggatttggcccaaggaccacagtttgctgatctgggtttagattaaagagcttgggttttggagttagagtgacccaagaaaattacttctgagctttaattttttcctctataaaatgggagtaatcataatacctggcttagagacttgaggccaggattaggcgagtacttgcgaagtactggtacacaggaagcactcggtgagtggtgattccctgccacaggcatttagcctattaaaaaattattttaaaaaatacttggctgggcacagtgggtcacgcctgtaatcctagcactttgggaggccaaggcaggaggattgcttgagcccaggtttttgaggccagcctgggcaatatagcgagaccccatcactacaaaaaattagctgggtgtagtggcgcatgcctacagtcccagctacttgggaggctgaggtgggaggatcccttgagcagggaggtcgaggctgcagtgagctgtgatcgtgctactgcactccagtctgggcaacagagcaagaccctgtctcaaaaataaaataaaatataaaaataaaaaacagtctgtgttagtatttgaattcatagagacagaaagtagaatggaaggtgccggggctgggcagggtgggggatggggagtgagtgtttcctgggcgcagagtttcagtttgagaagatgaaaaagttctggagatggatgggggtgatggtggcacgacagtgtgaatgcagtaatgcccctgaaccgtctacttaaaatggttacgatggcagattttgtgttacataaaatttgtagttcacatgtagttcaccacaatgagaaaagaaactctggccaggcacggtggctcacacttgtaatcccagcactttgggaggccgaggagggtggatcacctgaggtcaggagtttgagaccagcctgaccaatatagtgaaaccccatctctactaaaaatacaaaaattagctgggcgtagtgatgggcgcctgtaatcccagctgcttaggaggctgaggcagcagaatcgcttgagcctgggaggcagaggttgcagtgagctgagatcacgccactgtactccagcctgggtgacagagtgagactccatctcaaaaaagaaaaaaaaaaagaaattgctgatatcagagaaatactaatatgaaaagagagaatcccatgtgaacttagtatgaatttaggaggcctgggcaagaccgctcacgctagaggagctgtgtggggtgcggccggggagctggccggcctgggttactggttctggaaagacaggaggtgagtcctgctttccccagccgttgtcaggttaactgcctggctaggccgctgcagtcagcgcttaagtcctgatccaccggctctccctcggcctctgcttggcagacgcccctgggtcctgcctttgaggtcagagagactttttaggagaagaggtgaggaatccgagctacagatcacactagtcagaacctccccacctggggtggccccatcacctctcccctgccatgagcaagggggtatacatttccatcttgcttcgatttcaacttttccttagcgaaatctgtattgatcatttatttgaaatagtggtttggagagagagctcttcccccactgcattatttttaaccactgagatatttaaagataagtggatgtggccgggcacagtgactcacgcctgtaattctggtactttgggaggccaaggcgggtggatcacttgaggtcaggagttcgagaccagcctgaccaatatggtgaaaccccgtctctactaaaaatacaaaaattagccgggtgtggtggtgggcaccttgtaatcccagctactcaagatgctgaggcaggagaatcgcttgaacccaggaggtggaggttgtagtgagccaagatcgtgccactgcactccagcctggacaacagagcaagactctgtgtcaaaaaaaaaaaaaagataaaaagacaagtggaacagtgagcccttaggacaggggcctcgtctgaaacccgccccagccttcctctgttacagcttccctgtcatcccctgggggagacttctgagctggggcgctgtggctcagctgccagttggcccctcgccagtcccttgccagcagggaggggtggttttcgctcagcgcagggggtggtgagcagggaagccatgggctctccgggaccagcggggaggatagtcctgctcagacttgcagcctgctcaaaggggggtccggaggaggctggcgtcgactgaggatggaaaccctgactcatggcaaaatcagccccgatttccacaaagaggcaatgtttgcaagtctcaacctagccctgactttcctctctacagggtgcagcactgtgtatgggctgaggctcgggagccgtccccttactgtccttccaggactggcaagcaggctgtgggctgaaggccagcctggcggcactgagctgttccgtgccatctccctgggtcctcagtgacagcatcgaaagccaaatgttcagctccctcagggtccccttagcttgggatgctgggatgaggatggggttccccttttcatgtgctctcaatccttgcaatcaagctcaggaatcattgttttaaaagatctctatttatttcaaaaattatgtatgtcttgacttataaatcagcaaacaaaacctaagtgtaggaagtaaacgctcctcccctggccaatcctgcccgcctcttggcagggtccatgagcccttctgggctctgctcccttgagactttttgtttttttatgaaaatgggatcagactgttctgccacttgcttttcccccccacttgacagggtatttagaaatcatttcatggcagcacctttatgttatctttttaaaaatgactgcatcagcagaaatacgtctttctaaggagaaaatacatcaagatagaaggtagtttcaggccgtctgggagagggctgaaaaggttctatgtcaggtcctggtcccccagcacgcaccctgggtcctctgctcccacacctctgcccatggtacccgctccctcacccaggaacagcatggtccgtggtgggaagcgttgatttccttgtgtagccagaatccatcttcctggagctcctagaaccatcctggggccccaagagcccatccgagcctcctgcctgtagcagaagagctcttcctgcagagctagtacaagggatgggtcagggtcccagaaagtggaggtctctgcccctatcatgcatggagaattttctagaaccttaaggttgggtcaccgagggctttgagaccagcatggctttgtcgggttttctttgctcttttcttcaaattccctcctcctgctgctgtattcctttctccttctcctcctcctcttccccctcccatcctccccctcccttctcctcttcccctccccctcccctcccacttccctcctccccctccttcccttccccttctctccctccccgcctccccctttccctccttcttttcttcttttttttttttttttgagacagtctcactgtcacccaggctggagtgcagtggtgcaatcttggctcactgcaacctccaccctgctgggttcaagcagttctcctgtctcagcctcccaagtagctgggattacaggtgcccacaaccatgcctggctaatttttgtattttcagtagagatggggttttgccgtgttggccaggttggtctcgagctcttgatctcaggtgatccacccctcggcttcccaaagtgctgggattgcaggcgtgagccaccacgcccagcctcttcctttcttcttgagtggggaggaaggaatgggccagggcttcccacgtgccctggctgaccttgcctggggatgtcggcaggtcctggggcaggaaggggttccactgaatctaggaagcactgggtgaagccaagtgaacggggaccttggtagcttgggcttttcccatgtgaatccctgagagggagagatcgggtgccctgttcccaaactcaccctatgctttacattgatttgctgtctgtttattcattcccattcattcattcattgatagccaggtcttacccctgtggagtgcacgatgttctgagggacactgttgttctgtggaacagagtttggggaatctagtctgagtgaggaacctgcagcgccagtgggaaggcagccaccgctctgctaaacgctgcatttattcgtgttacagggcaggggccacccagctgtttctctaaagggctagatggtaactaacaacttcagtctctgtggcaaccactcaactctgccttttgcagtgtaaaagcacccctgagcaatgcataacagagtgggcctggttgcacgctaataaaactttatttacaaaagcaggtgtaagccgggtttgaaccaagggccatcatttgctggccactgatttaagggagctggaaagcaggagaccctgattctagacctaggccctggttggcccctgacttcagccatgagcccagagtcattcagtctctggaccttggtttcctgtttataaagtgcaggcagtaatgatagtgatacctgcctcacctcacttgcaggctggctgtggtgctcgagagcggtcatggatgtaaaagcttttgtaaactgtaaattgctgcacggtcagcgcgaagggctgactcatttgactgaggagggtggacttggctggcagggagaggggtacagctgtcctcctttctgacttacgctcaagggtcttccaccatcactccctctctttgttcccccataccagatgctttgtaagtgtctgagcaaggttctccaaggtgatgtttagatgcttaggtccttttccactccctctatcaggaagtgcaatctgtgtattcttcctccgaatttgagcagaaggagggtatccctgtgtagcatggccctcctggaccattcatgggttcacacttgctcattgtatgtcatcaaaggtaaatgccccacggtccccatgtcagagatgtgtccactcaaggaaggagactgccgtgcagtgagctcagggagccatggcacctcccgggtgggcctggctcagcataggccctgtgaagcccagtcatcggaggggcctagagccttgctgggagtcagagttgctggcaccacgtggacagtcacctgtctccttaataccgtgcccagtgtgtggagtagatgaatgcaggagaagccaggcaggcaggtcccgatttggcgcagcgaacgatggaggtgctggagatttagggacaggaagaagggccagagaggtggtgtttgaggcggtatgcagtgataaaatttgggagccagctgggaggcggctgtgtggtccagagtgagggggttgagcccctccatttgtggttttgcaaagaggtgggaaggggagtttctttggagatccagtttttgggttctggaacaccctccaggtttaaccacatggtctctgtcttttcccgctgtagatatcaatgagtgtttgagtatcagtgccccgtgccctattgggcatacatgcatcaacacagagggctcctacacgtgccagaagaacgtgcccaactgtggccgtggctaccatctcaacgaggagggaacgcgctgtgttggttggtattaagaaaacaaatctgaaatccactttcctgtctgcttccagcatgcaccctgccttctctggaagcagaaagttgatccccaaagcaaagccatttctatcagcccatccatcccactgtcagttcccaagcatggggcttcattgtcttgcctggactggtgcaccagcccgtctactgcctcagccttgtctggcttgtcctgagcccaaagctctcgcaccccaccctgtttacagttccatcagctccccgttggtgacaaaggatggatgcctctgcttacagtccagtcccccagagctggcccaactccacaaaccttgtaattcaggcaatgtgggtctgccactccccacacaagcactgtcctttcctctctgtgtgggtgtttgctctcacgtcattccctctgcccacctgctcctacgttcctttggatccagggcacccagcctgcctagatcccgccagggaaggagccttcctcgcataacccccaggacacttcttcagtgtctccctgggttcctgggcacttcctaccttaatgagagtcattgctggcctgccagccaggtagggctgcctctgggtcagctatcttcccagtccagggcccggcactcagtaggtgctctgtgaagtcgtgttgaaatggaatgcctgtttccatgtccatgtgttcctttcttgctttcctttctgatcatcttggggggaaaaaacccaaactaaaggttttcatcatggctttctttctcctttgcaagatgtggacgagtgcgcgccacctgctgagccctgtgggaagggacatcgctgcgtgaactctcccggcagtttccgctgcgaatgcaagacgggttactattttgacggcatcagcaggatgtgtgtcggtgcgtggggggccccgcaggcctcgggggaacccagccacgtggcaccagggacacatttctgtggcacctcgagtgatgtggtctgatcctcatctcagataatcccaagtgcaggcagaccctgagagaagatcctgagtcaggagaccccattctagccccagctctgctgctgcccagccaggcggccactggcaccacccccctgtgtgtgagcctgctccccatctgtggaaaggggttctgcttgacccaggacctccaagtgctgatgagccaggtctacacatgtgggcagcatcagcgatttcctggagattcaccgctgagctgtagatccccaggagctagagatgtgtgcctttagcccagggcagcgaggggaaaagttgaccaggagtggggtcaggtcttgtctagccagtgcctgctgtcaccaaacctaggtgctcagggaagcctggcagctgccaaccactcccccaaagtgggcactttgctagatcctggcagaccctccttgtgggtcctggggaggaggactggcaggagggcacaagttcagatgtgctgccgcagaaggagcacgaggctcgcccaccaggcaggcacagcgcggcagtcccggctctcccactgacttcccgcatgctcgggacaagtcactttgcattccttgtctgagaaatgaggctggaggccaggcgcgatggctcatgcctgtaatcccagcactttgggaggctaaggcaggtgaatcacttgaggtcaggagtttgagaccagcctggccaacatgacgaaacctcatctctacaaaaaatacaaaaattagccgggcgtggtggcacatgcctgtaatccctgttacttgggaggctgaggcaggagaatcacttgaactgggaggcggaggttgcagtgagctgagatcatgccactgcaatccagcctaggagacagagcgagactccatctcaaagatgaaggaaaaaaaagaaatgaggctggaggaggtggaggacaaaggacatgagctggccttactaggagggtggagtgtggtgccactgtgttggacattgccctgagtcagcccacccctcactttcagatgtcaacgagtgccagcgctaccccgggcgcctgtgtggccacaagtgcgagaacacgctgggctcctacctctgcagctgttccgtgggcttccggctctctgtggatggcaggtcatgtgaaggtgaggctggggccccgtccactcacctcccccaggtcaccttcctcctggggaagccacccttctgcagaccggtttgcagcagatccgcgatggtttccctgttaaatgacatgttagcaggggaagtgcctgtaaaatattgttcatcagagaggactgcccgcctgcccacccgatttctcctgatgacatccaccctccgaggccgtgtcggggttcataggctgcggcagaggccatgcgggatgtggctaggattatggggcttggagcatgacacccacgagtcacagggccttggttatgcccgacctctccctgcctccgtgtcctccccggggagaggggttgatgtgtgaaacagcagcgaaaactggacacttgttttgcacaaagacagtgtgtgggttttaatcagatgctgcctaggggagacaggcctctgtgtccattgatctcaagtcacccaaacaaaaggagggaggctttgtaaatgacgagctgtgagaggaagtactgaggcctttagggcgtgggtcactgtgcacctgcctctaacttctttttttttttttgagacggagtctcgctctgtcacccaggctggagtgcaatgctacgatctcggctcactgcaacctccgcctcccgggttcaagcgattcccctgcctcagcctcccgaatagctgggattacaggtgcacaccaccatgcccagctaatttttgtatttttagtagagatgaggtttcaccatgttggccaggctggtcttgaactcctgacctcagatgatccgcccacctcggcctcccaaagtgctggcattacaggcgtgagccaccgcgcccggcctgcctctaacttcgtgttggagttaggctttccccacccgcagagacagggagaagcaccctggccttccggatgacgacattccccaggcatgtccccagcccttgagaaagacactccttggttgcacatctcaaagggacagagaaaccgtttacatttgcaagtttttctaaagtagatgcttctaaggaacatggaggtcagcgcctgtagtcaggtttgggctggaaccaagagaaaattcttttggcagcattgatctttctcagacaggcatgtcaagggggctgggtctacatcctggatacctggtcttgggccaatggcagccacgctgaagttgggtcaggtctcttggtatgtgggggttggacagagttgttcctgccaacagtcttgtggttctcagataacaccaacctcctgggctgatgggaaggtcacatgaactgcatgtcagcccagggcctggcacatactaggtgcttggcagatgtcgtgtcttgtatacggattaggttctgagctgagcagacactgagagctttggatggccctccacaatcgtccacattgccgatgacaccctgtttggtgccgtgcactggctcacaggacagcttctgcagcctgactcaaacatggcaggtcctaacattttgccgtgagaattttccttcctgatgagatggtcgcaggggttggatatgccacagtgagctgtggtgtgcatgattctcaaatcggaggacggacggtgtgaggggtcctgggcttagttcacaagaacgtgtatggacaaggaacaagattcacgagttgagtctctcaggcttgtgttcaaacctgacttctgccatttccatggccttgaagaagtaactcagtctttcctgggccatggtgtcctcatctgtaaaacgggcatagtaggaccaaccccatagggggttgtgaggatgaaacgagattaagcatgtgaagagcttatcacagggccaagcacaggatgaagagctggcggtgtggaggctgctggctttattattatttagtagaagtagtgggattcctggcttgtgcttcctctagtcattcataaattgctgaaaagtcggcattcatatccacattagtggacaatattgtggatatagaaccagagcctggccagccttgctatgtgaccttactaaccatttgttaaggtcctgccccgggtgtgtagcaagaactcggtcctgcactggggagtgtctctagcgggggatgagagaccacactggacaggtggaggccaggcctggtgtgtgggggccacagagatgaaacacggggtggaaggctattggacgttctgtgacagccacatagtatagatttaaggcttttccagccacaatctctgttgcaaccgctgaactctgctgtggtagcagagaagtggccagaggaccatggtaaaagaatgagtgtggcagggcacagtggctcacacctgtaatcccagcactttgggaggctgaggcaggtggattacttgaggtcaggagttcgagaccagtatggccaacatcgtgaaaccctgtgtctactaaaaatacaaaaattagccgggcatggtggtgcacacctgtaatcccccagctactcaggaggctgaggcaggagaactgcttgaattcatgtccacatttagtggacaatagcctcccggaggtggagattgcagtgagctgagattgagctacttgtactccagcctgggcgacagacaaagactttgtctcaaaaaaaaaaagagtgaatgtggctgtattctttattttattgttattattattttgagacggagtctcgctctgtcgcccaggctggagtgcagtggtgtgatcttggctcactgcaacctctgcctccttgttcaagcaattctcctgcttcagcctcccgagaagttgtgactacaggtgcgtgccaccatgcctggctaattcttgtatttttagtagagatgggtttcatcatgctggccaggctggtctcgaacccctgacctcgtgatccgcccacctcggcctcccgaagtgctggaattacaggcatgagccaccatgccttgccgggctgtgttctaataaaactttatttataaaaacaagtgttgggacaaatttggcccatagactatgatttgctgacctctgctttaggtaaaggggacagttgagcagtagttcagagttgctgagtggcccagtgagttctgtgcattggagtatgaggagtactggcgtatgggctgggtggccgaggacttccttgtgtgccgtcatctgtttaggatgccatcttggaggtgaagtggagagcacaggatcagatttccatttgagaactagaatggactctggcagccaggtcggggcagacttccaggggccaaggctggaggctatcgctgccatcctggcaggagaagttgtggtcgaagcaggcaggagcagggatggagggtccggagccaccagcgatgacgcctctccctcggccacaccccccgggacctctgtctctccgagtgtgttaacctgagggaggtggagaggagattttctgttcactgaccctgagggctactgtggaggcagggacgtatgatgctctgagcggtgaccctcgttttgtatttcagacatcaatgagtgcagcagcagcccctgtagccaggagtgtgccaacgtctacggctcctaccagtgttactgccggcgaggctaccagctcagcgatgtggatggagtcacctgtgaaggtgcggacgcccctgcctgctgagggggaaagcaccccctggtcttgccatgacacagcagcacggcctctgactttcaaaatccacagggaagagcctgctgggatttcttcacctggcaaaccttccatgtccacccttggaggcaagcgggtggtttgctgttttccctccaactgaggtttttttttttttttttttttttttttgagacacggtcttgctctgttgcccaggctggagtgatatggtgcaatcactgctcactgcagcctcagcttcccaggctcaagtgatcctcccacctcagcctcccaagtagttgggaccataggtgtataccaccatgcctggctaattttttatttttaaaaaattagagacggggccttgctgtgttgcccaggctggtctcgaactccgtggctcaagtgatcctcttgcttcagcctcccaaattgctgggattacaggcatgagccaccgtgcctggcccccaactgaaattctaatatacttttcccatccttaagcgtgagggtgggaaggcagcaaaccactcctgacttgttctttaataaatgtgcacggcggtaattacaacatgcactgggaccttgggccgcatatctcaggtcttggtggtggtgcatggctgagaggtaaggagggggctcagggaccacctatatccctgactcagagctctaactcttcatctgtaacatgatgattaacttcagcctcaccagatcattggaggattaaactagatgacagcaattacaggcaattaagggcaattacgatgattaccattttcatgtaaggtgtgtgtgtattttgtttgcttgtttgtttttgagacagagacagctctgtcacccaggttggagggcagtggtacaaacacggctcactgcagcctccatctcctgggatctagcaattctcccacctctgcctccttgagtagctgggcccacaggcatgcaccagtatgcctgactaacttttttgattttttgtagacacagggtctcactttgttgccgaggctggtctcgaactcctgggctcaagtaaccctcctgcctcagcctcccatgcctgggattccaggcatgagccagtgcacccagctgaggtgtgtttcttattattgaactgtggtccatatttccccctgcccgccacatgcatacttcacaccatgaacttgctgtgtgaccctaggctagtcccatcgcctctctgagcacgatggtctctgaggcttcctgtgttcagcttgtcctgtgctgctgccctcccgggccccagtgcagcccccagggcgatgtagcatggccagcagccatggccaggtgccaggacactgaggctgaggtgggctttgccgttgcagacatcgacgagtgcgccctgcccaccgggggccacatctgctcctaccgctgcatcaacatccctggaagcttccagtgcagctgcccctcgtctggctacaggctggcccccaatggccgcaactgccaaggtgagcaggagggatgccctggggtccctcacgctctgcttggggccctgcaatgtcgtggggctgaggctgggctcgggggctgtgcttccccaacccaagggccacagcacagatggaatgcattcaggaaaaggaggcccaccccatccaaggggtgtcctggggtctgcagcaccctggtctcctacacccaggccccagcacacttgtcctctggattgtctgagcctgtggcggctgcatccggcaggaacacttcagccctcctcccctcccctcagcagccccgtaaaggctggaacagaggcctttaggaagatgcccgccagggaggaagcagtccaggccaggggatggcgtggcctggtgtgggatggcccagggatactcatggctatgggtcagctccagcatcggctaagtaatggtggccaatggcattggttctgcattcagcccccttttctacgaatgctctagggggcagtgtgtgtcccccagagccatctgataaccatccattcaatcactgacagcgggtgctgagtagatgtttgtgagcgcgtgatcctcagtgtacacactgcgcccagaagctgagtcatggaggtggggctgtccagccagttcctcgggagccccacacaggactgtggatcctggggctctggaagccccctgggtcccacagatgtagcttctggtcatgaggaaggtgactttgatgaaaggcaggcaggagctgcggtgtttcctgggaggccccctccgcttgccctgggctctggatggaaggctggttgtgtctgcatttctgacggagcaaatgacttttctcctggccaggctccctcaccacagcctggggtcccgcccagactcagcataaacacattcctgagccgggcctttgaggctggggagtgttgtttttgccaccgatgctcaggcatttggcacctcttaatggatgtctcccagggttggtgacagcccctgagccccactgtttggctgctccagagtctatgggagttgggctgctcccccatctccaggggcctctcagtgtggtgccccaggccccatcccaggagtcccagacctggtggttccagtccaccctgaacagccaccaaccccaacacacaggcaagacgtatgatccctcgaaggctgtttttctcattgttgtgtggagctagcagctcctgcccttttctcctaagaggttgagtcacacctagggtaagggtgctgagcctcgggagccacagagaggctctggttagttagtgtatggactctgatgccagcctgcccgggttcaaagctcagctctgacatttataaaatgtgtgacctcaggcaggtctcttaagctctgtgagctcctcataaaatgaggatcataacagtatctgcctcattgagttcttaggaggattcagtgacttatccttgcgaggtactcccaggacccatcatgtagtgtttacttttaccatcgtcacgctccctccagggattgcgaatgataagttaacactctataaatgtaaataccctataaatgtaagaactggcacaggacgctgctctgaagatcagccagtggagggcagggatggcctgatcgccacccctaaccctagttgatgggaggcctgggctcctccgtctccagatgggtatggctcctgcagcctctgccttcactgtgctgctgtggggtctcttgcagacattgatgagtgtgtgactggcatccacaactgctccatcaacgagacctgcttcaacatccagggcggcttccgctgcctggccttcgagtgccctgagaactaccgccgctccgcagccacgtaagtcccttggaccatgccatcgtcgtctgtctgtgttggccttcctggtgacccagttcccgggtgggtgggttatcaggctgtgacctcggtgtcctcccatgagggactcagggcactcaaagatcacctgatccctggccctcaagcccctaaatgctagtgacactggtctcggaaagtcaagggggtaactgcaaatgagtctggggtctatagtcatgttttcaggccaaggctgtgcacagaaccaggagaaaccacagccctcttttttcctagggtggaagccttgggcaagctctctgggcctcagtttcctcatctgtaacatgcagatgtcagaacgtgctctgactgagatgcataggtagcaatgtctccatgtcagcccaaagccagggagccgatgtgacctgttggacgttgttgttaggtgcccacctgaaagccagaattcgtccagcctggtgaccgtgtgggaacggcatcaaagattccagatcctaaacgtggggctgcgtgcccctatgtctttgtaagctcactcactcctaggccatcacggcgcccacttgagaccacggttcccacttcctatcccccttgcccctaattgtattcagaaagtctcatttagtgccacagtcagttgcttcaggaaaagctccatgctgggaccgatctcaggactgtggacttgtgacctctcccagcactctgagtgcacgatgcaggcagccagctgtttccgaggccttggccccttgaccttcagcctgccttgggctcttggccagctgcccccgcgacctgagggtcagtggtagtgtccacctcttgaccctaggggcagctgccctggcttgtggcatagcaaggcttctgggtacccgagcagccccgttgtccctggcagccctccatattcttcctggctttgcgattctcattggctggcccagccatttccctgtttcccagcacggatttctgtctgcttgaaaacccaacatcttgtttccttcctgagcttgggttaggaaaaagctgccccaaaactgggtttgcaagtctgtagcatcccgaagagctcatggttatgcaacagcctgccccaggcagtgacactgcttctctgagccattaagaaagttcgatggccttggctgcaggctgtgcagccgtctgtcattgtaagttcactctctccccagcctttgtcagcgcctgggcttgaggattccaggaggctggctgtggttgtgacctcgatttctaacttgcgcacagtcgtgaaaccacctttcgaagagggggaggctgccctgcacaggggccctggcgcctcctaagcctgagggtgggcgggttggccatgtgtgctgaggtcatggctgaaatcaggggaacccagctccacccctcatgttggctgtggaagcctctgccacccctcagtgctggagaaagtcgtttcttcctggacctactgcgtgcaggcacctgggtagacagcccacagagggctttgtccccgcacaggctccgccttcggcgtgtgtgctaggagggaggaggggaccccacctggctgggcgtgagggtgggcagggggctgtctggagtgggccatgcctgcatggaggtggaagggggagcgaattaggcagaagcggcgggagtatggacacatgtgcggtgaaatggggagttcagcctgaaacctgggccctgtgtgctgtgcagtaagggattgagctgctgggcgcctggcttgttccagcccttggactcccgggactgatagtgaggaggggccaccccctctcagcactgctaacccctcagactggagttttgtattttacagccccttttcctgctcatcaaaaatcgaagctgcttaacacgttttttcatctaagcttcagaaagcaatttttaaaatctaaaagagccatatttaggagggacccatggccggcgcttctgtggttaacaactcagcaagagcgcctccttcgggagccttgacagacaggactgcagagtccgctgctgtgcctttctctctctctccactcagacggcttccatctggggaacatcccggcggccgagggctggtaactggagcatgacccaggaagctgggccgcaaaccacagggctcggccttgtggacaggaccaggctgttacagtcctgcccacacaattcccttctgcccgcaggaggaagtgtgcaaagctgtcccacagcctttcatggggccggacacatcctctttatcccctcagtggggccggcgcctgatgacctgtggtctagaaagctggagcaaagccgggtggccttggttgccgcttcccggggatgggacacgagtgaacagctgtgggcctgagggtgtaacacggtggacggtggcagagatagagccgtcgatggcccccctgccttggccagttcctggggcttgtctcccggacgacgagcgtgtgaaagtcaggaaaatgccggcagggatatccacaagcacctggggtggccagaactgccgtgcctcccaggagaaggagggggcctagagggccttttttctctggtgtgtggtggcttaggatcatttccatagagcttgaggtgttagggtcaaatgtgttgaactggcaagttggagcacattgtcctctaacgcatgacatggcccaggatgggtggcctgctgaggggacatgtctggaaaccagggcctgcgtggcagggggggacggggcgggctcgcctgtgccctgctctgtaatacattcagtgatgacaacccgtccctgacctagacacactggctaaaagggatttttgggccgttcccagtctgacaggcagtttgccagacagttatgtttctggtgttttaaaaagtttgagtagagcgaagtacgatcattgaagccaggacttaccaggaaaatcaaggacatgtttatttttgtgcattagtcatttgcaaagcacatagcgggtgccccaggccctgctctttgtccagaaggagccagcccagaaactcctagtgtagagaaggttttggggtgctctgaggaatgactgtgtggggtcggagggggagcctccaggggaggagtgaccagtcgctgtgtgtgatgacggcgggagctgcaccagaacaccacgcacacctcccattgctttcctccgcttccctctggcaaaacaaattccatccctggttagtacccgccatgctgagagaagcgggaagccgaaatcccaccagggcgactctagcgccacctgctgaccagccccatccaggctggtcctgaagttgctggtgtgtgtgcgtgtgcgcgtgcttgtgtgtgtgcatacattgtgtgtgtaaaagctttgaagtaagacaggccgactttgaaagccaagcttgccccttacgacacaccacggagctatcagcaagttctgcatcctcaatgggcgtctgtcttccagccagtagagcgggaggacgatgggagacagtggagggagcgagtggaaggaaagtctgctgcttgcagcctgctccctgcacccggaagcgcagttcacctgcacccggaagcacagctcatgggtcccatgctcctcccccagttcacggacgctttggtcatagctcctcagaggcccccctgggggagagctctcagatcgcctggagcactcccgtttggcctggacctgggcatctctggggcaggccaccgccagcagcacccgtgcccaccttctttcctgcctctgttttgggcccctcccaggcaggactcccccgttcagtgcccctgactcccaggccagtcctttctaagagcttggaatgatcactagccaagtaaatgcaaggcctcctgtcagtcctgacaaacctggaaagaggaggtaaaaggagaccccagtctcgataaatgcctcaagcaagtccaagtaacccagcacgagacatggaaacttaaaaagccaaaagggagatgtgatagaaggccaggacgagaggatgctcctgacctcagaatccagacacagcccagatggcagggcttcctggagcacctgggccaggtcctctggggctccgcacctgggccctgcttcctcaggcagccaccttcagagtatgatgggccaggagttcagtacacaggagacgacccctgtcccatcttgtgacaagaaattagaacttgttactatcctgtagcggaagataataccgatctccatcctgtcacaggaggttagaatctgtaacaggaagttggaatctgtgctcatcctatacaggaagttaggacccgtccccgtctccaccacaggaagttaggacccgtccccgtctccaccgcaggaggttaggacccgtccccgtctccaccgcaggaggttaggacccgtccccgtctccaccgcaggaggttgggacccgtccccgtctccaccccaggaggttgggacccgtccgtgtctccaccgcaggaggttgggacccgtctctgtctccaccacaagaagtttggacctgtattagggttctctagagggacagaactaatggaatatacatatatatatatatataaaatggaatatatatatatatatataaaatggaatatatatatggaatatatatataaagtggagtttattaaggattaactcacatgatcacaaggccccacaataggccatctccaggctgaggaacaaggagagcagtctgagtcccaaaaatgaagaaaaaatgagtccaatgtttgagggcaggaagcatccagcacgggagaaagatgtaggctgggaggctaggccagtctctcttttcacgtttttctgcctgcttatgctgtagccgtgctggcagctgattagttggtgcccacccagattaaggatggatctgcctttcccagcccactgactcaaatgtgaatcttttttggcaacaccctcacagacacacccaggatcaatactttgtatccttcaatccaatcaagttgacactcagtattaaccatcacaagtccaccccttgtcaacttgaacccatgcacatctcctgagatcatacataatcttcaaataaagacaataataagatcataattacacctaacataactatacttcatacgaccagaaactcaccaatccccaacccaaatactattatataaagttaacgatacttaaatgctgatgtgaattcaataaatcttatgtcacttgataaaagagaaaggaaataaaatgaagtcatttttgttagtacaagtgtatacatgcacaaacatttttgattgttttttgtttgtgtgttttttaagacagagtctccctctgttgccgaggctgaagtgtggtggtgtgattttgtctcaccgcaacctccacgtcccgagttcaagtgattatcctgcctcagcctcctgagtagctgagattacaggtgtgcaccaccatacccagctaatttttctattttaagtagagatggggtttcaccatgtgggtcaggctggtcttgagctcctgacctcaagtgatcctcccgcctcggcctcccaaaatgctgggattacagtcgtgagccacagcacctggccatgtttttaaaagaaggaggaaatactcacgacaattacagtcctcgtttctgcaactggtcacatggctcgtagctggtattgatgactgccttcttctactacccattctgtattccctttgccttcagcaagcaccttggcagatcttgttttttttttttcctggtggagtgacccaaaccttcattcctgaagggtctgggtcatttgtagtcctgcctggattgggctgttgtagtttcccattgaccttaatcacagggcatggtaatactgagagatgccctaatggatctcctgtattccatgcatactctaacttatcttcattttggagtagtagactgatttcatcttgatagtctgggtcagccaccccagccaacactgtaactcccttcttagcctgttgacttaaaggtaggaggagcttcaagtgtccaggtggcaatcttaatttccagtttaatggaatccttgttctgtctcctggtggcggcgttcctccctctggaactaagacctctaggccagcagaacgtaatgttgcaggaacaggaagcaaaaattttgctagtggatcactaggggtgatggtgagtggtgccacttccatttccacccttggatgcctggacccgtgaatcctggctatgggagaaacagtgccataatattggaccctgattcagagcatacatggccttctgtagaactttgtcccagccctgcaaagtactgtcacctagttggcattgtaattgtgacttcaaaaggccattccactatcctatcaatctacctgcttcacgacgatggggaacatggtaaaaccagtgaattccatgagcatgagcccactgccacacctctttagccgtaaagtgagtgctttggtcagaggcaatgctgtgtggaataccatgagggtggataaggcattctgtgaacccacggatggtagtcttggcagaagcatcgtgtgcaggataggcaaacccatatccagagtaagtgtctattccggtgaggacaaacctctgccatttccatgatggaagaggtccagtataatcaacctgccaccaggtagctggctgatcaccccgaggcatggtgccacatcgagggctcagtgttggtctctgctactggcgaattgggtactcagcagtggccatatccaggtcagccttggtgagtggaagtccatgttgctgagcccatgtgtaacctccatccctgccaccatggccactttgttcatgggtccattgggcaatgacaggggtggctggggaaagaggccgagtggtgtccacagaatgaatcatcctatccacttgattattaaaatcctcctctgctgagctcttttatgtgatatggtgagcactctcatgtgatacaaatatcttcacagtttttgaccactcagagaggtctatccacatacctcttccccaaatttcattgtcatcaattttccaatcatgcttcttccaagtccctgaccatccagccaaaccattggccacagcccatgaatcagtatgtaatcgcacatctggtcatttctccttccatgcaaagtgcacaaccaggtgcattgcttgaagttctgcccactgggaagatttccctttgccactgtccttcagggatgtcctagaaaggggcagtagtgctgcagctgtccactttcgggtggtgcctgcatatcgtgcagaatgatctgtgaaccaggccctagtcttctcttcctctgtcagatgatcgtagggaactctgcatgaggccatcggtgcaggctggagaagagaaggcaagttggcaggagtggagaccacgggcatttgagccacttcctcatgtaacttaacttgtgccttcaggacctgctcaagcccgatcacgtatataccacttccatttgatgatggaatgctgctgttcatgaccaactttatggctagatgggtcagaaagcacccagttcatgataggcagttcaggtcatatggtgacttgatgacccagagtcaaacattcagtttccaccaaagcccagtaacaggccaagagctgtctctcaaaaggagagtagttatctgcagaagatggcagggccttgctccgaaagcctagagaccgccactgtgattcacctatgggggcctgccaaaggctgcagccagcatccttatctgccactgacacctcaagcaacattggatctgctgggtcatatggcccaagtggcagagcaacttgcacaacagcctggacctgtcatagagctttctcctgttctggaccccactcaaaactggcagcctttcaggtcactcgataaatgtgctggagtaacactcaaacgaggaatgtgttgcctccaaaatccaataggcccactaggcgttgtgtctctttcttggttgtaggtggggccaaatgcaggcaacttatccttcaccttggaatatctcgacaggccccaaaccactggacccctagaaattttactgaggtagaaggtccctgaattttattatcagatttattttccatcctctggcatgcaaatgtctcactaataagtccagtgtgtttgctacttctcacttactggatccaatcagcataatgtcaccaatttaatggaccagcgtgatatcttgcagaagcgaaatgcgatcaaggtctctccgaataagattatgacatgaataagattatgacacaaagccggagagttgatacacccctgaggtatgacagtgaaggtatattgctggccttgccagctgaagacaaattgcttctggtgggccttggaacaggaatggagaaaaaggcatttgtcaagtcagtggctacataccaggtaccaagagatatggtaatttgctcaagcaatgaaaccacatctggtacagcagctgcaaattggagtcaccacttggttaaacttacgataatccgctgccgttcaccaagatccatctgtcttctgcacaggccaaatgggagagttgaaccgggatgtggtgggaatcaccaccccgcgtctcaagtttttgatggtgacactaatctccgcaatccctccgggaatacgatattgtttttgatttactgtttttctaggtagaggcagctctcatggcttccatttggcctttccaaccataaaagccctcaccctaccagtcagggagccagtgtgggggttctgccagctgctaagtatgtctctgccaattctgcattctggcactgggaaaatgaccacaggatgagtccggggacccactggacccactgtaagtcagacctgagctaaaactccattaattacctgacctccttaagcccctatttaactggagggccacaatgacgttttgggtcccctggaatcaacctcagctcagaatcagtgtccaatagtccccaaaatgtctgatcatttccctttccccaatgcagttactctggtaaaaggccagaggtctctttggggaaggatgggagaaagattcactgcataaattgtcagtaatgtagtggggtccttcctcaagaggacccgcctccccttcattcaaggggttctgggtctgtaaactggttcaagtctggaaattgattgaggggccgtgattctctttttttgtaattcaaattagtcttttgtccacttgatctagaagttttcggcttatacaaatcaagtaggaatgcagtaggcttcctatcaatttcacttctaggaacactgtgattaattagccaatgccagagctctacacgagacagactattctgattgctgctttgcctctgctgtccattacagaagctacacccaccttgcctttgatggttgagtgctgtcacttggccactgccacctcaggatccaattatttccattgtatttaaattttgtagttgagtgactgtggttcccactgttagatctgacataccaagacgagcaattacagggctcttcaaagatgcaggtgctgccctcacaaatctgtttcgaaagacattggtcaagggtatatcttctgaatcctcccaacttggttgagtaggtctaaagtgactaatccactccaccatcccaatctccctaagtctttggattccttcctctacattaaaccaaggaagaccaagcatttccagcttgctcacagtgggccatctcttcatccgtatttcagctaaaccagcaaataaactattagaaccttttttaactccccgagttgcaacattaaatgcagagtccctgcttagtgggcctaaatctgtaaattcagcctaatccaacgctatgttccttccaccattctccgacacccttaatatccattctcatgcccgttctccagattagtttctataaattagaaaactcaagcagttcttttcgagtgtagctcacttcctcatgggtcacactctcaacctcatctctaggggcccgccaggactttagtctagttataggtctagaggcaaacaggggtgttaggggtggctcctgaggagaatcaacattatcttgcctggcaactgcctcacaggaggccatcactgttgcctcaggcagcgtggggtttatctccttagacaaaggtggaaaggctgatgggtcggggcggggatgttgccactactggggatggggaagctgttaagctgtttcttctggcaaaaaagattcatcagagtttataaactcagtgtccccagcttcatcaggctcctcccacatgtccccattccaagttgcagggtcccattctttttcaatcaatgccctcactttaacagcagacacctggcgaggctgtgcatgcatctttcattgcaggtcagccactcgcatgataagagcttgtgtctgtttttccacaatttcagctcttcctctacaggagataagactctcactcagggcaatcttagcagatttgaggctcagtatctgcttctgaagctgggagatggaatccctgagttcataattttctttcatcactttgtccactaaacttaggagcaaccaaccagcttcattatgttccttggttctccacatatgatcaaagatattatgtatagagtcactaaacttgcctcatgagcgatgaatcaggagtttcaaatgcgtttatttttcataactctctaaacagttcatgccaaggactatcagtgttctccatactattagaagtggagtccttagcatttttggatctaatcgttaaccagccaaccccagaaaccccaaaaccaatgaaagaactccatctttaatattctcttcctctagaaccactcctggtaccaaaatctgtagtagttagggttctctagagggacagaactaacggaatacatatgtataatggagagtttattaagcattaactcacacgatcacaaggtcccacaataggccatctgaaggctgaggagcaaggagagccagtccgagtcccaaaactgaagaacttggagtccgatgttcaagggcaggaagcatccagcacaggagaaagatgtaggctgggaggctaggccagtctctcctatcacatttttctgcctgcttatagtctagccgtgctggcagctgattagattgtgcccacccagattaagggtgggtctgcctttcccagcccactgactcaaatgtgactctcttttggcaacaccctcacagacacacccaggatcaatactttgtatccttcaatccaatcaagttgacactattaaccatcacaggacctgtccccgtctccactgcaggaagttaggacccatccctgtctccacccaggaagttaggacctgtctctgtttctatcacaggaagttgggatctggccctgtggacccagatgggttactgagcttggaacacgagggcttagtgacaaggaactgggaactgacctcaatggctgagtagcgatatggctccctcactcactctgtgaccttgggaagtgggaaggccacattctctctgagcctcagtgtcctcatgtgaaaaatatcaccgaagccactgtcatggggtggtggcagtgatcacactagagagtgcatggtgaggaagagctgagcacttggtaaacggcagcagctctgattgctagtggcagagatagtcatttcatgggtcacctccgagacacaaccaagagccctgcgtagccctggccactgtctgggcaagggcctgggaagggcagggtgtgcctggggagtgcccctggggtggggctctgccagtgagcaggggacgcacctcactccgggcacagcctttggcccccggccacccagcgcccgagatggtgttggaagaggctagtgcctgaatcagcagcctggaggtccacggcgcctcccgcaggtgagtgaggtgtgcccttcgtgttggctgaatcggccagaggggcggcgggaggccccgcctgccagccccgcatccccgcgctctgccgtttctccgcttgctggaccggccctaaccctcttcttgtctctctgcccacttttcttgcagccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtgagcctcgcgtgccttggttttatttggcatggttgggagtctgtgccgcttgttacccgggggtgagctgggcactggccaccgcctggtacccccgagggctgactgaggagcgctccccactagagggtgtgtgctcgggggtccctgttcacagagcccactgtctgtgccgacagggaggccaggccgggtacatcatttcacatgtgttaacttgtcttcatttgtgttgaacccaaagaataaaggtggtggtggagaagggccctcagattgctgagcacagtcccctctcgttttacagatgtggaaactgaggcccagagagaaggggaagggttggccagggtcgtctggcctgctgtggccatgccaggtcaaggaagcgggtctgctggcccctgcctggttctttgctgtatccccggaggtgagcatttcactgagacaagaaagctctctcctgagattcaagcctcctcttctgtttgtcttgatcagaagcccaaatctgtggtgcagaaacacgggatgcggttgcggctcctaggatgcagctcttgcctcagtgaagtcgttttgcccccactgaggatcctggccctgtgccggggcgaggcaaaggaccacacaatacatgtgatactcaggggatccttcataggccttacaccagtcctgccaggcaggtggtcatcctcatgaagactcagagagggcaagtgatttgcccaagatcacacagctggtatccgagccctggtttactgactccacagatctggctgttgcgttctgccagaatacctccactgagggccttaaccccctgcctccctccatctcctccaccatggtccagccaagccagtcatctgtccccctctgctgctcccagcgtccattcacctcccctacagctcattctttgcttagcagctggagtgatcttttagcctctgcctaaaaccgttcctggcttccttaccatttgggttaaggcctccagatcctcaagatgtctgaaggccgtgcctaatttagtccttgcatgcaatttccagcctggcctcaacttgttctatccttgcccacttcccttgagccacgctgcaagctctgctgcctccggcccttggtacgtgctttgcacccttggcctgaatgttgcttaaactccagctcatgtgcctgcctcagagaggccttccctgccacccctggcttctgttttctctgtccgtccttctcatgacccctttccttcatggtgcttgtaacaggctgcggttcctgttgactcgcgtttcacatttgtcttccgcaccttccagaaggctctgtgaaggcagggaccaggtctatctcattcagtgcggtgttcccagctccttgcaagacatctcgcgtgcagaaggtgctctgtcaatgtctgttcagggaacagatgactctgccagccctggcttatgtcactagcatttctgtggctgtgacactgtgctgacactgtttccaggcagaaatccaagaagggaaggcagaacaccccagcgggatcaagtaaagaggactgcagggttcttccatggaagcaggggttggaggatacccaccttgatgcctagtgaggaagatggacctggacagacagtcagctccacaccttgcgctgagcagctgtgattgtgccacgggagcatgagcccttttccccacggcccttgccactgtctcctggccctctctctgatcatgccaggtttgcaccagcctcgagtctcccatgttgtagtacattctccaagatgcagcccaggagcctctctgaaggaccagtctggttacgatggtctgagcttccttagaaccttccatggttgtcttttcccagcagatgaagcatagcctccttggaatggcatgggaggcctggcctgatctggcctctgcccaccctttgagctgtacctgccccaccccagctcatccatgtgcttgtaccctggccccacggggaggcttgcccttccctgaatctgccttcttgtggctttagcatgtgccatgctgtccccctgcagactgccattctccttgcagacttggctcagaagtcacctcctcagtgcagttagcctgagctcccctggccccaggtgcctccatcagagcatttaccccattgtgttgtggctgttccttaacgtccccactagccaggctctttgagggcagggattgtgtctggttaatttctgtattctctgcaactttgcaatgtttggcttgaagaaggagctcagtaaacatctgaataaacatgcaggttgatggatggatggacagaccaatggatggatggatggatggatggatggatagcatttttaaggcttagttcaaatatcgtctcctcagccaggtgtggtggctcacgcctgtaatcccagcactttgggaggccgaagcaggcagatcagctgaggtcgggagtttgagaccagcctggccaacatggagaaaccccgtctctaccaaaaatacaaaaattagctgggtatggtggcaggcacctgtaatcccagctactcaggaggctgaggcaggagagtcgcttgagcccaggaggcagagattgcagtgagctgagatcggagtatggcacaccagcctgggcaagaagagtgagactctgtctcaaaaaaataagtaaaaattgtctcctctgtttagccagcaagccacagcaggggttcttgtcctattcaggcatccatttgtcaggggcgggattactcaggctggaaggaacacctgtgccttcatgtgcatagcaatgtgaagaggtgggggaaacctctcaggggctttggaggctacccagtgaccttccacagcttgccagaagctcctctgcaacattcccaccaagggactcttctttgcttgtggaactccctgcctcctgaggggtcccgttgcattttgggatcccatcgacgtttgcgtgtgtgcctgagtgcactgtgggagtgacagctgagtgacctgagtgctcacccctgtcccgcagctccttggggctccttagccatgttctcggctcatgctgctgacagaggacaccatgcaggaaaagcaaaataagagcaggaggttgaatttccttcttgccatttactagttctgtgaccctggatacatcgtcagcctttcagagcctcaaggcccaccttatggttgattttgaagatggcctgaaatagtccagcaggcagcgcctgatacagagtaaacactccataggtgtgagtgtgggtttcttcattcattggaaggtaactgggtgttcgtgtggcttttcattgaaatggggatgaagattcagagagtttggagggatccaaggtcatatgtggagctgacatcacttttgattcagaacctgtgctttcctggttgtgtcactagtaaatcaagctcccaaggagaaaagacagcaataagggtgatttttattgtaatgataataataacaactccaacagctaacacatagagtgctgaccatgagacaggcgctgttccaagcatgtaattcgtttactcttcacagcagcctagggaagcaagcagtgctaatatccccattccacagtgaggacagggaggcacagaaaggtgaaggaacttgcccaaagttccacagctggtttccagtggcactgggattcagacgcaggcagcctgggctgggatctgtgctctgatcccctgtcctccactgcagcaaatacgggggagaggcagcatccctgggatgaatgagactgttgctccagccccatctcacagagcccgctctgccattcccaaactcaaaacaggatatcttattagctaaaggaggaggcagtgtggtaaggaggaaagggctatgaggctggaatgaaataagatatgcaaaatgggccaggtgcggtggctcatgcctgtaatcccagcactttgggaggccaaggcaggcagaccactgaaggtcgggagttcaagaccagcctggccaacatgatgaaaccccgtctttaccaaaaatacaacaattagctggtcgtggtggtacacacctgtaatctcagctgctcaggaggctgaggcaggagaactgcttgaacctggaatacagagattccagtgagccaagattgtgccaccacactccagcctgggcgatagagtgagactttgtctcagaaaaaagatatgcaaaacgtgtagcgtagagactggaaaggcagatgcattatttctgaagctctctagatcccaaccaa

SEQ ID NO: 17136 - DNA, 51022 bp, Human; identical to SEQ ID NO: 17135

SEQ ID NO: 17137 - DNA, 51022 bp, Human; identical to SEQ ID NO: 17135

SEQ ID NO: 17138 - DNA, 51022 bp, Human; identical to SEQ ID NO: 17135

SEQ ID NO: 17139 - DNA, 17117 bp, Human
  misc_feature (1)...(17117): n = A,T,C or G
gctacggcttagtgaggctcaggacagtggccctggagaagctggtcaggcccctcagcctcctcagagcgttcaaggtcctgtcctaagaacatggggttgctggagccaggggtctcactccattgcccaggctggagtataggggcatgatcatagctcactgcagccttcacctcctaggtcacatggtcctcccaccttggcctcccaacgtgctgggattattaagggtttcttacattagtcacggtagatcctgctcttacattagtcatggtagatcctgttcttttttttttttttttttttttgagacggagtcttgctctgtcgcccaggctggagtgcagtggcgtgatctcggctccctgcaagctccgcccttcaggttcacgccattctcctgcttcagcctccggagtagctgggactacaggcgcccgccaccacgcccagctaattttctgtatttttagtagagatggggtttcactgtgttagccaggatggtctccatctgctgaccttgtgatccgccctcctcggcctcccaaagtgctgggattacaggcgtgagccaccgcgcctggctatatcctgttcttacattagtcacggtgggtcctgttcttacattagtcaaggtaggtcttgtcgtatctttacttttaacactgtttattgtggaccttttccttttttttttttttttttttttttttttgagagtcttgctctgtcgcccaggctggagtacagtgacacaatctcggttcactgtaacctctgcttcctggttcaagcgattctcctgcctcagtctcccgagtagccaggattacaggcatgcgccacacccagctaatttttgtattttagtagaaatgaggtttcacccttttggccaggatggtctagaacttctgacctcaggtgatccacctgcctcagcctcccaaagtgctgggattataggcgtgagccaccgcatctggccaccagtggatttttttttttttttcctgacggagtcttgccctgtagcccaggctggagtgcagtggtgtcatcttggctcactgcaacctccgcctcccaggttcaagcgattcttctgctttaacctcctgagtaactgggattacaggtgcacgccaccacacccggctaattttttgtatcttttgtggggtttcaccattttggccagtcttctcttggactcctggcctcgtgatctgcctgcctcggcctcccaaagttctgggactacaggcgtgagccactgcacctggtggactggattcttttaaagcaaacccatagttttgaatcttatatgctctgagtacgtttctttaaattcagagaaacaccacagcatcataacacctgaacgttcttacgagcatccagtcaggtgttcccagcagcttcataaatctcttttcgcagttgatttattcacatcaagggccagtcaaggttcacatacaccagggatcagtgatcgtttctggactcacttttaaattctccgatgacaaacgtcaagcctgaaacccagggcctagggccagacgttgaagataaaatgtttccaagtcacagcctaaagctgggtgttagctaaaatgttacaaagtcacaataatgatgacagggcggtggggggtggggggtggctgttaggaccggctcccagatggcaccgtgaggcagggagaggctccaggatgctgtaggagctcccggagggccttggacagttctgctgtttgcacttgtcaaaataggcaaattcctgttcctcctggtgatgctggctgggagcgatgggggatcgcggctcctagttcagaaggaccgggctgttcctttctctctgggccttaggggggtctctctccctcctgtgtcctgaaggggaacctgcaggggaaatctgttgtgtcaggacccctaccctcagagccactgtctgctctgtcccctcaggaatgggtaccacagaccatgtcatcgtcctggcgtccacgaaccgagctgacattttggacggtgctctgatgaggccaggccgactggaccggcacgtcttcattgatctccccacgctgcaggtcagagccaggatcccagcctctcccactccacctgggccgcccccactcgctctgagtggtctggcctctcctctaagacacttcttggtgtgaagcctgtcacagccccacaggtgctggcagtgtccagcgtggcccccgcatcggctgcacgcccccagcagacctgcccaccggctgcactcactgctgtggcccccacattggctgcacgccccctggcagacctgcccaatggctgcactcactgctcggggttttgcagttctgttcacctgctattggttttccttttatcctgggtatcagtctggtttttatagcaaatcctttgaaacaaaatccaggaggaaaaattgtgggaaactttattcttgtgtggcatcacttccttccatccgtagcgtgggctctggggacgtggactgtgcagctgccctgaaattggggtgggagtagaagtcctgaggcctctcgcctgatccctcctctgtcacagggctctggttggacgttacacttcctggccaaagggcctttgttgctgccctgagggagcaggagttcagctcatggagcggagggtttggagagagggcctccgggtctgctggtgggttaatgttccatcagtgcagcctggggagcagggctgggctcagcggctctcagccggtgctcagtctctgttgggatggagagtgaagggcggagcagaagcccttcccgctgggacacggcttctccaggggacactgcttctccaggggacatggcttctccaggggacacggcttctccaggggacatggcttctccaggggacactgtttctccaggggacactgtttctccaggggatggcagcttctccaggggacacggcttctccaggggagggcagcttctccaggggagggcggctcctggctttttgactgtgtaagaaacattttacatcaggatttagacgcatggaacatgtgtgggaattggaagttttgcagaataagcatttgctgtgtgtgacgtgcttcattagctattctgctataattttttcttttttctttttaattttttctttcaatttttagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggtgtcaaacccctggcctcaagtgatccccacccacctctccttccaagagcgttctcttttttttttttttgagacagtctcactctatcccccaggctggagtgcagcggcgcgatctcggctcactgcaaccaccatctcccaggttcaagtgattgtcccgcctcagcctcccgagtagctgggattacagacacccgccgtcttgcctggctaatttttgtattttagtagggatggggtttcaccgtgttggccagactgcccacttcagcctcccaaagtgctaggattacaggtgtgagccaccgggcccggccatccaacagtgttctgttcgtgtttaaaatgctgcttgtggccaggcatggtggctcacgcctgtaaccccagcactttgggaggccgaggcaggtggatcacttgaagccaggagttcgagaccagcctagccaactttgcgaaaccccgtctctactaaaaatacaaaactcaggcatgatggcacacacttgtaatcccagctacttggggacccccccccccacagacaaacatgccgcacctgtggcagtaactaggcttgagcccaactgtctttcctcccctggttctggcaggagaggcgggagatttttgagcagcacctgaagagcctgaagctgacccagtccagcaccttttactcccagcgtctggcagagctgacaccaggattcagtggtacgttctcaacccgcagcctgggcagcgtcacgtcctgagggcaggtggtgtcacctgcgcacacagcatcgaggcctcctctgtggggtgggcgctgctccttctctgggggcctctgctcagtacaagcctgggagggagctgatgtgtatgtggggcagcaggaggtccagacggcacccgcactccgtcctccgccccggggtggaaaagcagacggtggttcccggtctgtgttgtctccagagatagtggagttatgttgcttccacacagtgaccagtcatgccggcgtttcccgtcagacccagagtcagaccacgcagtcccggcaaagccgcctccctctgaccctcacagtctctgtcaagttgtagaaatagaaatcatacctcaagatgcttttcctgctgtgtggttcacattttaaaagttaatgtcaacaaacctcccttttattatgagatgaatttgccctttgattattcgttagggtctttcactagaattttgtggttactagagagcctttaatttctttgccatcaatgctcatgagctgttaggtggaatcagccacaagatggggtgtggaactaactgcccttgggaggagagacgggcgtcagggcggatggagcctggcggttctgtgtctcgtctgtggaatggcctcagtggaacacggtgcaagtgcctgccgctctccccacccctgctcctggcgccggcgcctgccgctctccccagctctgctcctggcgccagctccccgtgcctctctcccacacgctctcaccagcactcttggttcttggtctcttttccctctttgttcttccttttatttatttacttatttattttgagacagagtcctactctgtcgcccagactggagtgcagtggcgtgatcttggctccccgcagcctccgcctcctgggttcaaccgattttcctgcctcagcctcctgagtagctgggattacaggcgctcaccaccacgcccggctaatttttgtatttttagtagcaatagggtttcaccctgttggccaggctggtctcaaactcctgacctcaggtgatctgcccacctcagcctcccaaagtgctgggattacaggggtgagccaccatgcccggccatctttgttctcccttgagggccccttcctcctcttaagccctgatagcagaaacccacccacccacaccgtggctgtttgtgttgacaggggctgacatcgccaacatctgcaatgaggctgcgctgcacgcggcgcgggagggacacacttccgtgcacactctcaacttcgagtacgccgtggagcgcgtcctcgcaggtacagggggcgcgccctgggtgaaggccctccttagcagggcttgaaccccagaaatacccaggcaggtattgagaggtgaggtggatggaaccatcacacaggaaggaacacacgttgcgtttcagttctgcgtaactcatgtctttatgataccttgtacttttccttagtttaaaatatcacagatttacctaagagtagacgctcgtccaacagaaataaaaaatgccttgccaaagaaagtgaaaaaataaaaataaaaaatgccccccaaaaataaaaataataaaaactaaaaatgtcttgccagcctgggtgtggtgggctcagcctagccccagcctcatgggggctgagctccagccgctgactgtgggccggagggctgctgccgcccgtggctgtggagggacagccgtgctttcagcgcagcaggggctctgcggagaggtgtggatctgcagcaccacctctggtgaaactcatggtcccgaccgtcagtaggaacgggagatgagttttggtgacgggtgaccggtgggctgaccgcctctgactgccgttccgtggctgctcagtgtggggtctgcgacgtctgtgaggagagaggaccaaactgggaatcggagctgctggaggtttccatagctatgatggcaacacccagacgtgatcagtcatctcatggaatggagttcagacccgcactgtcagtgtgagacaggttgaacgtttgaaaagggaagtggttcttgccccaggtgtttgaggagcacgagcctcctttgcgagctatccctgcgagaaccgagttcctcaccctcaattcgagtgaattcctagcacgaacacgcctcttgcaggtccccagggcttcagcttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccagtaagctgaacaggggagatttaatgcaaacatttgtccctggctgggcactgtggctcatgcctgtaatcccagcactttgggggctgaggcaggagggttgcttgaggccaggagtttgagaccagcctgggcaatacagcaagaccccatctcttaaaagaaaagaataaagagtattagccaggcatggtggtggagcacacctctggtctcagctactcaggaggctgcagcaggaggattgcttgaacctgggaggttgaagcaacagtgagccgtgatcgcaccactaccctccagcctgggcaacagagtgagaccctgtcactgacagaaaaaaagccttgtccctgaggcaaaaagcttctgaaggggtgagtagaagccataaggatccagaaagtgatggggatgggagctgcgcctccaggtctgaggggagagggaaagtaagcaggaggcccgtaactcagaggaggcctctgcccatcctgccagggagaaagtcaaaagctgctgttctgtgacccttgccccgaccctgtggcacccccccaaccatggggcaggaggagacactcctcagagggttgcacttgttcctaaaagcagcaggagctatttcgatgattgcaacatttataaaagaagaaatcacgacctccttcaacagccctttgacctgaagagtgtcgttttgagttggggtgtccagagccgcagctgcagctccaagaggcagatgtgcagagagaggcttgctttgaccacacggggcaggagcagggcccagccagggagaggccggggtctcagctcacccccccgtcattcttttttgtttgttttttgagacggagtcttgctctgtcgcccagcctggagtgcagtggcatgatcttgccctactgtaacctccgtctctcaggttcaagtgattctcttgcctcagcctcccaagtagctgggactgcaggcgcccgccatcacacctagctaatttttctatttttagtagggacggggtttcaccatattggtcgggctggtctcgaactcctgtcctcaggtcatccgcccgccttggcctcccacagcgctgggattacaggcgtgagccaccgcgcccaactcataccccggcattctttcagggactgccaaaaagagcaagatcctgtccaaggaagaacagaaagtggttgcgtttcatgagtcgggccacgccttggtgggctggatgctggagcacacggaggccgtgatgaaggtgggtcttggcaggtgccggctccacgggccttggccaaaggtgggtggggagtcccgcctgtgtctgtagctgactggggagtcccgcctgtgtctgtagctgactggggagtcccgcctgtgtctgtaggtcatgtgagaggaaagcctgccactgtcatgatccatggagcagggtgggtggcgactgatgggcgggaactcggacgtgggaggcaggagtgggctgtgtcacatcggagcatggtgctgctactggggtgactcgtggaaggttacaccatgcaatggggtttcgctgcctttgcctgtccaccccaaatgactcctaacattggaaagaagtgagttgagtgtacatttaaaaaatactattctaggctgggcatggtggatcacctgaggtcaggagttcaagaccagcctggccaacagggcaaaactgtctctacttcaaacaaacaaacaaaaaactactcttgtaggcagctgtgaactcgatggacatttattcttaccaaatggtgatgttacagcttctctaagacgtggctccaccaccgggagtccgagtgctgccaagaggaggtctctactcggaacgcaggtgccgtctttacagtggagccccaggaagccgtgcaggtttgaggctcacctgagaaggcggcagtgctgtgttcctacctcagggttcactgcaaacaatgcatacgctgtagcagttgccagcttggtttgtcagtgctggtctccgtgattggttctcaggtgtgagttgtagcaaagttgcgtgttaatcagagagcgtcctgcccatcccagggtctcagcagggctgaggcagcgtttggggaccagatccgtgctgctccttggcgatgtgcaccacagtcatgggaccagagctaggcccactgtggggcgagtggacactcagctgggggtcccatttatgggacactaaaaaactcagcagtgaacacgacgttttaacacggtatgtcaagaaatcaaaattaatgcagggactttgggaggccaaggcgggcagatcacttgaggtcaggagttcgagaccagcctggccaacctggtgaaaccccatctctaccaaaaatacaaaagaattagctgggcgtggtggtgcgtacctgtaaccctagccacttgagaggtagaggcacaagaatcgcttaaacccgggaggcagagtctgcagtgagccaagactgtgccactgtactccagcctgggtgacagagcaagactgtctctcaaagggaaaaaaaaagaatttttactgtatttgatgggcaaaagtcagatagtcacaatgaaaaagtgagtctctttcccaaggctcagtgtcctgccaggaaaaggttgtgaattggctgttatggttttggtcattaatgcaatcatcactgcagccgttatttagagcttctttttgttttgagacagggtctctctctctgttgcccagaccggagtccagtggtgcgatcacagctcactgcagcctcgaccttccgggctcacacgatcctcctacctcagcctcctgcatagctgggactacaggcatgccccactggtggctcgagtgatttttatattttttgtagcgaaggggtctcgttatgttgcccaggctagtctcgaactcctgggctcatgcaatctgcccacctctaactcccaaagtaccgagatcacagatgtgagcgaccccgcccagcctagttttagattttaaattaagcgtcctcgggattctcagagcacttggatgtggccatctcgccgccacaattctcagaagcagcagctgggccagcccctgccccgtctccgtccgtctcccactcagcggttccgtgttgtcgagttagctcgttgccccgcgccacctccttgcacacctgatgtggggctgtgggggagcagcagaggtgaggacagcctctgctgcctcagcatcgtggggttctcattgctctgaaccctcagtagctgtcgctggtgtgaggggtcagcgcagcggccatcgggggtgaaacttgtccttcgcctctcagctgtcttctacgggccttgtcttcttgactccctgcctgtctagtcatgtatgagaagacacttcccggcagtgtgtgaacaggcacctgtggtgggaacgctgctgtctctgggctggccatctagagtgttaggatcccctgttgttgtagaggatgctgcacatttgccttcctgctttgagacgctttaatgacggagacctcttagtcccacaccttcctcctcaaagcccacgcatcctgcctactgacctgggtcatcttgaccttgtgccaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggtgaggagcagcggcgcgggccctggaggtttcagagcgcttttccctgcatgactccttctgttccagtgcatgccatggggtgaatctggtgtagacgtagctttgaatttattaagtattttgtaaaagataagttgtggtcataagagagttggagctaagcaagacttcttagataatttaattggacaaaaacttaacctatatgccaactctagacacatttaattggttaattgttggtaatggctacaggaaacggaataaaattgaagcggcttcattgttctgaagccattactgcactgggatatccagagagctgaaggagggtcccgggggcccctgggctccaggtccatgggtttgcctcgcataggcctgggcttgtgcttgagaactgccatgcagtgagctccagtatgcccccgggttctagatttccaaataaaagagcatttcggaaagttttaagactctcttaaggaacagtggtgaggtgccaacgtcctcactgtccagcttcacggtgggtcctcgggaggaaggggatggaggtggtgctgcctcagtgctctgaccgggacacctggggcccagcactgctctgcgcctgcagtgctgaggatgcctctgtctcgaccccgccctccaggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgtgagtcggctctggccacaccgctgccctctgtgctccccggggagggagtccctgggtctaccacacaagggtcgcccacggccgccccagcggagctcagctgcaggccccacctgggtttcttccttctgggctctgctgtagttcccacctgtggagtattttcttctcaaatgaggacatagatgctcctaatgaaattatagatgtgaatctgggaagaatatcaaataaatacaccgagcaatagacccagggcccacatgtccttcagactgggccaggaagggccgatgtgtgcctgtgaggcagctgtgggtgggtgtgggtgggtgggctggcatgcggagccctgctttcctggcactggtcacaggggcaggagaccacctgtcggctgaggagtcctgttcctcctgggaggggaaaggccgtgttcccagtctgccatttcttttctgtgctttggtgctggagccaggcggccagccttgcccctgacacagttccctccactcacaggaagcaagactgctggtggccaaggcctacagacacaccgagaaggtgctgcaggacaacctggacaagttgcaggcggtgaggccctggccaggcgtgggggctacggcgtcacacagtgtccacacagcacccacggtccccacccctctcgtgaagtatttccaaggcacacagagtacagagaacactctgaccgatgtgaattctacccagctcaactgaaacttacgtgttccatactttttatcctgaactcgtcaagtgtgttcccccgaggtagaaagaaggctgccacagtctcctgtgcctcttcctgccattagcaattaccaatgttttgtcagttttgtttaatcttttcccaagtcttacacttttttcttgaacatttttttaaaacaaagctttaattttagagtaggaatttttttttctttttttttttgagacaaagtcttgctctgtcacccaggctggagtgcgatggcgacatcttggctcactgcaacctctgcctcccgggttccagtgattctcctgcctcagcctcccgagtagctgcgactgcaggcatgcaccaacacactcggcttttctttttttttttttttttgagatggagtctctctctgtcacgaggctggagtgcagtggtgcaatctcagcttactgccacctccacctccccagttcaagcattctcctgtctcagcctcccaagtgtctgggattacaggcacgcgtcaccatgcccagctaatttttgtatttttagtagaggtggggttttaccacattggccaggctggtcttgaactcctgacctcaggtgatccgcctgcctcggcctccccaagtgttgggattacaggcgtgagccacagccccacgctgattatagtgttagatgtagaaaagttgcaggcgcggtgcagagagctccctgccaccctgcctcgctcccgtggaggcccccatggggcagtcctcccacctgaggagcccccgccgacccgcggtgttgggtccacacgtgattcagatgtgctgagtctccccagtgtcctttccggtcttgggagtccacgtggcgtttgatcgcccatcttcttaggctcctctggggtgacagttcctcagacctcccttgttttgagggctctggcagttttgaggattggtctcatgttttgtaggacgttcctcagttgcgattgtctgatgtgtttctcacagtgggcagagctggagtgaacgtttttgtccctgggtttggtaactgctgcttagaactcaggagaggtgcacggctctttgtcccatgttgtgaacagatgggtaggcagtggataggtagttgtttcttcagcctccccttgtgtctttcaagcgagcactgtgtgtcacgtggggatcgtgtttggggcccttagactgtcgtccccagccagcagcagccgcctctgggcaggtgtgggcggtgccgtccccggctgaagcaggcctgcctgtggacccatgctcatcacggttgacaaagcagctctgcagagctcgggcacatcacagtgggagccacaacgggagcaaagctgcaggcaaggcttctcactggctgaggagtggtgtgtctgccccgtgtatgaactgtcagctactcacacactcagtgggttgcagaacttagtaaaatcccacaccagccctagagaggaagtgtttgtctcttgcaatacagccacaggtaaatcaccctagcttcaggggttaccattttctttagaaaatctggaagagtgaggaaaggagcaggtaattaacaacaacaacaacaaaaaatctggaagagttctgccttcacagaaaccagtgaaatgtggctgtggcagtgttttctgtggtctggccaggccaccccaggggcaggtccaccggcacaggacagtcggtgtctcaagtgttttccaggatcccacctagaatggcagaaattcacttccccaacttgagaggtcccagctcacacaacttcgcctcagattccttctcccagtgctgctctcctcaatcaggagggttcagcattttacccatctccttccctgtagacacacacgtcttgtttggtgaaagaaattgcagttgccaaaaataagccaagattttgaatagaagtagaaaaattaatgaggctggccgccggaaaatcatttatgaggttgagatgggggtgattcttctttcggagctgcctccgtgcctccgcttccctgggaaagtggcctgtcctgggtgtcctgcacacagacaggccctcacgcctcttgccacctccccaggacatagagatgctctgtctgccctggggactcacacactgctatgcctgttctttctagctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatctacatttgcattgtctggccagctctaatgcagaggagctggtgggcttgccctggatcacagggtcttgtggtttcagtttataatttgagtaatgcagggactaagtgaaaaactccttctgtaggaatctggggcctggaccccgtagggatagaagacgacccaggacaccctggccctgagttccggggcatgcggctcccactccggcccccttgcttctgccctccctgtggtgcagtgacgtgagtggattgtcctcttgttgctgcaacactgaaacgctggcggagcagtaaggaggcagccacaggtgcagtcacacacccgagggtggcatctctgagagatgccttgacctttgccccagttctccaaatccaaagaccagcacatcgatgggagggttttagctggtgtagccaagggtagtgtcctcggtaattgttttttttttgctgttgtgttggtttttggcagagtcttgctctgtcgcccaggctagagtgcagtggcgccatctcggctcactgcagcctcgatcttctgggctcaagcaatcctcctgactcagcctcccaagtagctgggaccgcaggcacgcaccattatgcccgactaatttttgtactttttgtagagacagggctagactcgaatttctgagttcaagtgatcctcctgccttggcctcccaatgtgttgggattacaggtgtgagccactgtgccaagccttttgtgaaattaatttattattttttaattattatttgtttttggagatggaatcttgctctgtagtccaggctggagtgcagtggcacgatcttgggtcagtgcaacctccgcctcccgggttcacgccattctcctgcctcagcctcccaagtaggtgggaccacaggcgcctgccaccacgcccggctaattttttgtatttttagtagagtcggggtttcaccatgttagccaggatggtctcgatctcctgacctcgtgatctgcctgccttgggctcccaaaatgctgggattacaggtgtgagccagcacgcccagctcttaaatttttcatttttgagacggaggcttaactctgtcacccaggctggagtgcagtggtgcagtctcgactcactgtaacctctgcctcctgggttcaagtgattcccctgtcctactctctggagtagctaggattacaggtgtacacaaccacacatggctaatttttgtatttttagtagaggcgggattttgccatgttggctaggccggtctccaactcctgacctcaggtgatccacccgcctcggcctcccaaagtgctgggatttacaggcatgagccaccgtgcctggcctgtgaaatacttttttttctttttgagactgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17140 - DNA, 75378 bp, Human
  misc_feature (1)...(75378): n = A,T,C or G
tttggtccggagaagtctgaagttaacctggccattgagtgttaccattctgtagagaataacaatgcctaaacatgacacatttgtgcacaacttaatcagtagcctgaacttttcattcagccttggacaatacatcttggaattcacaataatgcagatcctcagaaccaagtcagtgtcatccgtataggaggctgttactgtaacacaggctcgcatgccccttctgggtgcatcaggggtggtgttcacagcattaatgctacatctgaataaacaaggacactactggcctttacttaatccaattggttctttcatctgttcatcaaatagccaacactgatatttataaaatacctcccaggccatctcagagagacaaagtggaagacaataaagaaaggaagggttggagtgtcctggtcagtaggaaggaagtgcacacagggtcctctagtaggcgaccaggttttttacctctacctgcgtgacctcaggtaggtactctgctctctgggtggtgggcaacagggaggctcctaagtaagtcagtggcccagagtttggaagaggttgtctgcccccagctctgctactttctggacatagaaccttgggcaagtcattgcagctctcggggtcctcctcacataagaggacagtggccaactgtaggacatgtcattttagagctgtgaggtacacagcccatatggcagtacctgtcaaccctggacctccttcctcctgaggttgagttgagaattccacgaaataaaccataggattcatgcacacaccaggctggatctgctactcactagagattgactcccttctccttctctcacctgaggtacattcctacattacagcatctggaaaagtatccagctctggggtttggtgacctggtttctccagggtaaaacttatgtacagaggtttttaggtccatgttgtcatcctgtaactgggggaacctttctgatcctagagaagtgattgaggtgtgacccttggtggcttagtggatgccaaggtcaataattaaaacccaggggtgtcatcatatcctaacttggggcacccttggagaggcttaccagaaaacaccctctttgttgtttttatttctcagttttccaacagatggagaagcagaggtgtagggagtggccggaacatgtgtgggatctgaatttgcccaaggtccttatctggtgcatcagagagttaaaggcccaagccaatgttcagacagtgaggtccagagggaggaagcatcctggccaacagcaagcagctgatgaacagcagagcattagaggacagagatgaggaggaaaggagagaggtgagggaaggacctgaagctgctgccaggactgagagaggaaaccataggcaagtcttttctcttgggtccctggagctgcctcctgccatttttcatcctctattgcctgtgtggacatgtgttcacattcacatgtgccagcacacatagggatgtagaaagccctgaaatagctagattgagtcctagcttgtaatctgaggtctggggcaagtgatcagtacacttgtcatctgaggtccttgagcctcagtttactcatctgtaaaatggggttgcttgatgcctgccttgcccacttaggtagtaaaatgcacaaacccaaatggtctacctccacagcctgcactgatccagcctcccccaccaccagcagaataatctgggaggttgggcacatgaccctgcatcaaagaatgcatgagtgcctctctgcacacagccctgggcagtgcccatttctctttcagctcagtgaatgatggaaactcatggaagacagcagacaaagcagccccagggataggggagattccagagaggcccgtgaccaggccacagggatgctggggctgtaaaccaaaagccactggactctgtaaacccactgggcaccacagaggcagaaggggtgatgagtgagaggcgagtggtagtggacttgcccaccagtgccagctccagcatgcccctccagaggcgcagggcgtccttcagggggccacggtcatcatcctccctggagagccccccagcctccaggaccaatgccatgagtggccttgtccgagcacccggggtctatgtaggaacagcacccagtgggtgcataggtggcttgggtgcccgtgtgacccgccgggccctcggcatcagcagtgtcttccttcagggcctgcggagctcaggcctggccaccgtgccggctccaggtttggagagggaccatggtgctgttgaggacctagggggctgcctggtggaatatatggccaaagtgcacgcccttgagcaagtcagtcaggagctggaaacacaactgcggatgcacctggagagcaaagccacacgctcgggaaactggggtgccctacgggcttcctgggccagcagctgccagcaggtaagtgtccaggctgtgccaagggctttgcagagggctgggaggggctgctgaaggcagcgggtagggttgtgagtaggctgaggccagagaaactgaccataatcccctacactttcacacttaaaatggtaatgataacaacaatgctaccttttaccgaggtttactaggagcccacgctagcccccatacgtgcactacccactatcttctttaaacttcaaagaaatgctatgcagtggatcattcactgattgcatttttcagatgagaaactgaggcgtgtaatttgcccaagacttcaaagctagtagagggatggagatgagatttgaacctgaatttttgtgcctccaaagttgcatttgccccattaccctggggctgcctcagtcacctttactgttgagaagggatttttacagctattatccaatcaaataccattggatggatgaggtgttaagaacaatgaataaatggaggtgtgttcctgtatccacctacaaccacgctgttcaatagaaatatgaactacattggtaattgacaagtttctattacccacagtaaaacacgtaaaaagaagcaggtgaagttaatattatagcttatttaactctatatgtccagaatgttatttcaacatgtaatcaatacaaaatatattaatgaggtaatttacattcaagtagagctttctgcgtgatggaaatattaatatcttatatctgcactgtccaatctggcagccactagccatatatggctatcaagcacttgaaatgtggctaatgagactgaggaattgcatttttattttatctaattttcattaatttaaatgtaaacagccacaggtagctaatggctatcttattggacagggaaggatgcagaggtttcatctttctcccttgcttggtcagccctgcttttcccactctccagggtgatttctgcggagtctggagcacatccatcatgtctggcctgcagcctgtagttctaatgctgggactccagccagcattacacctctcagctggtctctctgtggatagctggcttcacctctcctcctcctctttctctccagatgctggccttgggatccctctgagcaaaatcagtctctaacccaccagggactgccaactcagacccttggccccctggagtccagtatgcagcctcccaagaggaggtcacaaaattttatttgtgtatagctgggggaagctaagcagttgcacacagggactccccatttgcccctcctgcctcccacttcatcccaggatgcttctcctgcactgctgtcagtgcccactgacagcacagagtgcatgatgaacagcaccatcctctcaggctctccccctggtgctgctgttctgcttgcatccatctgggctgcaagggagagccatcttagaacagtccagggccttaacgcctgtcaaatctaagaggcagccattcctccaggattcttcacaactgtccttattccaaatattgtgccataacaaccaccagaacatccctagatactccaatatgtcagcatctgctggacaatcgcttgcaatcagatgccacacagacttgtcaggagaaatcaggtatcccaatggctaggttaaaaagtagggccacaaaacttagtttatactcaatagatactgacttgttctggctccagatagctacaagagcctttgcaacttactaacttctctgggcctcagtttcattatctacaaaatgggtataacaatgcttacatattccagcaaatctgtagacaaataagagcctggctcctgcttacaggtagagtacagactaggaagctctaaaatcctgtgagagcaccacagccacacaccaagacatgcgacctctgtagttgagggtcaggatcccacatgggctcactttcctcttaagtgactataaatgagggcctgggtatgaataaagttctctttttcttcttttttaaaaaatcatggacttgaagatagagtaagaccaattgataaaatggagttattatttctttttttttttttttgagatggagtctcattctgtcacccaggctggagtgcagtggtgcgatctcaactcactgtaacctccacctcccgggttcaagcaattctcctgcctcggcgtcctgagtagctgggattacaggtgcacgccaccacgcccagctaatttttttgcatttttaatggagatggggtttcaccatgttggccaggctggtcttgatctcctgacctcaggtgatccacccgcctctgcctcccagagtgctaggattacaggagtgagtcaccatgcccagcctggagttactttttctatattgcacagcccagcctttcagccatattaaactctattccatcaagaagaacaaaagaaaactccataattgagaaatgctcctgattttttcagtgaatctggcctcgtggagctgcaggaggcccccaccaggcccccacccctttccaggcctagaggaaaggccacctcccagcccagtccttccacaacacgctgccttcatctcacttggggtcagaggcagccactctgcggtcctgggccccagaaatccagagctctctccctctgccctcacttaggccactctggctggggcttcatgcccacctttccagactctgggctctggtgttccgtgctcctcacagcactccttacccctcctgtttctccacctgcagctgcctcttcccccccttgtccacagaactcctcctggtcctgcagctcagttccatggcaaccctctgtgactcctcagggcccatgcagggcctgaggcctcagagcaagctctcagcaactgagccccaagttggcacctagagagaaattcgacctccttagcctgggccccaaacagagaatccaagagagacctcagtcactcaatagcacggtggggatgtccattttggtggcactttcttggatcaggctggagcaagcagtggggaaggtcagagcaggcaacaatttccataaatgtttgggaaacaacatttcctcttgctttcagagggggagaagagttggaaaggagacaggctctcctccctgccatcaccaccccagctagcacagaaagctcctggggccattctggggagtgggggccccctgtcccctggaatctccccacagcctgtctcacccccacccagaggagacaaagacaggttttcagaaaagccaggaagaggagccaggaggagggaaacaattgctgtcactgtgcagagagtcacatcatggaaagcaacacgaaactagggtgccaggagggctcacaccatggcagaatcaggaaggccgtcctggggaggggggatcttcctcatccttatatcactatgtaagtttggggccagggttggctccatgggtgcaccaccagtgaagtctcataggatgctgcactggagtgcagcgatgccatcagagatcactgcaacctcaagctcctggcctcaagagatcctcttgccttggcctcccaaagggcttggattataggtatgaggcaccgtgcccagccaatagttttatctttgaatttgtgttttaaaagtgaagtcttgtgggacaatggagtatggaccaggggctcttgaatggtcctacctccctctgtctccctacaacaggttcttggcccacctctctgcccctgggagccccttctgacacctgctccaagcccctgggtggcagcaactggagggagaggacaagcctcttgctcacccccaacccaggtacctacaggtggcactgaggtcgtaatattcttgggggttatcaccccaccccaccagcaggacatggtacatcggtccaatggccggtaagaaaggtaccgcagccattggtggggtatgcacatgcccagaatcatggagcgaggcctctggatgcctataaaggtctgcatgagcatccccattccccagggagtggaaattaaatagcagataaaaattaccataacaagttgaaacatgacagaagaaaggaaaaagcattatatttgagtaacttaaatcgcactttgttcctgctctttgaacatggggccccacattttgcactgggatccgcaaattatatagctggtcctagttagggttcatgcatatgaagttctgtttcaattccaaacctctctcctcccactcctcagctgtgttagaacctccaagcctcgctaagtggtgaaaacggacagaaaaaccccaggtggcaactacagaggctgaggaagacctgggccatttccctctccagccttgctctgtgctcctgacttttcttaccaaatgaacgatgctgacaataggctctgatggcaacatcaggccctttcatcctcaaataggccaaacacaagcttggaataaggcagccttgtgcctcggagctgcagatgaaaggagagtggggtcagaggagcagccctcagagaccaggtgtcaaaacaaaaggaacagctgaagccagggggagaatgaagctgcctgaggaagaaaggggagcgcagaggttctaaattaaggagccaggacatttgtctaggtctccatgggagaaaactgcagcttatacctccaaaggataaggctgtcagctggagaaaatgggaaatcaaaattgttgaaaggcaaaggattagagtttaaaatggacctgatttgactatttttcctgctgttcacagcccgtctttctgtcccttgcacagagacagcccatactcagggaatctgcctacttgaagaacatgctggaaactcaggcaatccagatctgggccaggtttctcccacagaacttgtggtcctagaaggctctctttttagaaaaaaaaaacaagaactaatccttctccactgagaataaataaaggcaacagggtttgttgttcatgatttacaacctggtatccctggaaagtaggtgatgggggcagaatcataatctgcaaaggcctgaacacatttccccaagaaaaagtcactcagcctgtttcttaatcagtgcaatttgtttggtcagagcaggccagtggggcggtttctttgtcagccaagctataagggacactacagtatggttagaaatgtagctaccagagaaaagtccgttagagagattcattcctcttaggaagagtgaggtatatgattggaagaaatattttgatgggagagggggagaaggaggcatgagcctgcttcccaagggtcttgttcatataatacaggtggccactaagcctctttatttatttttatttatttattttttgatatggagtctcactctgttgcccaggttgtggcgcaatctcggctcactgcaacctccgcctcccgggtttaagcgattctcctgcctcagcctcccaagtagctgggattacaggtgcccaccaccatatccagctatttttttttttttttgtatttttagtagagacagggtttcaccatgttggccaggctggtctcaaactcctgacctcaggtgatccaccagccttggcctgccaaagtattgggatcacaggcgtgagccaccgtgcccagccagtcactaagctgctttctaagaaaggtggtttctggaagttgaatgtgtctggaaagcaagagaactgctaaagaaaacagagggagactagggtgtggcactcagggcctctttccatgcccctctcatacaccacactcggccactcttaaacctcttaagatctcttaaaatgtgagttccatgttgggaaatggaagacagggggtggggtcagttttccatgaaaactagggaaaattagatgtgatgcaaagactggggattttgaagccagacagcccctagccttgccgcttgccatctaccaaccgtgtgatcttgagccaaggtcttcattgatctctgcatctcagtttctcatctgaataatgaggatgattagagacttcctttgacatgataaaatatctctaagaaggaaacactaggccttccacagaaattaagaatgagaaaaagatgcccgctctctctcgttggttagaggcagtagtcaatatgattagacaagagaaagtacttggtataagaattggaaagaaagagggaaaaatttggtctttctggaaatcccagaaggaacaatgtaaaaactatacgacaaacaataagatgatttagtgaagtagcacgttataaaataacatcaaaaagcaatgctgaggctgggcatgtgggcaaatgcctgtaatccaagtacattgtgaggccaaggcagaaggatcacttgagcctgggaggttgaggctgcagtgagccatgattctacaactgcactccagcctgggtgacagagcaagaccctgtctctaaaagaaaaataaataaataaatgctgctgggcatggtggtacaaacctgtagtcccaggtattcaagagggtgaagcagggggattgcttgagcccaggagttcaagaccagcctgggcaacaaagcaagggccatctcaaaacaaataacaaacaatgctatttatatataaacaaaaagataaaagagatgagaaaatcttatttatgatagcgtaagatgaatcacctctaaacttcagaaatgtccaaagtctatattagacaacaatcaaatctatctgaaacacacaaaatagtcttgaacaaatggaaagaaacaccatgcactcaaatagactcaatagcataaagatgtctcttctccctaagttaatgtatcaatttaatgcaatcctaatttttaaaattccatttttttttctagagttagatgagttgattttaaattccctttgtaagaacagaaagacaagaatggccaggaaagaaaaactaagaaagagtggaggggaggaggctggggaggggaccagcagccccgccagacattaacatattataaagtctctgtaattaaaatagtttagcgttggcacaaaaaagatgagaaaaccatggaacagaatagaacattctatagtaagctctactgtgtttggaaattgagtattgatgaaggcagcatttgaaaccaatagagggaaggatggactttttaataagtgatattcagacaactagatagtcataaggaaaataataaaattagatccatttcttgctgtaccctagggtcagttctaaatgtatcctagatataaaatcaaaaatgaaaccatacaagtagaaaacataggtgaattcctttataacttggatgtgggaaaaatttttcttgttacaattcaaaatacaaaagcaacaaaggaaaatattgataaatttgattaagaaaaattttaaaatgttgcatttcaaaatatcaccataagcaaaattaaaagataaatgacaaactagaaaaaaaaatgcaatgtaggatacaaaaggttaaaatagccctattttatacacagcatttaaaatttgaggttaaaaaaagccgatagcactcttttatttttaaatgttagagatatgaacagacagttgacacaaaaaatagatgaaaatggctcctaatgtctcaactgcactcataataagagaaatttttaaaatctacctgagataccacttttacctatccaattagcaaaactctaaaagtatgtcaaactatttgttggtgaagctctagggaaacaggcaagtttatacagtgttgatgggaatagaaaatgttacaacccctatggagaaaaatttggcaacatctagacaaattatataggcatttatgtatacataatttgacccagcagtcctgtttctaggacacactcccaatgacacactggcaaaaatatgaacaagaagtatgtacaaagctgttcactgcaatcctatctgtaataccaaaatactggaaaaatccaaatacctcccaggaggggactcgttgaataaaccatgatgcatctgcaaaggaacaagaaatcgctctatagctactatggagtgatgatctccaggatatgttattgagctaaaaggcaagatggaaagagtgtgtatttcattctaccatctagctaagaaaagggaaggatatgaatatatacatacatatgtgtttacattggaaaaaatggaataaaacaaaccataagtatttttaaatgttacttataggagggtggaggggaaaaagtagcagggaaaggtagggcactagagttcttctaatttatcttgttatgtggagatgactttggaaccatgaaaatattttacagaattgtataacaaaaatagatttcagaaagccaattctaagaatcaaaaataaaaagaaacaaatgaatccagctatgtaccaagttgatagcatagtcacacgaagaagaactattccaagtggctttttaaaccacaggaatttaactgtacattcctagtggagatgcaaaagacaacagaaaaaaacccaacaatttttcagtaatcacattggtggtggtagcactggcactgttattctgacactggtgtgtgtgtgtgtgtgtgtgtgtgtgtgtgtgtgtactgtgggacagagtaagagagtaactatatttgtgttattgaaaactgagacttgaatgtgagtgaaaggagatacagttgtaagatgcatgacgtttagtgacaattctttagtcttgaaattaaatcagaattatcaatataaagtcatgatatatgtgatcatgaaaataaatatatgcctatttccaagtctgaccactgaaaagatctagaagcaatggccaacttagcgacaatgaacatttttagcctcagatttgggtctctaacaaccatctttcactaaaagaatggggggctccttgtagaaatggctgaatccaggttcgaggataggaaatatacaagacgagtctgaaacaccttgtcataccagaaagcaaggacgctatgaaaaactactacagtcatgtcagaagacttaggagtcaattcaaagaagctcccactaaccaaagatggttgggaatcaataagaatattatcagggcttccagtaaggtgaacaagaagacatccatgtgctgggagggtggctaccccaactccatggggacagaactcctgtgctcaggactcttctacacctcatgctgtggaatctaaagcaacagcaaagctgaggtccaactgccataaggatggacaccaaggaggctgcactggggagaaaaagaagtcaagataagcaacatgaaccataaagcccggaccgtggcgggtatgaaagaacaagaaaggcgggatcaggaaattcaacaggacgaagttgccttcccacctagctctcttctctttgctgagccatacaaaactactagcaaggaagataagttatcgagttgtatccagagtaggcttggaaactatggtgaaatgaaagattttataggagacaaatctataccaaggcttattgcagtttccaagcctacggtaccacctataacagatgaaaatggaccccagtaggacctctgcacccagcatttctgtcccagaaacagtcctcaggcttacagagtggacatagtagccagtagaccggtgcaggtggcagcagtggcactaacagtcgtggccagagacatgactgtgactcacatagcagtagtgggagcagaagaccagagaaaaatgtcagcatggatcacagcactccaagccgcgctcttccagccctgggaaaccccaggctgtctcttcgttaagctccagtcattccagctctcatgggaatgatcagcatagcaaggaatatcagcgctccaaatcacctggggaccctaatgcaaacggggattctccctctcacgtatcttttccaagtgggcagcactcaaatcagtctttcccaccttcgttgatgtcaaagttcagttcaatgttacagaaacctattgcctgtgtgcagcccgtgggcggacaggagtccgtgggcggacaggagtctgtggaaccagagctgtcctctgagcgctacagtagccaatcccatggtgacagcacaaatgagctgcagcccagcagcaaagcacatctcgccaggctgaaaatacctttctaaccgctggacctaagtcacacattcagagcttttaatattgtgactatgtgaagcaattgaacatgaaattctgattgaacttgaactgcctttttgccttaatagtaaagaatgtaaaagtttagagatgttttaaagtttaaagaaagacttgtgagccacttccaagtgaatccatagagacctgttagctcccctcttgggaaatagacaaaatgtcatttacagttttgaaatattaaagtaagtcagttatagaataaaagcatgatccatcaagttttaaaagaatattattaagaacattaactgcaatagattgaaatccatcaaatatgtcagtataacaccgaaaaaaaaaaaaaaaactaattaatcacctttggagcccactgaggaaccaactcatttttaaaactggtaaataatgagagaaaataaagcattttcctgcctttcttataagacctataggtatatccagtaagaaaaataaataaagagaggaattatctttttatagatgtattccagctaataaagaaaaataatagaattattaattttatttatatctataataaaacaatggctctaggcaataacaataatcaaatggctatgaccttcacaaaatgcgaccagcagccgttctgcatctcctggtggagtacacatcaccacctatgaagtagtcttgcaaacaaacaaaaaacctgaatatgattaagcctcaagataaaactactaatttacagaaaagaagggggtcagatgaacgggttaattctatagtaagctctactgtgtctggaaatttagttttaataaaggcagcacttgaagccaatagagggaagggtggactttttaataagtgatatttagacactagatagtcataaggaaaataataaaagtattattatagagatgaaaccagcaaaatccaaactctgggaaactataagacaaaagacccaattttttaacaaataaaaattgcaagggaaagaagcaagatggtaagagaaatctatacagtaaaagagactaaattaacatatcagcccatcaaaatgggctttatttggatcactatccaaacaattaaaaaatatattagacacgagaaaagataaacactatttgataattgagaaagtattacgaaagtattattaatttttagacgtgatcatggttgtgaagtcatgtgttctttttaaagcattcttataatttgccagtacaggctgaaatatttgaagaagaaataatatgatgtctgggatttgttgaaaataatctcaggcagagtggcaagacgtgtgggcacaagtaaaacaaaataggccacgtgcttataatcaaggaagctgggtgatgcatatatgggggtccactataacagatttcttgtgactgacatttgaaatttttgtaaaaatgcagctagaagacctacctcatcgggttggtgcaggaatgtaaatgaaatgatgtgtgtaaatcgcctggcacataatcaatgctttaagtttgtggaattgaataaacttgaagacatacattaagtgagcagtaacacaaacagctgcttacatgagcgcgttgatcaaccgacatacgctgtgggagtttccagaaagagcagggtattgattagttctcagcaagggtgccccaggaagtggggactgaatgtgggtcccaaggaagatgccagaagatggcccttcagagcggggccccgcgtggaccaaggtgggagccgggcatggcgtcctcagggcagtctgggtgccgggcaggcctcctaccaagcgccagctctgccggggccactgctctgtctccctccctctccacttccagagcctggcacagggaggcatacctcgacacacagcgggtgttcaagaaacggccggtggtgaaaggtgaatgtggaaccagacaggctccaggtttcaattcagaactccagctcaggggttctctgaaattccagaccagcagtgagacaggaagcggctgcaatgtctgacacagagaaacaacgcagcagaatcctctgccgctgtgagaagagaaccaggatgctggttagatactgacgtggagctggcgccagaatgtatctgagtaaccacgtctgtgctctgctactatttctgtttcttagaaagtggagggcagaccctctctggaagcacacataggggctgcggacagtggaggcttctggtgagagggctggggctggagacagggcaggagcaggcttactttggggtatatactctttgacactgtttggaggttttaccttaaataaaatatgcagtaataaataaaagtcctgtcagtggcttttggggtgggggaagcagtaattcctatcaggtcttggggcaggggaagccttcagaactccacggaagcaagagaacctttctactgacgtgtcccggtgggagagaagacccatctccacagctcctctcaaaacaaacccagccaaattaaacaagcgtacagaagagcaataggaaagatgttctaaagggctacactctccagaagagctaaattaaaactaatccaggcagctggcacaagtgctgaggacaaatgtggtggctttttacgggggaattagtgaaagaatggctgaaccaagcagaatgttactcagggtccccagcgctctcccagagggtttatgctgatccaccgaatttgaggactcaatttaggcaaataaaacctagtttattgtcgtctggctggggaaaagcacataaagactcatttatctggttgtaaacgagctagtagagctggctgtcacaagtgcattattcagcagaaacgagaagtgatttcagcagtcctcaggagggagtgaatgcagggcacaggagtggaaatctccaccaccaaactgaccaccactggaaaacaacttgtcctttttagttacatgtttattgcaggaccaacgaataaccatctaaataagcgctaactaaataacactacagtgtggaagttagaaagcccccgcatttcagcaggctctgggaaaaattatgcagaagacaaagtcccctgctgaatgtaactgcccacgcctgcctggcccctgtactcacgccctactcatccctgtccgctcccgtctactcacccctgccctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctactcacctctgtcctctcccctctactcacccctgccatctcccctctactcacccgtcctctcccctctactcacctctgtcatctcccctctattcacccctctactagaccctatcctctccattctactcacccctgtcctctcccctctactcatccctatcctctcccctctactcacccctctagtcccccatgccctctcgccttaactcacccctgccctctaccttctactcacccctgtcctctcccctctactcacccctgttctctcccctctcttcccacctcctcagctcctactgctagccctactgcccagagtacttccaggtaccattcccagctttcaactttacttcattttcatcatcttcattcccaccccccaggtaacctttctccagctctgaggagaaaggttaggtgatggagagatttattatcactcacccaccagggaaacacgggccttgttttgttcatctgcgcaatgaagatgaaaccattgctctcacatgaggagtaactgggacaaggaggagaagccccaggaggtcacgggagttcactgggtgtgggtacccagcgtccctgaggagattgcctgggaaatgaggcgctcatggcagcatccagcccacccaggccaggaacgtctccagggacagccttgggtaggcccctgaattcctgggtgcagttggcccagatccagccaccccccggaatgggcacaggcactctgggagttctctgggttcatcttctgtgaggcatgtccctgctcaatcccaccagccaaagaccactgagaacatacctatgtttttcctaacaaaatcatgttccttccctaacaaaatcatttacttccgtaagactcatgaggataaaaccatccacagtcttcactgaactgcaggcctctgatatgacccttgtgttgcgtgacgtctgcaaacgttaacaagaactttcactctctgtcttaatttgggcctctccataacatacggggctacctaggaagatgggattatgtgcagtgtatttgtcaccttgggctgccagaacaaaggcccatggactgtcttcaacaacagaaaggcattttctccctattctggaggccagaagtccaagatcaaggtgtcagcaggattgtttcttctgaggcctctctccttggctcatggaagggcatcttcaccccgtgtcctcacacaggcttccctctgtacatctgtgtccaaacttcctcttctcagaagggcaccaggcatcttggagtagggcccaccgtcaggacctcattttaaccgaattacctctttaaagaccctttctccaaatacagtcacattctggggtactgggccttaggatttcagcacaggaatttgggggaggaaggacacgattcagcccgtaatacccattttacagataaagaaactgaggccacagttagtgttccagccaggatcaattcagtgttgtttctacccctaaaatactgtttaaaaacttcctgtcacattcatctataaggcccgagttagtcctgtcccagaaccctgaagggtaggcgggcccacagtctatgtagagtgcccgtttgataagatagagctatagtcgacacaggccccactctgtgagttcagactttgggatgtgcctctttttctgtccttctctgcctcttttaatttggaagaaactgtcagaaagggtgattgatccttctgcaagcacatctctaactggaactaactgctttaaccaggacgcatgaggctgggcggcttccgacccatcagatggctcagaactgagacttgcaagtttaatagctttgctgctggggaatagcacagccctcctcgggatttctcattgtctttttcagtgattttaatactcagaaaaatgtgctgagcagtcagcactcaaggcagaatgactttatctgagtagagttcagagacgccccatggtgtgtggctccggctccgccaaaccactccgccacaggaggtgagcacctgctcgggtgggcgaggcctggcatgagggatttccacagactgctgggacccctgcccccgacaggggcgatcacctctcaccaccacctagcccagtggtaggggccaagatgccagtctccacggagtgaggcacggctctgttaaatcccaccagccaaagacccctgagcacatactcataggtggaaagagtgtattagcatgccgcagcaacagaaaaatgtaccaggagaacccgggacatctcaggaaaagggagttgggaggggcttgttatgaggtttaggcctgtgttaggttgttggggaaaggtttaagaaaggcttgttctgcatttgatgctgtcaggaagtaggggcagtttgatgattggggatcttaataatctttacacaagaggtagaaggaatgaagcaggcatagagctgctgttagtaaagaagcagcagtcatcactcgaatcagctggaagaggggatgttgagtttttgtggttgcagagcgtccttgcctctctgtccagatagaatcaccgcgtgcccttgtctccatctccttccaccatgatcacagagtgagctggtctgattattgctgatattctgtaaacgctcgtgcataggtgagaatactctggtctagctgtcagctgccaacggtcagggccatggttttccttccttacagcaagcaggcatcctcagcctcctcctccacagtagtgggaggaccacggagtcagaacggaggtgcaagcgacctctcttctcacgtgtcctgtgcagcccctgtgaggctgggggctgagaggtaattgtttgggctgtgctgtgactttaggagcagggcccactctgtgcctctcacgtgctgagcagagtgtgtccctggaatccacactcctacctgtctcacccatctctcccccagagtctatcttggcagtcctgcatctatgcaatcaactgagttagaacatagcaagtccagctgactccttcccacaagagaggccctggccctgttactaacccctaagagtccatttccttatctacacattaagggagaataatccctgtttcataggattgctgtggggatgctggctggagataatgcatgtaaactagaaagtatgcgtcgggaagggaggaacctgtcctctctggctcctgctgtttctctatcacccaggatggcggccagcacatagatgcatgataaatattggttaaatcaacaaatggaagtgccccacaaagtaatcagttaataagaggcagctatgttggtttcccagggctaccataacaaaggattacaaactgggtggcttaaaacaacagaaagctattctctcacaggcctggagactagaggctggaaaccaagatgttagcaggggcagctccttgtgaggactgtgagagagaatcggtcccaggctgctctcccagctctggtgatggcgggcaatccttggccttccttggcccgtagatgcatcacccccatctctaccttcattcttccatatgtctgtgtccaaattttcctcttttcataaggatgccagttacattagatgagagcctaccctaatgacctcaacttgatgacatctgtaaagatcttatttccaaaaaaaaggtcaccttcacaggtactgggggtcaggactgcaacttatcttttggatggtacacaattgaatccataacactggctattgttcttttcacattatagtcctgattcccaacattttgtcctgttttgtcaactgtcatttaaaaatgttgcagaaatatcagtatttctgcacctaacccatttcatcctctcttccttttgtacttgaaattaaattccacatcctggctgggcgtggtggctcacgcccgtaatcccagcactttgggaggccaaggcgggtggatcacaaggtcaagagatcaagaccatcctggcctacgtggtgaaaacccgcctctactaaaaatacaaaaattagctgggtgtggtggtgcgcacctatagtcccagctactcgggaggctgaggcaggaaaattgcttgaaaccgggaggcagaggttgcagtgagccaagatagcgccactgcactccagcctggcaacaaagcgagactccatctcaaaaaaaaaaaaaaaaaaaaatccaccacatcctatcaaactacttgggctattggggtccagaaaggaaagctgtacagagagtccaagagaatgctgttcatatagtagaaacacagtaaatgccactaagctgctgtgtgaccttggacaagttactccacctctctcagcctcagttttcttaactgttagataaaggcattggatctcactgacatctccctgcacacacacagggaataggcaagattcccttttagaattctggtaggtagatgagatggatcgtttccctggacatgcagaaacctggtgccactgactcctacctctctcttcacttctgtgtaccctgagatgaagccctctccctctgaggctcctcatctgtaaaatcagagggtggaatgttctgatctcccaagcccgcagccatagaggaggctgtcactgctccccatcatctctgagcagtggatgaagcctatagaagagaggcagcctccgatgagctcattgtccccattctttggttggctggctggaaatgggaatgttcagtacattttgggcacctccttcattcctgaggctcaggtggtagcctatgccccaacattaatgaagcagcagttatattacccccagcccagcacctgccagaatatagcccaggtgttgccaaatagcagggtagggagaaactgtccggacaggggggttgccgagagacagcaaagccaacgcctcacccaagttcacaaaagcccagattaaaccaatgaacagctggaatttctaacttggacagccccaggattgtgcctgcctatacctggtactgaatacgtgagccttcttgctccttcttggacacaccctgtcatggttccagatacccactgctgtgattttgagcttctttgttacactgaaaatcctaagagcagaggtatagtctgattatttctgaacctaaaacctagcacaatgccaggcacaaagaaagaagagaaggaagtcaggaaggcaataaggaaagtaggaaggatggaagaggaaggaagaaagggagggagggaaagagggagactgcaacagaatatcacagtggctaatggtgcaagccgtaaagtgcaaaagaactgagttcaaactctggttttgccattgactggctttgtgacccaaggcaaatcgcttaacctctctgaattccaacgtcctgtactattcactccaccgggttgttgtgggaattaaataattcacttagaacacttagcatagtgcttgcccatggtaagcattcggcaaactgtggtagtaatctgcgtcatcatttatagtacttaaaacaataataaccgcatggactacacagccctctgacatcacctgcccagccaacttttccgtactttgggggcgggcggtggggtggtgggggaggcggcgggggcgggggtaggaatgagcatttgcacaacgttacacagggatggtcccgctgactcaggagcattccactttgtggcagcgatctcagagtggcctgcaggccaaatcagatttgccagagcccctttgagataggggtgtcccgggctaccgcctctgacctggttctcttggcaggtggcgccacctgctggctgctctaggaactgtcttacatacctagtcactcagcggcaaaatgttctttgtgtcaagccctggactcctataatcacctcctgactgccaaagccaccttgatcctgggaagccagtcacgcaattcatactgccctgcagtcgtccggttcacgtcagaatttccaggacaactcccaatttcctgaggattataaatcaaccataaaatttcattttcccctgagactttgcatatatcaaccagctagtctgtttctattctcttctgctttttttttttgcgggggcgggggcggcggggaatggagtctcactctgtcacccaggctggagtgcagtggctcaatctcggctcactgcaacctccgccgcccgggttcaagcgattctcctgcctcagaagtagctgggattacaggcgcctaccaccgcgtccagctaatttttttttttgtgtgtgtgtgtgtgtgtgtgtgtatttttagtagagatggagtttcgccttcttggtcagtctggtctcgaactcctgacctcgtgatccacccgcctcggcctcccgaagtgctgggattacaggcgtgagccactatgcccggccttctcttctacttctattcgtgacagaagaaacctcgtttctttcctttttcaggtgcattctgggttgctgtggagcttaggtcagaccttgagtttagagtcaaaggtcctgagttccagtctcagcccaccaaatacttttgcccaggtccctaatctctcccacctccagctgctttatctggaaaaggagagttatcattccacctgccatcatggtcctgatccttttgtgggtttgtttgttttttgtttttgttttgattgttgttgttattgtttttgagacagagtctcactctgtcacccaggctggagtgccttggcacaatctcggctcagttcaacctctgcctcctggattcaagcaattctcatgcctcagcctctcaagtagcagggattacaggtgcacaacaccactccccgctaatttttgtattttagtagagacagtgtttcgccatgttggccaggctggtctcaaactcctaacctcaggtgatccgctaggctcagcctcccaaagtgctggattacaggcgtgagccaccatgcctggcctggttctgatccctttgaaatttaaaggagaatgaaatcagtgggaaaaggctttgttagtgtcacagataaggctacaactccttagcctgtgggtgtaactactgtcacgtgtaaatacagaatcctgggtgacggtggcatgcattggccctgccttcttcctcaccagcagtctctcagtatgacattgtcatggtagctactataaggctggcacaggtttcggttttattatggtcattcatgagatttttaatgagggcttactatgcaccaagcactatgggagttcaaatatcagagccaaaattcttggactctgggacctggaggtctagaagggatgaagtgtaaacaaatccacacactggtccatccctgttacatgccaagcactgtgctgggcacgtgatggatgtcaaccgtaggtcaaacaggaaggactcacgaagtacagttacaaatgcagctttggtttgatagggccctctcccaagatccctttcaacttgctcagtgggtggtagacattcttcccagcccctgggcgaaaacatggagggtcccatgatttttctgatcacttgcaggaaactaaaaacgtcacactcgttttaagccacaaaacagtatcaactcaggaaatagaatgtccagttgatatattattcaacatatcaaccctcactttctcccctgcccaggtagggccaagcacctagcaaggatgctgaagtcagttccgtctctctttcctgctattctcctcactcccacttccctgtggctgtttctagcccagttgaaatctaagcaggacaaagggacgggaaagggaaagggaaagggaagggaagggaagaagggaagggaagggaaataaagaagggaagggaaataaagaagggaaaggaagggaagggaagggaaataaagaagggaagggaaggcaagggaaataagagaaaggagggcaagggaaggctagggaaggcaagggaagggaggggagggggaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaagtttctgcctctgcagtatggcccactggcatcccctcaccctcgcaggctgccctcccaaatgccccctgctgacgtgcctgtcaagggctccacacctcccaaagatggaagcacctgtcaggcattgtaagaggagtgcagtgactttgcagtcatctcagctcagacaactgagcatccctttatacatacatctcttttaatcatcttgcaatccaggaaagaaagctcccttatcccttttctacaaatagacttttagagaattacacaatcactaagtgacaaagatgaggtttgagccctgtctctccaagtcaaatcccacgatattcccatgagtccttgctgttggattccaaaaagcaaagggtccactctggggcctgggacaagccatcaaacttccatcttgattcttcatctttcatgatttccaagagctcttcacattctaaaactctataataaaatttctgagttgaggaagcctagaagcacatggcagagaattctgcggaggcctccctcttctgcgtgggaggaagtccccacagctcagctcttcctaagagctctctgccctgacaccctacgtgatatgggcatgtgcctccagcaagtacagggcagagagagagaaacatcatttaagtggtgctggcattaagtggtgatgacatagcctcatgtccagtactgagtgggagatggaaagcatgcatttgcttcctttccagacaggctggctcatttcccctgtgcctctcatgatgagaggattatgcatgctgagtatgatgctggtgattcaagtgaggaagtttccagataccatgcatgactcctggtttaagccaattatctcatcatggttcaaccaaagaaacaataatttattcaaatgctggagaaaactcccagccatgctggttttattgattctgggtctccaagatggtgcccttctaaagaatttccaaggatcattttgtgcaattgcaatgttctccttagaccttcgtcaccattggtgggacttcagtgcttagcagctcaaggaacccagcatgttctccgtagctgtatcctctagatcctcacagcctccctttagaataagcagaacaggtgtcattacctcctttttacagataaagaaactgaagctcagcagtgataaatacgatgtctggtgaaaagcagagccaggacttgaaccttggtttcccaatccaagcctaacactttgagtcctataccttctttttgctgatgttcacacaagatcaagtgagcatttccctgcccttcctaatcctctacttaccagaatcccacctccctgctcctcagccagcttggggttggagaatggggtggcatttcaggcagtgtaaggttgaggattctttcatgattcttccagtaggacatcagacacatccatcctggcaacaacacactaaactgtccattacgtcccactggaatcaattgaggttatgtttctgacaacagagaatagtttgttcccttcgttacattagcctgggccaaggggtaaagcatatctatccctttattgcccgtaagtgtcccttagttccagtggagattaagaaaactggaatttattgagcacatactatatgccagaatttgttctgagggttttgcacatcttaaatcatttaacctcacaaaaaccctatgaggccattccttgtatgattcctttttatagatgaggaaactgatacacagcaccagttaaataacttttccaagattcacaggttgaagtgatagagacaaaacctttaacgtgggtagttggattccagagtctgtatgcccgggtccactctcgacagactaaagctcaaaacagtttgaccttgaggttttccaggaggaaaagcatgaggctgaggagaacacttatgttagattggattcctgagacgcaaagcccaagcctagggttctcttgtgggccacgtagtatggaagtgctcctggagaaacccgcaagaggcagggaggcaggacacggagggaagaccaagcaagggagccacctcagggctgccccacccccaagccagggcgctgggctttcatgcccccagctgtcagacagagccagtaagtcaagctctggggccctagggcactgctccacaaatgagccacagggcccagctgtggggagtgaatgcacatggaacgtggggacacaaaaaaatagttccaaaaaaaaaaagaggatgggtcagagcagtgacagtacctgctgcagcagccacgcctgggataggaaaggagcacctgtgatctgccgtaagcctcaacaggtcccacgcgaatttctgaggaacttagattcctctgatgttggcaagtgcccaggaaatatcttgtcagaggaaagtcggggataactgtctgtgcagggccaccttcgggtaaacacgcagggcctgttggagagccacctgggtgactgggactgcgtccacatgacctctgcagtcaccccgcccactgttccctaaggccacacttccataccgcctgccctcgctctgacctgccttctccatcaaacttgtcccagccagtctctccctgtgtctgtcagggtcccaagatgtatcagccactgtgctagttttcttttccaagttgattttatttatgcgatcgatctcattctgttcttaattatgaaatatttttaacacataaaaagccacctaatactcagcattgtcaactcagtgttatttgttaaaaaacctttttttaaaacctgaaatcaaagattttagatataattgaaactccccttgtactctgtcctgattgaattccacccccacccccccagaggtcactgctgccctaaatttggtgcttaccactcccatgaaagttttactacatatgtataaaacctttcctaggactattttgcattattttaaactttatgttaaattgtgttatactgtgtattagtcagggttctccagggaaacataaccatagaatgtgtacagagagagatttattttagggaattggctcacacagttatggaggctagaagtccaagatcaaagtgtcagcaggttgggaggcccagtgaagaggtgacactgcagttcaaggctgaaggctgtctgctggtggaatcctattttctcaggggacctcagtctttgctctgttaaatcccgcaactgattggatgagaatacccacattatggcacgcaggcaacctgctttactcaaagtccaccaatgtcaatgttagtctcatccaaaaacaccttcacggaaacatctagattgtttgaccatcacatattatttccatctgcaacttactttcttcacttattgtgtttttgagatttatctgtgttgacaaatctatcatttcattgtatatgaggggacttcaaaatgttcctggaaaaaaaatggaattaagagataaaaatacaaaatgtaaactttttttttttttattatactttaagttttagggtacatgtgcacaatgtgcaggttagttacatatgtatacatgtgccatgttggtgtgctgcacccattaactcgtcatttagcattaggtatatctcctaatgctatccctccccactacccccaccccacaacagtccccggtgcgtgatgttccccttcctgtgtccatgtgttctcattgttcaattcccacctatgagtgagaacatgcggtgtttggttttttgtccttgtgatagtttgctgagaatgatggtttccagtttcatccatgtccctacaaaggacatgaactcatccttttttatggctgcatagtattccatagtgtatatgtgccacattttcttaatccagtctatcattgttggacatttgggttggttccaagtctttgctattgtgaatagtgccgtaataaacatacgtgtgcatgtgtctttatagcagcatgatttataatcctttgggtatatacccagtaacgggatggctgggtcaaatggtatttctagttctagatccctgaggaatcgccacactgacttccacaacggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgattttcttctgcaatgccgcttgaccccaatacatactcgacagtagttccaaatagccagaaaacggcactttcaatttttccaccctacaagatctaaataattcttgtcataaaatgggcaaatggtctgaggtgcctgacgtccaggcattcttttacgcatcggtccctctctagtctctgttcccaatgcaactcatcccaaatcttccttctttccctcccgcctgtcccctcagtcccaaccccaagcgtcgctgagtctttctaatcttccttttctacagacccatctgacctctcccctcctcaccaggccgagctaggtcccaattcttcctcagcctccgctcctccaccctggtccgctccttttatcacctcccctcctcacacctggtccggcttatggtttcattccgtgactagccctcccccacctgcccagcaatttactcttaaaaaggtggctggagctgaaggcatagtcaaggttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtttgctgagaatgatggtttcccagtttcatccatgtccctacaaaggacatgaactcatcccttttttatggctgcatagtattccatagtgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatatccagtaatgggatggctgggtcaaatggtatttctagttctagatccttgaggaattgccacactgtcttccacaatggttgaactaggcaaagcagctcaattttataagaaaaggaactgagggctgggcacagtggttcacacctgtaatcccagcactttgggaggccaaggaggcagatcacctgaggttggaagttcgagaccagcctgaccgacatggagaaaccctgtctctactaaaaatacaaaattagccgggcatggtggcacatacctgtaatcccagctacccaggaggctgaggcaggagaattgcttgaacccaggaggtggaggttgcggcgagccgagatcacgccattgcactccagcctgggcaacaagagcgaaactcagtctcaaaaaacaaaacaaacaaacaaaaaccaaaaaaatgaaaacaaacgaaaggaaggaaagaaggaaggaaggaaggagaagaaagaaaaaagaaagaagaaagagaaaaagaaagaagagagagagaaaggaagaaagaaagaaagaaagaaaaagaaagaaaaaggaactgagctatttaacattagaaccatgattcaaacatgggggtaatggaagatggctgagcatgggttttacaggcctgccctggagagggagcaccgtgaaaaataatcaaatagctggcattattctgcaggcctgagaatgctcagtggggaagcaaaacaatgatttggctacccgcccatagcttctgacagccaggggcacctacatcgtaattcttagcagaaaggacctatatttcacagaagcatcagcagagtagcatagtaattaaactgattttttgtcttccgttttgaccttagaaaataaaacatctgagattataagagagaaagtgtgagtatgaggaggaaactgtctatagttgatacaagaaatagagttctattatttaaagtgatcaaaacagccagtaaagggaaagggaggtggagggtgagtaagttaaatattcatttgtcagctagaagtcagtaaacgatgtctgtggcagataacttgagcaatcaagaaatatgtgggcaggctctggatgaaagaaacagtaaggccaggcacggtggctcatgcctttaatcccagcactttgggaggccaaggcaggcggatcacctgaggttgggagttcgagaccagcctggccaacatggtgaaaccccatctctactaaaaatacaaaattacaaaaattagctgggtgtggtggcacatgcctttaatcccagctactcaggaggctgaggcaggagaatctctggaacctgggaggcagaggttgcagtgagctgagatcacaccactgcactccagcctgggtggcagagtgggactccatctcagaaacaaaacaaaaaaagaaaaaagaaaaggtgaaagtgctgacagcagggtgcggggagaggaaagtgtgggtcagggaaatgttggtctctagaaggtcttcagtgctgtttaactttttaaatcaggtgataattaaattatcacttgaataattttaaaattaaaatagaagaactacaaaatagagcaaggactactgaaatatttacagattttccaagtgatatatgcataatagcctcccagatggggtggaagctggtaggtagagattgtaaaatttagccatgatacttcaattgctgaagtggagggatgggggggtcattattctagactctttctacctttatatatagttatacatagttgaaatttcccatagttaaaaggatattttttaaaacaagcacagtctgtgaggtcagacaggtgtgagttaagttctagctgagccacttagcaatgtgggcaagttacttaaactctctgagactgagtttcctcatcacataatggaagtaactgctgttcacccacttagtgtgaccacttacttcagatgtagggatgaaatgagattatgcctgtgaagggctgactgtggcataagtgtagtaagtgctttaaaaaatattttggtttggtctgttttgttgcttctatgcggggtttttataaagaaggtttggctgtaaaatgtgaattctgcttctcaggcatcttatatttgttctgtacctctattttctgccttatgtgtttgctgttgtttagtgttatatttctctcctcagctagcttgcttagtctattctgttaacaaacatttattgagcacctatgtgccaggcactgaactgggtgctaaggaagcagagatgagagactgtccctgatccaaggtcacacaaatcagtgatggagaaaggcaggaaaagatcagaataacatgcagcataaaaactgcagagattgatataccacagtgagtatggggagtactgaggatacctagcacagcctgagccagggtttgaaggatggataggagttcaccagacaaaggaaagtaggaggcagtctgccatgacatgccgaggtagcagcaggagtcaaggtctagaagctagaaaggcctgagtctgttcagaaaagtaactcagttcatggttggggagtgagggaaaaataaaactagactgaagagcaaggtccaaattgtgccccaggctacagacttcataggacaaggggacatgggaaggttcattccggagcacagcttcaaataaaacatgagttcaaaacatgagttccaatctgcatctgagtaagttcattccagtagaaagggagagggtgagaggttagaaagcagagacagacagagagagagagagagaaagcaatgtcacagagggagtataagtccattttcctactgctatgaagaaatacctgagactgggtaattcataaagaaaaaaggtttaatgaacccacagttccccacggctggggaggcctcacaatcatggcagaaggcaaaggaggagcaaaggcacatcttacatggtggcaggcaagagaccatgtgcaggggaacttccctttataaagccatcagattgtgtgagacttactatcttactatcatgagaatagcacgggaaaacctacccccatgattcaattatctcccaccaggtccctcccacaacacgtggggattatgggagctacaattcaagatgagatttgggtggggatacaaccaaccatatcagcaggagatgctggctgtctaaatagatccccgtcagaatcactgtatctggatgtgcctggggctcaaaatttgattttgttggggcatctggagaaaattaagccctaaagggctgtctcacaacaaactcatctgacataaacaaccaggactgtgttataaatggtagggtttaaaccctatatatggtaggggttaaacctctttagtgaccagcactgatgcctactatccaaagcaagccctcgtatttctgaggttgctggaggtggaagtctaggtgggcccagaatcagaacttggggggacagagaggcttccagggaaagaggagcctaaaacactttgtcctcagcatgacagacttctaggggccaaggtgatcctgtttgcccaacaatggcaaataaaccccggccagcagttctagcttctcactgcatgctcatctggcccctctacaatgacgttccttcccagccacagcatagtctgatgaagtcagggtttatttacagtacaggctcagaagtgtattgtggcttccagagtgaaatccaaccttagccctcagatgtctctcattctccttggacacccagtggctgtgactgtgcttgtgagtgaactgtctcaagagatggctagacttctccattacttgaagacatttcccctaaattcactttcagatgcaatctttttttttttttttttttgagggagttttgctcttgttgcccaggctagagtgcaatggcgccatctcggctcactgcaacctccgcctcccaggttcaagcaattctcctgcctcaacctcctgagtagctgggattacaggcacacccacgccgggctaatttttgtatttttagtagagactgggttttgccatgttggccaggctggtctcgaactcctgacctcaggtgatccgtctgcctgggcctcccaaagtgctaggattatacttcgtaatcccctgagccactggtgtgagcccctgcactcggcctcagatgcaatcttaactcactgtgcttgggcttcttagtttttgtccccaggtaacaactatcaggttaaaccagaaaagagatgattaggacttgaaccaagctggataatggagtgggaatggatttgggcacatctacttggggaattgttggtttttgacttgggggatgaggaagagagagatgtttaaggtgattctcaggttggagctaggtaagaacctggctgttccctgagggtaggcactgggtcttccctgcttgggttctccataaagaggtagcactactgctgggctcattaattcaactaatacctgctgtaccagacactgtgctagggatggaacaacaaacaggacagaaaggcagtgcctgacttccaggaggttatattctagcagaaaatacagataaaataatttaaaaaccataaaattgataatacaagctttggtaagtgttttaaagaaaactaacaaagcagaaaggggcagagtaaagggaagcactgctcgcagtaaggtgaccagaatgagggagctattcatgcaaaggggaagggaggagtgggccaggcaggggagtcggcaagtgctagggccttgagcaggagagggactggtatggtccagaaagaccaagacccacatggctggagcctttggagcaatggaagagtaacaagcatgcagggccttgaagcccacttcagaagactgggttttactctaagtataagagacacttctatagagttttgttttgttttgtgtgttgtttttgttctgagatgggctttcactttcactctgtctctcaggctggagtgcagtggtgcaatcatagctcactgcagcctcgacctcctggcctcaagagatcctcccacatcagtctcccaagtagctggactgtgggtgcacatcatgacacctggataaattctgtttttttgttttgttttgttttttggagagatagggttttgctatgttgcccaggctggtctcaaacttctaggctcaagcaatccacccaccctgtcctcccaaagtgctgggcttataggcgtgaaccaccacacctagcccctctgaagagttttaatttagtttaatcagagtgacatgatatgattttaagagtttaaaaagcccactctggaagcaggatgcagaatgcattggaggagggaggtacagatcagggagttggaaggatattacaatgggatattataatgggataggagagcatgatggggacttgcactagggtgatgtcaagagaggtagagagaaataaatggatttgagatacattgtgggggtagaattgactagactcagtgataaatgagatgtgggagatgacagaaagtgagagatcaagatgatcccttggtttccgggtagacattggggttgtttactgagatgaagaggatcaaggggtggtggggaaagggaagatttgtggggaaattatctagattttcttttttttttttttaatggattttcactcttgttgcccaggctggagtgcagtggtgcgatctcagctcactgctacctctgcctcctgggttcaagccatgatcctgcctcagcctcctaaatagctggaattacaggtgcgtgcaaccacgcccagctaattttttgtatttttagtagaggcaggggtttcactatgttggccaggctggtctggaacaactgacctcaggtaatccacccacctcagcctcccaaagtgctgggattccaggcgtgagccaccgcacccggccaaaattatctagattttcattcggggacatgttaagtttgagatgtctgagaaatagccaagtgaagacctcaaagagagggtgagtatgcaagtgtggagctgagcagaaagttctgagatagacatttaaatgtgaaagtcattagcacatacaatgccatttaaatctgtgtggatagatcagaccatttagtgattaaaaaaaagaagcaccaagacccaatcttgaaaaactttaacatttagaggtcagataaggaagaaaaacctggtgaagcagagaataataagaaagaatggtcaatgaagtaggaggaagtccagagagagtggtgtcatggaagccgagacagaaaagtacatctgtgacaaatgcaaccagcaggtcaatatgagcacagagaagcatctgccgggcttggtaatacggtggccttgttattaagagcagtatcactggggtgctagggactgagaattatttctcattcctttattgctagaagcaagttatgctgaacatccatcctaaacttgaaagtcaaataaatgtgggaagggtttccaagggaatcttgcatcttgccactgcaccagctgagtttaatttcccaggagctcagtcttacccacctcctccccacacctgcagctctagctgccagaatgccaatatctttactccaaacaaaccattcattgtacccttgggcccaaatgataaccttttttaaaacgctgcttgtatttgcctttcctttaacacaatgatggtcaaatctctcatccaccaccaccagctcatttattttaataactacatccgcagtgaaaacaggagtagtattatagaaagagataaagtcctcaccatcatggtacaaatgactaggacttttcagatgactatggacaggaaaaacaaaggaaaaaaatatatatgtatatatatacatatatatatatcaagccactagatggaagtcttcattcaactgcctgtgcacttcagaaaagtaaagcaggatcagtgccagactgcacaaacccatcaaattcattcgacattcattgaacaactgctttgtacaaagacaaataacaatgatgataatggctaccgttcatgcaatatttactctgtgccaggcaatctgctgagtcacacatacgctgagtctcacacaccttggctcatttaattctcccaggaggaagggagtattattatcttcattttatgggggaggaaaccaaatcttagaattacttactctaagcaactgacccatgcttgtgaatggaggagccagtttccagaataagaaaacactgtcgttgtctacaaagtatttatactaaatgtggtaagagagggataatgtgccacaggggtgggctgtgactcagatgcaggaaccagccaatgagggaggaagagaatcagcaaaggccccaccatgctctctacagctcaggatgaaacggagcggtcacccctaattgttttccctcactctccccataactactgcaccacaaagaaccgactgttctatcccccaaatgcatcttaaactagtccacatttttccacctaccctatgatcacatcgttcgtccaggccaccatcattaataaaatgggctccctggaccaccgcaagagcctcccgactggttctttggcatcttctcctgcctcctccaatcctctcttcccacagtagtcagagggtccacttagtgcacagatcacctctgtaacctgctcaagccctttcaaaggcttcccagtaaatctcaactcctttccattgtgcccaaggccttccctctatggtctggtcttgtctacctttttaacctcatctcctacagtagcggctggtttctcaacaaacaggacagagcctggcataaacagtaattatgtgctgaagaaattaaggcaagaatgaatgagtgaataaatagaaaagtttcatggggaagccgtgtttgaaatgagcattatactggagcaggctttctcagactgagggctgggagtggggaggtagtgaaacaagttgctctcaatggaggcagcaggtgcaaaggcacagagggattccaggtgcagcagggaggcagctagagcaggcctgggggcagggccatgtgaaaccggggttctcaaggttgagtatgcatcataagcccctggaaagcttgctgagacacaaattgttgggacccacctgcagagattctgataggtccatctgaaacaggagctgaaaagtgcatttctcacaagttcccaggtgatgctgctgccactggtccagggcccacactttgagaaccactagtgcaaagtacagtcagtccttcacatccatgggttccacatccatggattcaaccaactgtagatcaaaatattttttaaaaaatagatgattgcgtttatactgaacatgtgggcttttttcttgtcattattttctaaataacacaataaataacaactatgtacatagcatttccattgtattgggtatcataagtaatcttgagatgatttaaagtatatggaaggatgtgtgtgtaggttatatgcaaatactacatcattttatataagagacttgagcatccgtgggggactggaaccaagaccccatagataccaaaggacaactgtacataggttttctataagctttaattttggagggtaggaattgttaccttaaaagaaggatataaatcactattttaagccaatattagtcctttgatacttaaatgtgaatgagttgcaagttctttatcaaccagaaggagaactccaggcaccagaggtgagagacaggagtgattaagaactgggaaagggagacaccctagtctgcctgctccccagtgtgccccaggccaagctggaacagaaatgattagctttgctagtggggaattcaatgaaaatggcagggtttggtggcttacacctgtaaccccaggactctgggaggccaagatgggtggataatttgaggtcaggagttcgagaccagcctggccaacatggtgaaaccccatctctattaaaaatacaaaaattagctgggcgcagtggcacatgcctgtaatcccagctactcaggaggctgaggcacgagaatatcttgaatctgggaggcagaggttgcagtgagcagatattgtgccactgcactccagcctgggcaacaaagcaagactctgtctcaaagaaaaaacaaaaaaagtaattcaatgaaatgaaacaaaataagacagccacactggagcaaggggaaagcagttattttcttctcccatagctgggatttggctccaccctgcaggctccccctatcagagccttcagctcaccatttatatatatatatatatatatatatatatatatatatatatatatatatatatataatattaatatnnnnnnnnnnnnnnnnnnnnccctacctgtgggagatcctgagaggcttggggattcaagtttgaaaaaccactcctcaaggctccatgaaacccctaaactatatccacaatgtttatgttcacgtgtatgttttgggggagacgaaactctagagccacgctgcccaatacggtagccacgggtggccaccatgctggacagtgcagacagagcatttccaccgtcacaggaaagctctctcagcactcatctagagctttcaccagccttccaaaggcatccatgaccagaaattttaagagctgctaggcaaagccagtgaaacttcatctaaggagccggactctgccctggagagatgaaagcttgtcactgtgacagaggctatgaacaagtctgcctttgaatagtctttttgtgccaaaaatcccactctaaaaactcttagaagatatccagattttatgccttattatttatatccccccaccctgaccattgtccaaagagagggacatcttaattccacaaatatttgctgtaagaaaggttctctgaggtcccccagagcctctgtgcctaacacaagtcatggtggtaagtgatcttgacgctcccagtgaccttgtctcctttggtgtgtgtgatcgctctaggtgggtgaggcagtcttggaaaatgcccggctcatgctgcagacagaaactatccaggccggagcagatgactttaaagagaggtaatgtcttacagcagaggcgacagtccctccacatccctagactcctaggcaagtgtggataatgctgttctggagcctgcatcatccaccttctacctcaggggaagctggcaggataacagagccatgattatccagctcacacccctccttgtagacataaagtaggccccaagggctcaaagattttgcccactgtcagttggtttagagcagggttctcaaactctggaatgctcagaatcacccaggggccatatagaaaacagagattgctgcgccccaccctgttgaatttctgactcaatgggtctggagaagggccccaaatttatattcctaacaagttcccagggatgctgatcctgctggtcctgggactcaaatactttgagaactactagcttacagtaatgattctccaacctgggcatatcagaattacctgggcacttaaaaatgtcagtgcagtgcacaagccatagactaattaaatcagagtccccaggggttgggtccaggcttcagcagttttagagctcaccaggtgacttaatgtgcatccaggcttgagaaccgtgctcagctacacctcccactcagtccctgaaggcatctgggtttgcagccactctcctggagatggacacttttaacatgggtgctttggagacagaaaccacatttcttattttggggtccccaccctggtgcttagcaggttgtcagtaatgtttgttaaaggatccttggttgaaaaggaggacaatcaggatagcgatgaagatgccggatcccctaacctggatctgaactcctgagttttccctggagttctgtgttgcaacactcccatgaggctggtagcccgggaagccaggttatcagaagttggctgcaattgccttcattttaataaatcaatgtgtgacaactgcactaacagtgccctcaaatctattgaaacagtgacttttaccattcattgtctaactatcacataattggcctgttggtaacatttataatctgattctttttcttttgggctactcagttatgctaattaagttcctttatctgcagatatgaaaatgagcagccatttcgaaaggcagcagaagaggaaattaactctctgtataaagtcattgatgaggctaatttgactaaaatggacctggagagtcaaatagaaagtctgaaagaagaacttggctctctatcaagaaactatgaagaggtaggagggggctggggttgctgggttggccacaagaccagaagttcacatctgtctgcctgtgcttcataacaaggccacagtagctcatttctgactctccacattgcgtgcccaggactgcagggaacatacctgtaaaatactttcagatccttgaagtgggtcaggttaccccagcagtctcaaactcaaatagcttcaggaaccagtgtggtacagaaacaggggaaggcagccagtcttggcactagcaaatgagggaacttgtgttaaattagagggagcaacccctcctcaatgcattctatgtcaggtttttttttcaacactgtattatacaaacaaaacaactctgagggtagatccaagctgtggttgacatctactcattaacaaaactgggtcagattattgagtgacagaactgaagaggacctccaacagttatggggtctagttccctgcgaggacttcagcaattctaaaccacctcacacatattactgtctgatccaagatttaggctgcttcaagttgaaagagtcaaaacccacttaacgatgctcacattgggaagttctttcttgagaccaacttaagctaaccagcaactgtaagcccatttcttcttgttcttagctcagtgatttaagactactctccaacagtaaccatttagagatgccaaagttatcttttaagtctctttcatccttgtctggctttatgcataaattccctgtgctgttgttgcttactttgtttttgtttttgtttttgttttattttactttaagttttagggtacatgtgcacaatgtgcaggttagttacatatgtatacatgtggttttttgtttgtttgtttgtttgtttgttttattttgatttctgctttgggcctgggcttgtggagaccaacctaagaaatgcatccttggtgctaggcatggtggttcaagcctgtaatcccagcactttgagaggccaaggcaggggatcacttgagcccaggagttcaagaccagcctgggcaacatggtgaaaccctgtctccactaaaaatacaaaaattagctgggcatggtggtgtgtgccgtgcctgtgcctgtagtctcagctactcaggagactgaggtgggaggactgtttgagcccaagagatggaggctgcaatgagctgagatcatgtcactgcactccagcctgggtgacagagtgagaccctgtcaaaaaaaagagggaggaaaggaagaaagagagagaaggaaaggaaggaaggaaggaagggagggagagagggagaaatgcatccttgggaaaagagaaattacacttacgctgggaagaaggtcagggactttcccagtctctgtgaagcctgtgtctggcagttgtggaatgagaaaagaattgcccacagagctggttttctgctggctagaattctatgccatttatttccccccgtaactcatctaagatgtatattgttgttttcaggatgtgaagctgctgcacaaacagttggcagggtgtgagctggaacaaatggatgctcccattggcactggtctggacgacatccttgagacgatcagaattcagtgggagagagatgttgaaaagaaccgggtggaggcaggagccctgctccaagctaaggtgagaggcaggaccagcatcctccactctgccctatgcagaaggaggccacgctgagctgcaaactagtcaatgtgcagacgaagaaataacaacggtttagtaacaagttcaacctcattagaaacagaagaaatgaaaattaaaataatagctttttgtttacctatctaaaagtaggaaaatgtttaaaatggtaaaaatgctggcaagtatgtggagaagtaggttctctactgtattactgaagagcataaactagtgcactgcctttgaataagaaatttagtaatatgcaccaagagtgttaaaatgcccctagctaccaactgaataatctgaatacaatcctgaaagaataattgaggccgggcgtggtagctcacgcctgtaatcccagcactttgggaggccaaggcgggcggatcatgaggtcaggagatcgataccatcctggctaacagggtgaaacactgtctctactaaaaatacaaaaaattagccggacgcattggcaggtgcctgtagtccccgctactcgggaggctgaggcaggagaatggtgtgaacctgggaggcggagcttgtagtgagccaagattgggccactgcactccagcctgggcaacagagcaagactctgtctcaaaaaaaaaaaaaaaaaaaagaatatttgaaaaaataaatcatctgtgtccaaatatactcactgaagcattataagagtgaaaaaaacatacacatttactagtagaagaaaatctaagccacaacctacctatgtgcagtaaaatatcaggcagttattagaattaatgtttatgaagcatttataaaataggaatgtgttcataatataaggtaaaatgaggagaaaatgagagtacagaatggtatatgccagaagccaaaaaatattctctgtaaaggaccaaacagtaaatatttcaggcttcttgggccagatggcctctgttgtaactcctcagcgctgccactgcagtgtaaaagcagctgtagccaataggtagctaatgagcatagctgtgttccaataaaactttatttacaaaaataagcggtgagatggatttggcctgtggactgcagtttgccacttcctggtatatacagtagggtaaagcattcaaacaaagaaactaggcattgagaaaaaattttagaaagaaaagactaaaatgggattagcagtcgttgcctttgagtgatggatcagtctgacactttgagatgttttttcttttttgtttttgagtatttctcaagtttttgttaaatagtatacattatattcatggaagaaaaacaacttttattaaacctcataaataatacaggaattaaccagaaaataggatgcatagggtttgttcttcccttctccatctcccacccatttctgactttgtaatcttgagacagaggatgaaaagtgacaaggaaggaaaatgtggaaaagtagagaaaataaggtagatgtctgagttaaggcaaaaggctgtttctgagctcttgattactatttagtggttcttgatcctggctacgcagcagaattatttcagagcattttcaaaaatcgccatcccagaccaaccaaatcagacagaggagagggactttgtgatttttaaagctctctggatgattctaatatgcagccagatttgagaaccataagaattataaaaagctatgaaaagaaaaataggagaggcttttctgtcctttctcccaccatactccctctatcccccaagtatcaacaagaaccttcccagcagggtcttcatcaattctggattcccaaaatgttctccagcctagaaaacatcctttcactcacccatttctccaacccctaccccgtttcaatagcttcctttctttctaaccaccaatcattgagccaggtcactacaaacacttttttatggcaaatagagcctagttattaaaaaaatgacttcccctcgccccacccaacctgatgagaagtggagcaacacagaggtaaagtgaagccatagatttgagtttggtccattgccttttttaacagactcatgacagataacagataattaatggtcctagagaccatctgatcccattccctaattttaggtgtgaggaaactgagacccagagagtgcaggtgacttcccacgatcacacagctggttgagagctccatagttcaactctcctgttcttggtccagagaccttttctctgcattgggctgcatcgtttctcccctggctctgcttctaaagctaaacctcagaggcccagcagtttgcaaactttgcttctgtcccagccctcctgcggtgtgcaccacactgtggtaactgtttctttgggaaaggacagactattataattatcagaaataaatccttcatagtatgaaaaagaaaaaaaaaaggtcattattatctcctcctcaccccttggagaatcatcactagcccaacagtaactcaaacattaattctgaacagattcattagtgtttttttaatagagtaatctgaaagctacatctcagagaaaacagacagtatttgttttagcttggccaatgctgcctgggcctcttgcagaaaggcagagctcagaaaatatttgcagaatgagtgaattcctctgatcatcaacagagatctgaactgacagccagaattcctccaataaatagttttgtcagttgcagttgtgccctcaggggctgacatttgcccatcctgagcatctcttgtcggtttcttggcggcatagcataaatgtgaaatggcttagcacacacagctttcaaaagcttttgtaaagaaaatgcaagcatgcatttaattacctttcggaccacagaggctgaaaattaattaacatgattaatttatatcttagtttaggttccttcagaagcagatcctgaaacaaatattggagttaaggtagtttacctggaagttggggagttaaaaaccaacaaaataccagtagaggagaagcaaagaagggaaccaacaaagaatgcctaatcaaaccagttaccactgtgggagactgacgtgtaaaccaagaagaattgtgagaaacggtatagactacaggagaggggaaaggcaagggagctgagatgttaataccatctcccaacagttttctgccatctgctatcagagtggccttccaaaggcttcagagaaactctcaggcaaaaagatgcagaatctggcagggggaacaggagagcactaaactgcgaaagcctaagggataaaggtggtaccatcagcatctgctagaacttatctgccaattctgtttattttttcagtcattaaaagcttaataaaatagagacataaaaaaatttattaagaggttctggctaaggtcagtgcagtattcatattctttccagctacggtgttacgaatgtcaggaacctcatggtccagtttttgaagctcctgaagttgtatgattcagtgatgacaggatcagattggtccagagaatttctggagggtcttaaagtctagttcttccttgtctatttgttgtggttacctaatgcagggtactcagggatgcttcaggaacctcagacaacatgccacaccacactctagacctcctagttagtcaagtaaaacaaaacaactttttttttaagttgggcactgtggcatgtgcctgtagtcctagctattcaggaggctgaggcaggaggattgcttgaggccaagagttcaaaggagaagtacactatgatcatgcctatggatagccactctactccagcctgggcaacatggtgagaccccatctcttttttaaaaaatcctttttgtcccctatgctcttacaaaatgcttctgacaccaaatatgtaggtttgttccacaccaagcagatctccaaacaccaactgagtgtcctataattcaattcaatcctgacactacctgcctgaagtagtatcagatcccacaggttaagggctcagtcccataagacagccctcacttcagatgacaagtctggccctcccatacttcggatgaactggctataaattaggggttcccacaacctcctctgcagagggataagtagatagtttgctagaacagtgcccagaactcaaggaaacactttacatatttttgccagcttattataaaggatacaattcaggagcagccaaatggaggagatgcttaaggcaacgtatgtgagaaggggcacagagtccccaactccaaatttttgactctattataataacacttggcttaaaatgcaaacacgtcatacagctatacaaaaatattctttcttttatccttattctataagcttgttttctatttttaagaggggttttttttaaccttttaaactttttttgttaaaaactaagacacatacatacacattagcctaggcctacacagggtcaggatcgtcaatatcactgtcttccacctccacatcttgtcccactgaaaggtcttcaggggcagtgacatgtgtggagctttcagctcctgtaacaacaatgccttcttctggaattcctcctgaaggacctgcctgaggctgttttaccgttaactatttttcttttttaataagtaggagtacgctaatgataaaaagtatagatacagtaaatacataaaccagtaacatttactattgttagcaagtgttatgcactgcacataattgtatgtgctagacttttatatgactggcagtgcaataggtttgtttacactgcatcatcacagggtctcacaaagctgcaatcaaggtacccaccagggccgcattctcatcttcagagtttgttcgggttcttggcatcgttcaattccttgcagatgtaggcttgaggtcctcaactcctagaggccagtcctcctcagaggccatttacaacatggctgtttgctccttcagggccaacagaaaagcattaccattttaagcctttaatctgattaagtcaggcccactcagatactcctcttttgatcagctcagatttagctgatttggaaccataattacatgtcaaaatctcttcatccttgtcatctaacataatttaatcattggacataacaccagagagcagagatcacggaggccatcttagaattctgcctaccaggcccctcagtgttgagcagagaactaaaactctgcccctccccaaacccccaccatctcacctcctctgccaggcaaacagctctgccctcagcccacctcctgtaggggagcacgggtcccgtctttcttgtccaatttctcagccggggcactgagacgtctttgttccctcaccctaagcctggtctgaagtctgcctcctgcaatgcaagctctgttttgccttcttagccttcttcctgagatgctccttccattcaatttccatttgcccaaagctgactccacactttcattcccagaggcctcatttctccatcccttgcctgctgcaactggttgatgtatacaatacccaaaggcttaatcaatcaccagcacaagttggtggttgcccggatgtgagagaactcagtctgtcttaagagtccccagggtcaggaacaaatggattgctcccatgctatcttctctaacagcaggtctgcacttgcctcaggtcagtttgaggcatctgcggtcaggaactttatctgagctgtaaccatcatgccttcatgtcacatgtcaggatgacagattgtgcaaactattaagaatgaagacaagtgaatagattgaaatgaattgtgaggtttctggttgttgatagtcttaaggccaaaagaaacattcaagatcatctaaagccgggccatctaactgaaatatcgcaatgatgggcatattctataatccacgcagcaatccggtatggtagctactggcctcaaggggttatacaggtgcagtggctcatgcctatagtcccagcactttgggaggtcaaggtgggcagatcgcttgagcccaggagttcaagaccagcctaaacaacatggcaaaaccctgtctccacaaaaatacaaaaattagccaggtgtggtgacatgtgcctgcagtcccatggaaactacttgggaagctgacatgggaggatcacctgagcctaggaggtcgaggttgcagtgagctctgatcgcaccactgcactccagcctggacaacagagtgagactctgtctcaaaaataaataaataaataaagctgaggaactaacttttaattatgtttaatttttatttcagcagctacagatgactagtgactgctctattagaggacagcataggtctagatttacccacgaggagaatagaaaccttgaatagcatctctccatgtcatctacacttacaaacaataattttccctgtaaacacagacattttatacaagctactctgtctagactttttctattcttgcttttaccaacaagagtcaatattttctaagatatatgaagctgaattaaaacaggcactgccactctgactctagactacaagatgacctcttgtgctattgccatgttaaccacctgggaaagttcctttccaggggaacagcaaaagcaggacgcctgacagcatctgtaatctagaggctcctgtgtgccaatgagctggctggactccctgagggctcttcagtgaaataagccatggctgtagccagtgtgctcaaggcaaacactgaacggggatcccgaagcatcttcatatctctgaatctcacagagagcttcacaaaagggccctgtttgcttttatgtctttttaaattgacttttattttatttcaacatgtataatagataatacattcacttagttcaaaattcaaaacatacaaaagatataaagtgaaaagtgctatccaacccatgtcctagctaccgtttttttctatgggggtcaatcaatgttatccttttcttgtatgtcatttcagaaacattttacccatatacaaagaaatatatatattttttttcctgtctttttacacaagtagtattcagaacatactgctttatgactgtatgatattataccacagggggcagcaaactctggcccacaagccaaatctgacccattgcctgtttttacaaataaagttttattggaacatgaccatcacattcatttacatatcatctatggctgcatttgcactacacaagtggagttcaatagttgcaacagagaccatatggcctgctaagcctaaaacatttactatctagctagtcacagaaaaagttgtcaacctctgttctagctaacagatgccccagaatttgtttagcctgttccctactgctgggcactgagggtggtttccaatcttttgctattagaagaaattagtcactaacatggtatacctctcatttccatatatagaaatgtatctgttaaatgaacttatagacatggaattgttggccccaaaagtgtgtgcactggtaattttgataaatattgccaattgctctctacaaagattataacaatttacatttctatcagaaatatttgagagtgtccatttccccatatcttcaccaatactttgtgatctttgctaatactatgggttaaaatgcatttcttacaaattgcttttgtgtgtactagcagatcatatcttttgcccatttgggttactgtagttgtatgctatagtagcatataccagttggtgcggctgcaaagagaatagggaaaatcaagaatcagagcagattttaaaaggaaaaaccaaaagactgtctcattgaggtaggtactgcctactctttgcctcttcttttctctagttaagacaacacacaggctgggtgtggtggctcactcctgtaatcccagcactttgggaagccaaggcaggcagatcacttgaggtcaggagttcaagaccagcctggccaacatggtgaaaccacgtctctactaaaaatacaaaaaattagccgggtgtggtggcacacacatgtaatcccagctactggggaagctgaggcatgagaatcacttgaacccaggaggtggaggattgcagtgagccaagaacactccactgcactccagcctgggcgacagagtgagactttgtctcaaaaaaacaaacaacaaacaaaaaaacacagacattgtagagcgctctctcaggcccttatcttcttatgttgtgtgtttaaactcacaactggttgactaccaatatctgggtaactacataggggatcacccaacattgcaacctctttcttacatcttctaccaaggaatctccactcacttattcattcaaaatctgtttgtcaaggacaaaccaggtgcaaggccctgacttgatgctatggttcctgaagtccctgacttcaaagaacgctcgtcccagactacctgactgtgctgatctcaaagcataccttagatattttttaacagatttttcccataaaaagtgtaaggactggccaggcacagtggcttatgcctgtaatcctggtgctttggaatgcggaggcaggaggatcccttgaggccaggagtttgagatcagcctgggcaacatagtaagaccccacctctacaaaaaaaaatgtttttaattggtcaggtgtagaagcacgcaactgtagtcctagctactcaggaggctgaggcaggagaactgctcgaactcaggaggtcgaggctgcagtgagctatgatcttatcactgcactccagcctgggcaacagggtgagaccccgtctcaaaataaaataatagaaaaatctatttttctctttagaattagactcattgctgagcctcttcagctgattttatcaagaggatgagcttacttattacaagggggcagcaaggtcacaaagccatttactcctctgtgttttgtttggcagctccaacggaggctgggaattggtcctacactcaaacagcagcttcaatagctgggcagttcttgtgtaaactcacagagaaacttgtagcctagccgggccagctcctctgccagtgttgaagtttcattgagtgaggcgtgcacttctttttaatccccgctgaggagagcccatgttgctagtgcagactggatggcatccagccttctcccaaataaatcctacatctggctgaggaaggtcgggagtgtgtgctgcctgtcaaaagctatccttagctaaataacatatgacaccacgtaactgtaaaatgacttacaactgttataataacgatagctgatcctcttaatgaaaaggagatttgatctcatcctattcctggtagatcctcctcttcttccctagtccctagcatgtgcctggcctacattgtaaaccttcagtaaatattgttgagcacattctaggtgtaaaaagctatgttaggtctccaaaaggggcagaggggtgagtaagaagttgttcctataaataaggaacccacagtccagtgtggatgttggctggtgtacctgtgggaggcaagaaatgggtagaaaggctactcttatacaaggcaggatgaaattttccacaaaagcagagccagccaagcttttatggagcatctaccaagggttctaagcacccgacaggtacgttctcatttaatcttcccaacatgagataggtattgcgattttagcattttatagaggaggaaactgaagcacaaagaggttaggtaatttgcccaaaattacacacttagaaagtggcaacactaggattcaaattacacattctgactccagaatccacactcttaactgttagtttgaactggacagaccacatgaatggggggaccttaatttggtttttaaaagatttttttgtagaaacaggatttcagtatgttgcccaggctggtcttgaactactggcctcaagcaatctttctgctttggcctcccaaagtgctgggattgcagatgtgagccaccatgcccagctgatttcttttttaagaataaataagtgacatcttgtggaatgtgaggttggagaggcctttgtccccggggggctaaaagttatgccagacttctgttgggagcttttcaaaccaagcgtctgtgccctccttgtgggattcttctatgacacaagatagggaacccctgtattcccacgggaccattgtttacctttctccatgaacagcacgatgagattagcatgatctcatgaaatctgaaaagtgcttaagagccaaggcaggtagctgcattctgcagtagaacaatgctcatataaagcaattgatcaccagttgcaaaaaccagagtgctcgagtgacttgctcaaacctgcacagcaactgcttagtgaaaggcagaagacacatgaggcagacagctcatctggatacatgatctgctgagaatgcacttgcaatttcaaagaccaggaagtatcaacattctctctcctcactctccctcctcctgaacactcgccttcccctcacattgcaaaggtagcgtttctgtcagttctgggtcattgccaagggtgtttttaggaatggccatcctaatcagcaaagtgggtcaggcttggacttggagatggttcttttcctctttcccagtcctcatttgtatcttcaagagtcaggctctcaaatacttaattattacttacttagaacacattgcttttctcttctcacatccttcatgtgcaaaaacatgctaatttaatttgaaatttttgaaatttgaaaatctttattatgtttcaaaatgtcgacatgctctcctgccccagaagtaattgcactcctaccctgctggagtgcaaacacgggcggctcaggtcctgtgcagtttcaaagcctagggatcaacatatctgaatttcatcacacaccctaacaactgcactgggcaacaaaacacagccccaccttcctatcctcaggggctagatgacacacctactctctggtctatgagaagaaatctggaggcacagggttgaaatggaaacagaaatagagttataataaccagaaagcacaaatctaaaaagccattggataaaaatgtgtaatacttttaggtgaattacttttagcagtggttactttaggtgagttaaagcaattaagtgggaagtatctcttgtggtgagatgatttgagaaggaacacagtgacattaaaacttgtagtgatcaaattacattcttttgctctttcaatcttaaactagaagaaagcctctgttcagtgctgggaggtctttaacacctctgttgtacttatttatctcccctttccacaaagagaaagcaggcctcaggacttagcagcttggcagtcaatggtagctggaatttaataacagtggttggttataactttattaattttttagttatcctctacccactgcaagggatactgtttcattggtttctgcagcgatctagaattttgcttccatggaccaggcaggcatcacctgggagtgcagatttctgagctgtactcaggatcccctgcatcagagcccacattttctcaagatcctaaggtgacgctcatgcgcatttaacctatagtttccattttaaactaacctacagtttacagataactaacctacagtttccattttaaacacgtttatttgtaaaaaaaagagtgaattggtttaaataaaaatagcatgaatgagtattaagagagtgtgaaaaaccatgtcagtggtgcaagaacatttgagaaacacctaaatacagtatttttgctaatgaaactaagacatggtgtttcagccaagaaaccagtaaatatcacggaagctgctcactggattgagaggggacaaatcatgtgagggactgtggctatagccttggccagcagctttacactagacctgcacaccaaggctttgaaacttgcctccattccttccctggcttttccgtatggagtgatggtaaatgtttcacaactgctttctgggtgaaatatatgtatatgtatatatgtgccaatcacattcacaatactgcttaagggtaatgtaacaattcccactgatttttttatatataattttagaaataacacaaattttaagacaaaatactttgctatttcaattacacctataacttcagcatgacttgctatttcttggaaaattcaccaaccattttttataattctatcatcaacaatagtatcacaaaatcagactacaaaaaatgcttgattactaatttctgattaagcaaaaagtcactcacattatttgttactggtggcaaatctgtagggggtctgaagcaacctcaattcttgcctcctcagaagaaagaattcaactgaagggcataaagcagaagagacggaggcaagttttagaacaggagtgaaagtttatttaaaaactctagagcagagaccgggcgcggtggctcacgcctgaaatcccagcactttgggaagctgaagccggcggatcaacggaggtcaggatttcgagaccagcctggccaacatggagaaaccccatctctactaaaaatacaaaaattagccgggcatggtggcaggcgcctgtaatctcagctactcgggaggctgaggcaggagaattgcttgaacctgggaggcagaggttgcggtgagctgagatcgcaccatcgcactccagcctgggggacaagagcaagacttcatctcaaaacaaaacaaacaaaaaactctagagcagaaacaaaaggaaggaaatacacttggaagagggccaagcaggcaacttgaaagacaagtgcgcagtttgaccttttgacttggggatttatacgttggcatgcttctgggatctttcatcccttctcccgattcctcccttggggtggggtgtccgcatgtgcgatggcctgctagcacttcggaggggagcatgcgcagtgtgtttactggagttgtacacctgctcatttgaggcattcttctcttaccagctaaatgcccctaggaggtcatataccagtttaactctgccattttgccttttagtgtgcatgcttgagctcacttgcccaactcctgagatcttatcaggaagttgctgatcaccagtttcaggttttttctatctttagggagactgcttttccctgccagctgtgacaagttattattttagagagactgttaacaaccacctgaccatcacctgatggtcacctgacattcttagttggttgtgggggtgcctctcccgccctgttcatgtctgactggctacctattagctacctctgttacagttaccagtaacaatgtaatttaatttctaatgatggctgtgtttagcagtcaacttacaacattcctgaaaatttaaaaatcagctcccgtgagctgttaggagcaagttctagctcactactgctccccgccaccctctgtagctacattgtctgactccatttgccttccaggatgccccacctcctgcctcctacctacctacacagcccatctggccaggaacccaaccccaaagaggggagaaaaactggggtattgatcataagaacttggaagacaaggagtatacttcagaatgatccacctgagtttggggaagatacctccaattttagggatcttaaattggtagattggtggagatgacaacattaaatactagttgagagcacatctctgggtctgctgctgggctggaatcctctttctgtctctcactggccatataatcttgagcaaataactcaatctccctgtgcctcagtttcctatgaggataataatgacatctccttcatagggttgtaaagattaaattagatacttgattaaaactgttaacaatgtgcttggcacagaataagtgcctaatacatattctttattattagtagtatttaactattactatttaattgttactaaatatttgactcttcatagtagcatttaactattaccactttgttatttaactattaaataacaaaagttatttgttggccactattactttttacatttggaaaatatatacagtcagtgttttcatgcttttaagattctaaaggcttcagcatgcttaatctgctggaagcctcacagtgaccacaggagggagtcattatatgataatgagtattattctccattcattgtggtctgtgttccatgggcagaaattgagactctgagaagctgaatgatggcttagggacacaagctgttggctaaccagtcagagctgggtccaaggcttctgttctccttcagcgactccaaagcctttaatggtcattctttgggctctgtaaagaccaaacagtaagaattggaggtgctactactgagctatgagccacttgacttggggtttcttttttttttttttttttctttttgagatggagtctcactgtcacccaggctggagtgcagtggtgccatctcggctcactgcaacctccgcctcctgggatcaagaattctctgtctcagcctcccgagtagctgggactacaggctcacgctaccatcacgcctggctaatttttgtatttttagtagagacgggttttcaccatattggtcagtctggtcttgaactcctgacttcaggtgatccacccacctcggcctcccaaagtgctgggattacaggcatgagccactgcacccagccttgacttggggtttctagccagtccattagattggactgtctttggactattctgtaaataaatattcatatgtggtaaaaatggtaattccagaaaaccgtaacctaggaaagtagagttttttccctcctccattcttggctaggagacgttccatcagactgcatcgaagaaaatggggatgatctctcatttttcatcttttccccagaacagaggagtaacaatgacctgttcccctgaatatatggggagggatcagactctgtccatcttgctctggggagaagttaaaaacacagagcttccctttgtctgggtcacagttgtgactagacacatggttttcacaaggaaacaggcactatcagattgacagagatcaagttggataactccttgtttgagggcggtatgggacaactggcactgtcttacaatgctgaaatggatttcaagttttccgaagggaaatttgccactattcaccaaaattaaaaatatataccctttctaatcagcagttctactacaagaactactttctcaaagacatgctcttgtatgaaaaataagggatcaaagctttttctttgcaccattgtttgtaatagagaaagaaagactagaaacaatctgagtgtccaccagcagagacttctaaatacattgcagcccttccaaacaagacaacactgtgcagccgctataaagaatgtactcaatttctattaggttggtgcaaaattaattgctgtctctgccattgaaagtagtggcgaaaactgcaatcgcctttgcaccaacctaatatgtactgatatagaataatttctaagatactttaagtaccaaagcacgggggggggcaatacatatttatttataaatatataaactatttctggaaagaggaataagaaactagaaacaagagaactggataattaagacacaggagaaaatgagactttatagtctgtaggaaatcttttgaattgtatttcatttgcaggcatcgtatgttcaaaataaatacatttttgtatacaagttggtgaagggacctgtttaaaaaaaaagacatttccagccaggcgtggtggctcacgcctgtaatcctagcactttgggaggccaaggcatgcggattacctgaggtcaggagttcaagaccagcctgaccaacatggtgaaaccccatctctactaaaaatacaaaaaaaattagccaggcctggtggcgggtacctgtaatcccagctactcgaggcaggagaatcgcttgaacccaggaggaggaagttgtggtgagctgagatcgcaccactgcactccagcctgggctacagagcgagacttcatctcaacaaaaaaaaaaaaaaaaaaaaaaaagatgtttccacgtgacagctgtatttcctctggttagaggcagtggagtggtgattagaaaggctgggaaggaaggatgggctcagatttctgatcatcaccgctcacactgagacctgactctccacagcaacaggcggaggtggcccacatgtcccagacccaggaggagaagctggcagctgccctcagggtggagttacacaacacttcgtgccaagtccagagcctccaggctgagacagaatccttacgtgccctggtaagtgggccaaggaaagacctggtgtccttgtgctaattttaactctctactgtcaaattccagtattatggatcttagtttccaggggattcccatctcacagcatatgagttttgaggcctgaaatgtcttctgactcccaaggatcatcagatactgaatcacagcaggtgcaatagacactgtagtgccccacggaaatatctcttaccaggctgctgcagtaaatgttgactgttaacatctgcagccgccccttttcagctgccccactgctccagagacctgcccttacccacactgaggacacctggcccagaaggttaggccctgccccccaacgctcagccagtgactaagagggggctttaaaattaaaagcccagcccttttgcttcaacatggagctagctccatgctatagagctctccataggaccaggctgtagccagattccagagaccacatcctcgcttagtgccttcctctgccctgtcctgctttcctcactcccccttttcctgagagtactccttaatgatttgcgagttccaggatccctaactcaggctctgcttctggagaacccaacctgagacatctagtaagctctcagactcactgggatttgcaagctcgtctctttcattattaattatttattaaaatattaaaataataaaatgtattaataatgaagcaatccaccctctgatctctggaatggattgaagttctatttgggtattaaacatcttttcttagatgtcccctccaggaggtcatttgcattgttctaactacagcttcgttggtgcaaatcaaaggttggtccatgtaatccttgtgcagctgagatggcctggagtcaatgaggcgcatgataggatgtaggtccgtgcaagcatgtataagaaaaggatctgaggatctgaggggaggaaaatcaagagtaatagagtcagaagggctcagctcctccatttatcccttgggtaaagaggcaaatccctgaaccacagtttcctcttctgcaaaatgggtatgatagtcacagtccagcccacttctcagtgtttctagggggatccaatgtgtggatgcacatgagcatgctcttctgactcttagcattattttgagaacttgctatgttcctagaactgtaccaagtgctttggagacataaaactaatgagatatggtccctgcctccaaagagttaatgtggcttcggtggaggagctgatacaaatgtgagggaggggcagatgggagagagcacccctgctgtgggagtcaggaggtagacttcgtggtgggtgctctcctcactcactagctatgtgaatgaacagctttcattttctcacttgtaaagtgaggatctattttggctatcatatctagttactgtcttagtagcttaagacaacagtgaatcacttgttctctcattctgtgatttaggcagaattcagcagggataactcttctctgtatcatgtggcctctgctggggctggaacacccaaaaatggcttcttcatttagcttctctggtgactcaattgtgcatctctttttctctctccctgtgaccactccgtgtagctagcttagacctcctcatatcatgacagcctgacatagtcaaacttctgatatagcacctgagtgagcacagaagctaccaggcctcttaacacctgggctcgaaagtctctggacatcacttataccacattctagtggtcaaagcagtcacaagactatcctagattcaacagggagagaaataaattcaacttcttgatgagacaatggcaaggtcacattgagaaagcgattgtggagtggagataattgttgtagctgccaatgcaagtgtgagccactttaggatcgtaatagaatttacctcataacgtcattgagatgattaatttgataatgtatgtcaagcccttagcacagtgcctggcagttagtgagcagtcaataaatgccatctattattaattatcatataaaattgctataatagctactagtacagtaactccaagttggcatcaccagccacctggtcacctcacttaaacccagggtcctaaccattggggaaaaaaatggaaaaataatttacactctcaaccagaaaacttcagagtagtgccattctgtctatgcccatagcccagaacaggctgcctctgttccctgctggttctagtagattatcgttctggtcacggggccttgcagccaaggtgaggagcacagattgggacaaaataggtaacaaactctcatacagttttcagatacaggaagttcatccagccattcctgttattctgtcagagcgatctgtgcacacacaaggcccccgcagcttatataagcttcagacagccaagctggcgagactttcggccccctttgccaataaggcactatttgcattggaagctaggcacaaataatggtgcttgagacctgctgaactctgtgtccagtcaactcaaatcaggaatggaattcaaggccagaagtcacagaaggtcactattttactttctggaggattttgcaatcccagaaagtcccttcaaatctccagagacctgcagaataagtgtgcttctgtgatctcagcttgtttgctggtgctgtctgcgtggctgactgagccagtgtacttgcctgcaacagtagcctgatcatagtcactccagctcaagcatctctgggagaaccaggcatcctctctttctgccataatgtcagggacttaggtggggaagctggattcggactttaagggtgagatggaagacacatataacctttggctggggttccaatgaatgccctgttggcagtgggtcctaagtcaccatggaaaaacctcaggccacatgaagaactcacctagaagatggagcaaaaactatagacagatgatccaaccgtgattctgtgaagcgtgttcccaaatcacagatgttacaaatccaatgtcaacaacaactagtcacaagttaagtactttcatgcataaacaaagagagaaaacccagggaggttggaacaaatgatgctcaaagtcaaggtggccatttctgcatcctcactgctatagaaaggtttccagattctattagttaaataataaccctagaccagatactgatctagatttattttctagtgatcacgttttgcctcttataaatatgcctcagacagatgagaatctgactcaacattctcatatcctatggaattaagaagatttaaataaggtaatatggtgatccatgctaacagcagtcatgattcaagatggtgtcgtgacagaattttctgtttcatccacagtggtcataagggtgtaaaaagtctcctcctggaggacagggtacagaaacttgttgcatcaaaatttaattcaatccaatttagaaagatatttgttttttgtgtgttatattaaaaagccagatgctaaagtataggtgaaccatagttaaaactattggaaaatgttgaacacagatacagttttttaaaggggtttattgattagctctgtagttttcaggacatggtgcatgggaagatgagaagaaagaagtttccagtctaatggggagacatagatagtgcaataagtgtaaccataatacaagtgctatcatccagggcaatctacacataccaagaacctattctgtgccaggccctgacttgtgtgctgggactacagagacttggttccttccaagtctcaccatctggtggaaaagacgtgcccataagcaagcttagcccactgtgataagttcaagagcatgcatgagcttggggagccatggaaatacagagggtctcctaacccagcttggtgatggtagcggcagaggagtttcaaggaaggcttcctggggcaggttacctctaagcttggacttggggatgagtaggagtgagtgaggtgaggatgctggaaggaatggaggagcatggtgcaggtggaggaaagaacacagaccaaataaactccaagactggaagtgttgatgctgctgtagggtggggataaagatggaaacatactgggccagctgtgtgtgccatatcaggggccctggggagccatcaatggagtttaagcagaggagatacaggcccaggtttgggctttggacagagtactgtggctatttgtgtgtggaactcaggaagaggaggaactagaggtggggagatgagctaagaggccactgagggtaccacaggtgagaggtgacaagctcccaatcccagaccatggtggctgcagaatgtgaaaacttctcaagagatacaagaagcaggactcataatatacaggaggccatgatggttgcatttggaaggaagagaaggaaggaaagcaggaacacatctttccctggtttccagctcacatgggttcacccgttgaagcatagactagggggagccagcaggttcaggaggcagccagtggcttcattttggacaccttgatgtgaggtctgagtatatgtttccagtaagaagttcagtggcaggtccatagctactgaaggaaagattggtggtggaattatcaacgcaggacgtggcctggagacgactcatgagtatgttcaaatcatgagtatgatggagaccaacacagacccaggatgcgctccttggaaaaaaagcgggctcagggtgggcactgggaagcccaaagtgaagggacggcagaggaaaagggatgggcaaaaatgtgctactaaaacaccaaaggggaaagcgctgagtatataaaggccagagacattcattctaaggacagtgatctgggaaagaaagctggaggagatggtgttccagccaaatgatggatggggtttcagcagcagagggagaaggggtcccccggggagtgaagaaatcagaagaaaaagccccggagaacaagatttctttgaagaaacgcctgcaagctgcctctcatttgtctctctcaatccctatccctcttgccccgctcctctctctcctcacaccccctttcttttctccctccctctctccttctctttttcgcctccctcaccctctctcccatcaaaaagatcaatcagactaatccacagtctgacctgagtgggattccttatttttcccacggagccactaagaataacccccatcagtctccataactggcaaggtccctgccacgaggggaatagtccgggctaccaccagcccctgccactgctctgcacacctccctcttcaagggcccggcctgttgtcctcgggtttggaccgggttcgctcttttgtagaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcgcgcatctgctggcccgcaagtgccagctgcagaaggacgtggcgtcctaccacgccctgctggacagggaggagagcgggtaagcctcgcttccgcgtcaattatccaagagatgcatattcgtggctttaaaaataattattttccaaacactgtagaagtatttaagaagaaatcaccccagacttcctctcacataggcacccattcccacagcctagctgtgtccttcctttcctattcacatacaaataatatatataatatattcacatactaatacattttctatatgtatgcatatttatgtatgtatatatacacacatacattcacatacatgtgtatacctaggacgtacataatagctgttaggaatgtttcagttgcttgtaatagaacctaattaatgaggctataaaccagtgctcctgaaactaatgtgcactcaaaaccctgcgcatcttttttttttttttggatacagggtctcgtctcggtatgttgcccaggctggtctcgactcaaacccctgggctcaagtgatcctctcacctaagcctccagaatagctggggttacaggtgtgagccgtgacaccccagctgggcatcttttttaaatgcagattctgcttcagtacgtctggggtggggtctgagagtcttcctttctaacaagctcccaagtgatgactatactgctgctccacagactacactctgagtagcaaagatgtgtaaatcatttatttaagagtcccagaaacaggtgatctaggctgctcaaagatttcattaaggactcaagctcttttcatctttctaacataccatgataacattggctttttgtctttatctttgtcaccccatggttaccatatgccagccacagatccaaacatcacatcctcattcctggccggaagtgggagagaagaggcagcagcaaaaaaaaaaaaaaaaaaaaaggctttttctttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacaggtcaacaggatcccaaggcagaagaatttttcttagtacagaacaaaatgaaaagtcaaaaggctttttcttgaatgatcctctcctttaatcagtgaaggaaagacattttgaggcttgcagtggactgtcccttatatctcattggccagaacctgcttatactggccatacccatctgcaagggaggctaagaaagcaactctttagcttttccagactccatagtggaggcaggcaaggggttgggactaggagttgagttagtctgccataattacacacacacacttgcactcactctttttttaatagataaggattccagaggcatatacatcagccttgggccttagcttccttgccaactctttccagaaacccaggcccttattttgtatcatagttctatgccttcttatttccctccaagactccttgtctgacatatgttgaataaggaatagagacagcttagtgattgtatcatccaacccctcctgattcaagagagaacacaaagacccagaatggaaaaagatttgcgcatgatcacacaggaggcggagacagcactgggatgggagcccaggtctcctgctctctccaactgtgtaacctctctttattcagaaggcgggagagcctcaaggaagcgacctaaccacgccctgctttcaaatggaaaatatgtcatccagctcctctccaactgtcttttattgaattgatttttgttgattataaaagccagatgttcctaacaaagtatttttttttcggatgcctatgagcatctgtataaacacacaaagtcaatttaaacaaacagcaagagcagtgagttaggccgagttacttcttaagaatctatgtgctacgttcatttagtgagtgccaaggcagacctgactcttgattatttttgtttatcctccaaaccctgccaagacaacctcatgatccgtgttttagagacaggaaacaaagcctcagagagcttaagtcatggcccaaggtctcacagcaaataaccatggagtaattatttaaaacccaaaactatcttgttccaaaggccagattctttcatgagatggccccctttctcgtaatcctattgtgatagaatgaccgattttcctcacccattgcttctgactcctatgtgtttcctttcagctgatggagaaacttcctctttttcatgaagaaaacacccttcctcaacagctgacccaagaagttgcttgaggagctttctcctgagctccagtccctgctggattccctggttaattcagcttgagctgaaaagcttcctggaagtggagaggatccttctgctttaatctgagtagtctgtagcttgagcaatctcccttgtcctccttcaaataaatgctttgtgcgcagcgtccagtttgcccaccttgttcaactcactatagggtcgagatggatatcactttgtctgtctggcctttgctcacagagctatgcttgaaggcttctggaaggattcccttgagtgtgacgccatctgcctccctagggtcacctgctcttgggtttgtcaacataaaagtgctgcggaggcaaaagcagtgctcatggcatgcaggattgacgcagtctgggacaaaaaacaacactcttgctcgagaggggattagtgtggtgctttatcacatgtttcataattacaggcatcgtggagtattcagacctctttaatatactctgcatgcatattcatgtgcagacacacacatttcacttgctattggcagagcatctctcaatcagttaaaagggaacttcagtctaagcccaatctaaacccattcaatctaagtgggggattaattacactgtggttgctcaccccacttacagcctcagaattttcttccagggtcctttctccagttctctcagggcctaagccagccaaatatagttcatgcatctgccacctacccaggcaagactctcttgccttctgattaaaattgaaaccaccacctgtgtcctaccacaggttctcagtgtctctaaaactgaaaggaaaaaaaaaaaaaaaaaaagcccaactttaattttgtcattcctccctcaaacttctgttggtctacctatcacacagaattacagaccaaaatatccaagctgagtctttgtgtttgtgagctgctaatccagacagggggatgtatccaacactggtacatttgaaaacccccatacccgagggtccaaataaccaaggcccacacaaagaaaagaacatttatttatccttaaggattgcttataagagaagcaaggtggccaggcgcggtggctcatgcctgtaatcccagcactttgggaggccaaggtgggcagatcacaaggtcaggagttcgagaccagcctggcgaatatggtgaaaccccgtctctactaaaaatacagacgttagccaggcttggtggcgggcgcctgtagtcccagctactcagggggctgaggcagaagaatcgtttgaacccaggaggcggaggttgcagtgagccgagattgtgccactgcactccagcctgggcaacagagcaagactatcacacaaaaaaaataaataaataaaaggcaagatatatggtatcctggttggaattgctacaactggttttcctttttggcctgcaagagcaaaggaattgtattaaagatcacatgagcagaaccactatttacaatgtgcatagccccttgacataggtcagtttgttgtttgagacatggaaataggcaagacaccctaaaactacattttagcaaagtatccatctccatagctgcacactatggggctgcccataattgaaccgcctgggtacaagagtcttgccagaaaacaaagtgggtggctggccttgctatgttggatgcacaagacactgacgtctgtttcttttctgtctttcttgttactattaatttttggtccctcaggcaagacctaaattcctaacctaaatgtagctggaggcttcaaaggtgacagtccccaaaaggtcagccatcaaaaggaggtacttctatgaccgaatggccatgcagtttttagaacctggaagtcgtttcagccactggaaagacgggagaatgtatctgcgcatcctcctgagtttccaccagacagcatgctgtgcagggctgcacacacttggtctcctccgcaccatcatctcaaagagcagctgccgtaaatcattcagttaatcaccctttggcagggagagccgtggcagactggtgcttccagttcccagcacaggctcttgctgtttctaatgaggcttcattaacaggtatgagaaggcactgctggccccccaactctgccagggcctcgtttaa

SEQ ID NO: 17141 - DNA, 11312 bp, Human
ttgtatttttagtagagacggggtttctccatgctgatcaggctggtttcgaactcctggcctcaggtaacccgccggccttggcctcccaaagtcctgggattacaggtgtgagccaccgtgcccagtcctctaaggatttttttaaatttagctgagtgtagtggcataggcctgtggtcccagctactcagaacgctgagatgggaaaattgcttaagcccagaagttcaaggctgcagtgagctatgattgcaccgttgcactccaacctgggcaacagatggagacccagtctctaaccaaatatactttgagcatctcttagatgccacgccctttcagctccaatggtatagtgataaataaagtaggtaaggttcctgctctcatggagctaactttctcgagggagagagagagagacagatcaagaacataaatatgaaagataatttcagatggcggtgagtgtttagaaaaaaataaaatgctattggcattgaggggctggtctggttagggcaggtccctctgaaaagtgtcatatgagctgagaccacaaagaggaggaaccagccatgggaagatgtggaagaagagtgtcccgggcaagtgcaaagaccccacggcacgcagaagcttgtgtgcctggagcaaaaggagcattgaagagctctggcgagaggcctcagccaagggccctgaaaggtgattagggttgattccaagggtgattagcaaccacctaagtgttctcagaagggaagcaattcagaacttggtatgacttgcaatttttttttttttttttttagacagagtctcactctgtggcccaggctgcagtacagtggcgcaatctcggctcattgcaatctctgcctcccgggttcaagtgattctcctgcctcagcctcctgagtagctgggactacaggcatccgccaccatgcccagctaatttttttgtatgtttagtagagacagggttttgccatgttggccaagcaggtctcgaactcttagcctcaagcgatcagcccaccttggcctcccacagtgctgggattacaggcatgagccaccgtgcccggctttgacttgcagttttaagcttcctctgggtcctgatggagaatggaaggcaggagccctgagaccaggcagaagacggctgcggagtccacacgagggatggtggcagaaggatgggtggcatatgtggccagaagtagttggattcggggtgtatattttggaggcagggccgaggaactcttctgtggggttaagtgggcaggaagagggaatttgaaggatctggctcactacaaggaaaggtaggccctgtgtctgtcctggtgactcacaaacagcctagaacagtgtctggcatctatatgtccttcatcactatttgccgcctcaataaatgaggcgcagtttgaccttaatttggagatgaggctactggggatggagcccagctgggaaaggggaccccagagagacctaacccaggagggggtggcttgccacaggaggccagagacccagccggcctgggcactttggacctaatctgggtttgaggagaacttggcagtgatggtgtgaggcctgcacagctcccagggggttccagcctcaaagggtcctcactgcatacccagggctcctttctccagagtccgcccaccagggcccagggaagctggatgcaaaatcctggcctgagcctctgagcatcacctgcatgcagccagtttgtcccaggccaggtgacgccactccaaagggcagtaggaatggcttggtaggagctggcttccagagacagactgcctgggttcaaacctgggctgtggggccttcgagggcacatttcttgagccctctgagcctcagttttcccatgtagaaagttgactggtgctatgattaaggcaggctctcctattgtggacacaccccccaccgccaaatgtctcccgcagacccagggacagtggccaccatgcgtaagccccgctgctccctgcctgacgtgctgggggtggcggggctggtcaggcggcgtcgccggtacgctctgagcggcagcgtgtggaagaagcgaaccctgacatggaggtaggtcctggggcccacccgcaccctggccctgcctgctgggctccggctttgaatggctgcctgctccctccacggccacccttacacctcactcccctctccccagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaaggtaaaatctcctctcttatgagagatcctcttgccaggtctggtcttaagaataagttttctgttgtgtgttttgttttgtttaagaaacaaggtcttgctctgttgctcaggctagagtgcagtggtgcaatcatagctaactgcaaccacgaacttctggctcaagcaatcctcccacctcagactccagagtagctgggatcactggtgcacaccaccatacctggctattttttttgtttgttttttttactttttgtagaaacagggtctcattatcttgctcaggctggagtgcagttgcacgatcacggctcactgcagccttcacctcctgggctcaagtgatcctccctcctcagccaccacgtagccaggaccacagatgtgcaccaccacacctggctagttttaaaactttttgtagagatggggcttcactatgtcaccagggctggtcttgaactcctgggctcaagtgatcctcccatcttggtctctcaaagcattgggattataagcatgagccaccactcctggccaataattaggtttaaattatatttactgatggaggctttatcagctgggaggtctccagagaaacaaaaccaacaggatgtgtgtgtgtgtgcacgtgtgtgtgggatgtgtgtgtgtgtgtatgtgtgtggggggggtgtgtgtgtgcgtgtgtgtaaagagatttattttaaggaattggctcacgggattgtaggggatagcaagtccaaaatttgtacggcaggctggcaactcaggatttcagtgacagtctggaggcagaattccttcctctccaggaaaccttagctttagctctcaaggccttgaactgattggctctgcccccaccccacccccagccacactatggagcatgatctacttgacttaaggtcaactgattgtagatgttaattgcatctacaaagaccttcaccatggcatctagactggtgtttcaccaaccagctgggcacgacagccgggccaaactgacacacacaatgaaccatcacagaggcctagcaggtgcctagctccaagccagagctgggggcttgcggagacgaaaacaaatctttacctggcagctgagtcagaagagtgactggcaatgacaacacccacggtgacacagctccacagaatcccagcagaggaagtcctcaagcctgcaggggctcagagatgttggcccaaagctcttgggcaaggggaggcttcctagaagaggtgacttcattccctcaatatatatatgaatataggccgggcgtgattgctttcatctgtaatcctagcacttcgggaagcacaggtgggtggatcacctgaggtcaggagtttgagaccagcctgaccaacatgttgaaaccccgtctctattaaaaatacaaaaaattagccgggtgtggtggtgcaagcctgtaatcccagctactggagaggctgaggcaggagaatcagttgaatcctggaggcagaggttgcagtgagccgagatcgtgccactgcactccagcctgggcaacaagagcaaaactccatctcaaatatatatatatatatatgaatatccacacatacacactgagtgcctactagcacaagacaagacatacagagttccgctctccccaggtacacagggttgagatccaatgggaaagcagtgagccagctgagtcaggggtaagaggagccagtgaccagagaaatgacccgggacatatgaggccagaagccaaaactatggcatcagtagggagactgcagaaggcggcaggtcctggatcaccaaggaccttgaaagcatgtggaagactttgatcaatgggggaatcattaaggggttttgcattccggaactatcatcagcttcagcggggggcagggggtaggatagaggcagggaggcaggaagttctcgcagggtccaggcaagagatggtggagtgtggtcctggggaagggggcagtggacggatctgagggaggttcagttaggatgggcaaggattgagatctggctggatcctggtgacaggggagatgaggctggggcccttgaaggatggtgtcctggtgctgttaatgcaggtgtgagagtgggagggggaggagcaggctggcagaaggcaggcatgagtacaggtctgggcgggagtctgcagcgctctgggctggccacacgggtggggcaagggaggtggaggatcctgccctagagcttggtctcctctgtctgaggtcaggttccccagaggtggggctccagagggaaattcttgtgcaagcagtttctcaggggccatgtgctgaggggaatggggagcaggaacagcctagaagctgagtgaggatgtggtctcagctggagaggaggctgatcgcatgggagctctgcagcagggatggcaatgccggggaggcggtcccgcctgaggccaggcccagctctttgcagccccatattaactacattggctgctggggagcctgagtgacgggggaagggggcagccagggagggtgcctaggccctgtggagggcttggtaaggcagaggctggggaggctgtgtgcctcaacattcacatatgggcttcggctgggcgtggtggcacatgcttgtagtcccagctactcaggaggctaaggcaggaggattgcttgagtcagggaggttgagactgcaatgagctgtgttcacaccactgcactgcggcctgggtgacaaagtgagaccctgtcacacacacagaaaaagagaatgtgggcttcaaagttgaattcaagtaagtcagggttcttccacttgtaatgaacaacttccttaacctcattgtctcaggttcctcgcctgagaaatgcgaggagaacggcgcctgctggtggcgtgggcttgccgatgaaatgagccattcacccatgcctctcagcacagggcctgccctgggccgcatactgtgcattgtcagctgctgtcggagctgggctagcggccgccttgagagccagcagtccacgggggttggcgagcttctgggaggaaagggtggaacgtgactgtcaggtacagagctacagagaaccccagcatgaaggagtaggtggcaggggagaaggactcaacagagatggagaaagactaagcccaaaggtgatcaacaacaagagtgaaggaggaagtggtcagctgtggctggggcaaaacaagcccagtaagttacattggcctgtgtttggtcatccagggacaaagtgacctttttagtgcctgtaggcccagcgcgttggggaagaatttagaatgcagtggggataggtgtgagaggagcgggggaagtgaagattgagttgagaccactggctggagaacttgaccgggaagggagggcagagagcagcatggggtgaggggagggaatggatccaacgagcgtcttaggatgagggagttgtgagcgctcaacaccattacaaagaagggatcggggattgatagactgacagatgcatgcacagaggcaggtatggatgcatgcacagaggcagggatggatggacggacaaatgcatgcatagaggcaaggatggatggatggacagatgcatgcacagagtcagggatggatgaatggacagatgcatgcacagaggcagggatgaatggacggacagatgcatgcacagaggcagggatggatggacggacagatgcatgcacagaggcggggatggatggacagatgcatgcacagaggtggggatggatggatggacagatgcatacacagaggcagggatgaatggacagatgcatgcacagaggcagggatggatggatggacagatgcatgcacagaggcagggatgaatggacagatgcatgcacagaggcagggatggatggatggacagatgcatgcacagaggcagggatgaatggacagatgcatgcacagaggcagggatggatggacagatgcatgcacagaggcggggatggatggatggacagatgcatgcacagaggcagggatgaatggacagatgcatgcacagaggcagggatggatgtacggacagatgcatgcacagaggtggggatggatggacagatgcatgcacagaggcggggatggatggacagatgcatgcacagaggcagggatggatggatgcacagatgcatgcacagaggcggggatggatggacagatgcatgcacagaggcggggatggatggacggacggatgcatggccagaggcagagatggatgggtgggtagattggacggacagatgatggtaggttgttcttgtcctggaggaggtgatccaggctgagtcctcacactgggcagagcaagaggcaggaggtgagcatggggagatgcagctgtgtgccccagtgcaccggaagttacagatgacatcgatgtcctgtcctgatgaaacaggaaacacatttgtcatttgagagttagtggctggggctgggtggaagcttgaggggctgtgggcctggaatggggctgaggggagcgtgcaggagctgcctgccaaagcctggagcaaggatgacaggaggtgccggggcccctgtggactgccctctgggaatcttgtggggctgggtctgcacagctgtggttgtgtaacttcccccagatgcatggcgtgacaagggtgcaggaaggggtgcagggcccggaagcccagtatggccaaggagagacaaggcagggaagaaggtgagagatgaaagatatcgccctgattgaaacaccaaactacccccagtttctcagaaaaaggactcagagcaacaagagaacctacagtcgacagggaaattcgtcagtgcggatgtgatttgagcaagaccattgaagcccctgctgaaaggcaggctggcagagccagggtacctggccatctaccttgaagtctctgtgcctcagtttcctcctctgtaaaatgggcataggagacaggtttggtgagaagtgaacgaaaacgtgtttgctacccctcttaggtctcacgtttcatgcttagacgctcagcgagtggctttagggaccgagagaaatttgcttttcagttcaccaggtcgttacctatgaacctgccctgaacagtgctgaccttagttagagatggccatgaaactcatccgcatggggtaactggggcctccctgtggtgctgcggggctgtgtctctgtcttggtctcttcaggcctctcagcagctggagcaggagctggcaggcggctcaccggttgatgaggagctgggcttcagccggggctggcgtgtgaatcctctgggtcctggcagtcctgagcgcctgagctgaatacagagggaagaggctgggagcaaggccgggtgctggggccggcaggctgtgttctgagagtgcctgctagaggagctctgtgttcccaaggagatggaggaagacctggggtgggggtggtacagggtagggagaggaggggcagaggctgtgaacagggagatgggggaggggggatggaggactcaagggatgtaagggatatggcttgaggagggatgggggcaggaatgagggaaggtcttgggtcaaggacatggacctacatccccagcagatgggggtggcaagggggagacgggtgggggtcgctgactatagactgtagctgggaggaggggatgctcccagggctggggctgcctgaagagaatggcacgcaccttgtaggctcctgccctcaccccaccgccctcttaagtttcttttattttctttttctttttttttctttttactttttttgagacggggccttattctgtcctccaggctggagtgcaatgacatggtcatgcgtcactgcagcctccacctcccgggctccagcgattctcctgcctccctgcctcagcctgggacctgagtagctgggaccacaggcatgcgccaccactcctggccaatttttaaaatttttttgtagagatggggatctccttatgttgtccaggccagtcttgaactcttgggctcaagcgatcctcccacctgggactccaaaagtgctgggtttacaggcatgagccaccacacccagctcctccccctcaaacttctgtgcacaaagtgctcccttcccagaggaggggccccatcggtgtgtaaggtggcctattcctctgtgtgttctctggatcttttcagccctgtggtccagtgtccatcacagccatgctgactgagtgactggagacagggatgatggagagttcaggaagggctgggcagaggaggctggggccacctctggagggtgtcctgctgttcctgttggccccagctgcactcgcagggccttcctgtggcccctttccccaagcaggggcggccgcagctctcacccactttctcctgcagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatggtagggggagagggacctgccgcgaaaccatcattgccccatccagtgtcctctgcagcagggccaggggacgcacacctgcctgactctttcctcacagggaaggcgccccaaaccccatatgacaagcccacaaggaaacccctggctcctccgccccagcccccggcctcgcccacacacaggtgagtcccccaccaactcggagaccttgggtgaccagctgcccagcctcagtgtcctctgagatggggatggtgggggtccctgccttggagaaaacaaacccccctctctactcacctctcctttcctccccagcccatccttccccatccctgatcgatgtgagggcaattttgacgccatcgccaacatccgaggggaaactttcttcttcaaaggtgagtcatttcacttggcctcatatatgttggtttcctgcccacttccagtgacccactggggctgtgggcttaccctggaagcggaacttttttcttctttgagacagggtcttgctttgttgcctgggccgcagtgcagtggtgtgatcatggctcactgcagcctcaaaatactgggctcaagcgatcctcccacctcagcctccctggtagctgggaccacaggcacatgccaccacgccttgctagtaatttattttattattttgtagagatggagtctcactatattgcccaggctgggctcaatctcctggctcaggtgattctccggtgtcagcctcccaatgtgctggcattacaggtctgagccaccaggcaaggccctggcacttttagcgctaaaaagggaaaagtctcaggcgggccaggatgggctggtcaccctagatccattgcgcccttgatttccagatgggacccctccccacccagccacacaccctgggggaggagacctcctgctgtctcatgccttcctgcgaacccctttgtcccctgcaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcggtgagtggggccggcggcggggcgcgctggggccggcgcggggagcccacccctgacctcccggcctccaccctgcagggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtggggagcgcggtgacctgcgggttactgggcctgggggtggggagagggatgtggggaatggggacatggaggccaccctgcggggatgggggtccttgggcatcagggagcggcggggcggggagggaccgggactcaagctctgctcctccaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgct

SEQ ID NO: 17142 - DNA, 11312 bp, Human; identical to SEQ ID NO: 17141

SEQ ID NO: 17143 - DNA, 6027 bp, Human
cagactcacccagggtgagggcgccaggcttagggtagaacagagcttgagactccgcttcaccacttaagcagcgcggtgacatggggaactcacctaaccttcccgagccttcgtttcctactctgcaaaatggagataacaagtctgcattttattatgtaactacgtcctaaggtacaaattaaagggcatactattggtattattttagagaaatattttcactgtgtcacccaggctggagtgcagtggtgcgatcacggctcactgcagtctcgaccttctgggctcaagcgatcctcccgcctcagcctcctgagtagctgggactacaggcagcacacgccaccgtgcccagctaatttatgttttgttttgtatagacagggtcttgttatattgcccaggcgtctcgaactcccggactcaagcgatccgcccgccttggcctcgcactgcgctgggattaccggcttaagccaccgcgcccggccagataatattatttttatgttgctggttttttgttgttgttgtttgtttttgagatggagtctcgctctctcgccaaggctggagtgtggtggcgcgatcttggctcactgcaagctctgccttccgggttcacgccattcacctgcctcagcctccagagtagctgggactactacaggtgcccgccaccacccccgactaatttttttgtatttttagtagagacggggtttcaccgtgttagccaggatggcctcgatttcctgacctcgtgatctgcccgcctcggcctcccaatgtgctgggattacaggcgtgagccaccgcgcccggcctgttttgttttttgagatggaggccctctctgtcgcccagtctggagtgcaatggcgctatctcgactgactgcaacctccgtctcccaggttccagaaattctcctgcctcagtctcccgagtagctgagattacaggcgcccactaccacgcccggctaacttctctcttttttttatttttagtaaagacgggggttcaccatgttggccaggctggtctcgagctcctgacctcaggtttaattgttataccccccgggcccttaacaaagctgtagtggccaggctaacctgggcaacatagtaagaccctggtctctacacaaaatacaaaaattagccggacgtggtggggcagggcctgtggtcccagctacttgggaggctgaggtgggaggctcacctgagcccagagagccgtgatcgtaccactgcactccaggctgagcaagagtgagacgcaatctcaaggggaggtggggggaaggaagctgcagtgatctctgcatggattggtcgtgtgtctgatttctttttattgtttgtttgtttgtttatttatttatttatttatttatttatttatttatttgagacggactctcactctgtcgcccaggctggagtgtagtggcgcgatctcggctcactgcaacttctgcctcccgggttcaagagattctcctgcctcagcctcctgagtagctcggattgcaggcgcgcgccaccacgcccggctaatttttgtatttcgagtagagacggcgtttcaccacgttggtcaggctgctctcgaactcctgacctcgtaatccgcctgcctcagactcccaaactgatgggattaaaggcgtgagccaccgcgtccggccgttcgtgtctgatttctatatgtgctgccgaagcgagcactcgtgtctaatttttgatttccccacaccacgcacgctggactagatcaccggctgggcaaggaagggggtctgcgtccctgcggggtcctggcagctcccgcgccaggactttgttgaatgaatgactgaactgagcgggcgccgcggggcggggcgtcccgaagcggacctcaaggcgggcggaggcgagagctccgccccggaaggcgggggcgggggcggggcggcggccgtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggtacgcgggactccggggtcggggaaccccgggccggggctcgggagccggactgggtgtctggagaacagcgccgaactgggggaacaggcggatgtggggatctggggtcaggtggccttcaaacagctcgctcccggctgtgggaagttccatcactctccaagcttcattcacaatccgggcctcagtttctcccaccgtccaattggggttgggggggtcttcagttccacaagtccgaagtacttcgaatggagagagaaagtgagtgagggcgggatgtttagtctaggaaggggcacgcccccagcctggtccgtacagggtctaactagccccagtgatcgacgagttggggaggccgtcgagaggcactagggtctgtgccctctataccatgtggggtgcccccttccatccggtgacttcagtgcccagctatgcggggggagggactggggtcgggcccggtgcccaggagtgagtcacccgccggcggcaggggggttgtggggacctgaccccccccacccccagcgtcccgcgctacgccctccctcccggagctgccgtgtcccggtcgggccgtgcggtcacctgtgaggaatgcgcggggagggcgccggtgactcacgttattcgagccggccgaccctgacctcagaccccagaatagccgagtcccgcccccagcctctgacccgaggccccctccccaggcaccgccccctgctcccgcggcagctcctggagcgcggacctggacaagtgcatggactgcgcgtcttgcagggcgcgaccgcacagcgacttctgcctgggctgtgagtggggggcagggccagtggccagcggaccccagactgggagggagggtggctggtgcgcagagcggggccgagagctttgcatctgggaaatcaatcgggaggaggtgggagctgggagggggctccggtcagggaggaggccacgtttgggagaaggcagaaggctcagtcttagggggcggggctggcctggagaggggcgaggtctgactccgagtcccgcccccaggcgctgcagcacctcctgcccccttccggctgctttggcccatccttgggggcgctctgagcctgaccttcgtgctggggctgctttctggctttttggtctggagacgatgccgcaggagagagaagttcaccagtaagtgtgccctggcctgcccagccctgtcagcactcgaccttttctctgctgctgacgaccccacctcttatcttgcagcccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaatggtttggagaggcagtgatccccgactgactcccctgagctggagggagggagtgagtcagccagccgcgggggcgggggtgaggctctgactcacacattctcaatgcctggaactcagccggcaaggacctggctggccctaacagttttccagggaagatcttgaggagaaaccccagcatcccgcgcctctgccctctccaccatccccaaaagccccaggttccagactgaagccttcctttgctcagcaatctttattcagttcttcttgggggtgggatgcctcccttcccatgctcccacccctcccatcccagaactccgttgggctcagtgtcctctgttgagggaaggtcttggtgcccagatgcctactctgcaggagagggaggaaccttgtccctttgcgggagtcgctggtctcttctgttgtggggaagaaggaaggtgggaggggcactgtccaccagcactcagagctccattatgtccccagctggggttgcagggtaggggggactgggggtgtcccccagcctcagcagacggagggcctcagggatgaggctgccaggatagcgccagagaagcagctcagagcaagggctcctagaagaggaaatgactgtcagggcatggagctgaggctggcctagctgagcacctcccaccaggtccaggtccccaggggctcctgggttcccagcactttccaaagagccaagatgggaaacaacccagaggtcagctagagctaaaaatggcacgatgaggcagggcctgaggtcagctgtgaggaccgcctgtgattctgcagaaggcctggccagtggaggaacctacctgagtgggggcagggctggggagaaggtcatgggggggctgcagtaggggtggtcattgtgcaggctgagttgagagaagtgggtggccatgttctcctcagacagaaactgcttgcgcagaggctccctggggagagatggcagagaggcaggctgggatactgacacaggaggcagcctgttggggaccagaggtgacagagatcttgttgggagtccctccctgcccccaaactcactgctcctcctccaggcgccgcttggtgctcatgggcacagctcctcggagaggggagctgggaaaaaaagagagcctggtgcaccccaccctcttggccccttcccaaggatctgcccgcctaagcctgcagcatcagccaggagccccaagcccattcctgtctcagctggtgccggtccccgctctcctggaccatccagcagggtacctcggaagtctcgaccctcagccgcagccccagtcccatctcagctcacgcctaagccccgccgattcgccccaccccgtattcatcctgcagaccagtcctgagcacccagccaaagctcctgcggcccttggtcaggcccaccctggtcccctacacgcacctggcgtccaggccccaagtcacccccaaggcggcccgcgggaggcgctgggcccctccctgggggcctcgctgcaagggctgctgcaggatcattgggttttggggtcctgcgggtgggatctgggcgacaggggaggagtctctgagggcgtggccaagagaggatgggcgtggctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcaggtgagacggacgtggtgcgcg

SEQ ID NO: 17144 - DNA, 7282 bp, Human
ttgactaaaattcctaatgctttgggaaaagttattaatcaaatagtgacagattatggcttttttgggggggaggggtgttgttttcttggagaactgacccgtttgttgttataaagggttctctctttatccctgatactttttttttgagacggagtctcgctctgccacctaggctggagtgcagtggtgcgatcgtggcttactgcaagctccgcctcccgggttcacgccattctcctgcctcagcctcctgagtagctgggactacaggcgcccgccaccacgcccgtctaatttttttgtatttttagtagagacggggtttcaccgtgttagccaggatggtctcgatctcttgatctcgtgatccgcccgcctcagcctcccaaagtgctgggattacaggcgtgagccaccgcgcccggctatccctgataactttatttcaaatagtgacaggttaaaagttaagagcggatgtttcagtatctagtttcccagcgtcttgccagttactttaagcttgtcgacaggagtttgatttcactgacctccctccttcctagagctatgcttactttttaaaattttaagaagctgcttcatttgcccattctttcaacgcattgttgtgtaccggcactgagtcagtctttttctttctttcctttttttttttttttttaagacagagtcttgctctgttgcccaggctggcgcgcagtggtgctatctcggctcaccgcaatgtccttcccggctccagagattctccacctcagactccttcgtagctggaaccaaaggcacgagcgagcacgcccggctaattctttgtatttatagagagggggtttcgccatgttgcccaggctaggtctgtcttaaaagagcttcttccggccaggcgcggtggctcacgcctgtaatcccagcactttgggaggccgaggcgggcggatcacctgaggtcgggaatttaagaccagcctgaccaacatggaaaaacccgtctctactaaaaatacaaaattagctggaagtggtggcgcatgcctgtgatcccagctattcaggaggctgaggcaggagaatcgcttgaagccgggaggcggagggtgcggcaagccgagatcgcgccattgcactccagcctgcgaatcaagagcgaaactccgtctcaaaaaaaaaaaaaagcttcttccttgacggttcccttttcccatgaaattcaaatgcttcattttatccctcatcctcttggcctttgcagtcttgctcccaaggctcttccctgcccgccaactctctcacttgggaacatagctccgtaagcctctgcccaacccttctccccggcgagcccagcgccccagagccctgcgcaggggaattcgagtgcggagggcggcaggcatccgtggggacctggttcaactccttagaccggttcttcaccgtcagcgactctcccctgacagattagggtaggatttagaaatgagaaatggaagcgctggctgggcggtagccgctgccatggcttcccgtgtggtcctcatcacatgctattgtatctgttaatttattaggcgcagggccgactctgagggatctagtgccaggacaaagccaggcactggtgaatgagcaaacacctgtgtatggctgcttcttccagccctacctgctccatacccacccccagcgcagcattcgaatctttgtgatctcggcgtccacagggaatttcgacgcaagctggcgtcagcctcaaattcccgctctggcaacaaggctgaccaaagaccgatgcatgccgggatgaggctggattgacgatctcttgcgacgctgaaatgcatttcgggagatgtagtcacacagacgggcggtggctgcgcagcgtagctccgcctcctgcgtgagaggaagcggggacgtgtgaggtcacttcctgcgtgttgggtggcttcctgcggcgtttccactctcgctctcctttcgttgcctgatcgccgccatcatgggtcgcatgcatgctcccgggtgagctcggggcatcaagccggattgctgggcggggggtgggaggaagacagggagtgtgggcagcgggccgaggggatgatgttctgggctgctctggcactagccgccacctcacctcgagactgcttctctccccaggaagggcctgtcccagtcggctttaccctatcgacgcagcgtccccactgtaagtagcgcgctgggaccggggagaatccggggagggggttggcatttgtctcgggtgaagcgacgccagggtgaggaacttgcgtgtatgaggagcgcggttttgcggaaggagagaccgctgttctgcggcgccattcctgggttctcatcctaaggctgctttctattccataacagtggttgaagttgacatctgacgacgtgaaggagcagatttacaaactggccaagaagggccttactccttcacagatcggtgagtgtttgtgtctaacatagcctatttcgcctgtcctcgtgtgacttgtaggatctagtaggtggtaaagttattttaaaaatagccaaaactctggtctcgccaccgtgctagaggcatcattgtaagcacttcacatgtactgatttcgtttaattctgaccacaatactttgaaataaatcttcatggctttcaccccagtttacagttgaggaagcagaggcacactgccgctggatactaaccagccccaaatcacacagctgtcaagtggaggagttggaattggctaagcagagtgcctgacacagttcctcacagttaggtgtggtttgaatctcagctgcgtgtgacttcgtgcaagtggcttcattcagcaaatgtttaccttctatgtgctgaacatggttctggggcctgagaacatactactctccgactcccccgcccaaaaaagccagccgcaatgtgcctgtagtcccagatacttgggatgcagaggtgagaggatcaccagagcctagaagtcccaggctgcagtgagctatgatgaagccactgcactcctgggtgacagagagaccccacctctttttttttttttttttgagacagtcttgctcttgtcgcccagtctggagtgcagtggcgcgatctcagctcactgcaacctccacctcctggattcaagcgattctcctgcctcagcctcccgaataggtgggattacaggcgcccgccagcaggcccagctaatttgtgtgtttttgtttgagaccgattctcactttgtcacccaggctggagtgcagtggtatgatctcggctcactgcaacctccgcctcctgggttcaagcaagcaattctcctgcctctgcctctggagtagctgagactacaggccgcaccaccacgcccggctaatttttgtatttttagtagagacgaggtttcaccatgttggccaggctggtctcagactcctgacctcagatgatccactgcctcggcctaccaaagtgctgggattacaggcgtgagccacaccacctgatcccacctcttaaaagggggaggggggtgcaaaatatctgtactcctggagcttgtagtctaattggaggtatgacacatcaaaagaaaatatgtcatagattgtaagtagtcagagctcattagaggtttaaaagaaataacgtgtaaagtttttagaagaatatctgaccagagttctcagtaaatgttagctgtggaatctcattaatccctttggtcatctgtattccagcaagctcactgtgatgatggttttccaacattcgcagtttccaccagaaaggttttccttagtgttgggtaaaccttccttggatgtctgagtgagctttatgtgcattctcacgttggtttctgtgatgtataaaagtatacccccatcttacagataggaaactatgccctgatttctgagccttgacatcatcacattctccagtttgtgtttcgtgttgaaagttaaaacgtgattcccttttcaggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggtaagctaataaataaaacctggtgctaagtaggactgcttgtactaaattttttcggtaaaatgtaatgcatctggtttgaattatccaaggcttagtacacaaaccagtgtagtgctgctttgaagttcaaattctatccaaagagattttcattatagaaagtgcatggtagctctacattctcttattaatgtttgataatgttaggtcattttgggtggttttcttgaattgcaccaaattttatttttaggataaggatgctaaattccgtctgattctaatagagagccggattcaccgtttggctcgatattataagaccaagcgagtcctccctcccaattggaaatagtaagtatcaactcttttgtcgttgttatcaagaataggagtcagccagtagtaaaagtcctagtagtaaatatgttcagccttgggggctagtagtaaatatgttcagccttgggggctattttgttaactgctctttgagctctggcctggtagtgggaaagcagccacaggcaatacataatcgaatgggtgtggctgcttgtctttaataaagacaagcagagggccatagttgcagaccccagatttagaccatgaataagccctttgactctcttttagatagtaggtagattttcctttcatacctctactcccaggagtttgaattaattttcacatgaattgctcactatgatgattggttgccagacattcgcagtttccaccagaaatgtttttccttatgttggccagttcttccttggacgtctgagtgagcatcttcattcattgtgcttgaacacaatgagttggttcaggtattcagaagtttggtgcactttatatagtttggatttattaactgtttgagaatagcaccattagtggggagattctgttaatgaatgtggagggactagtattaatcctgattttctttctttccccttttttctttttcagtgaatcatctacagcctctgccctggtcgcataaatttgtctgtgtactcaagcaataaaatgattgtttaactaaaagcatgtttcatatttattttcctagaagaaaaattatatatatcagtggttcatatgtgttgatcttgtttgatggggaagtgttttgggtgattgatgttaggattccagggagcagtaagatactgtccatcacatcccttgattggccccttaaaccagttgagcagcttataacctcataggtggttgctttaaacatggagaactggaagacactaggaaataatgcctttgtgtttgttttggtgtcatggcaaaaatgtttctaagtatttttgatacatttaatgttaaaagactgagacagatccctggcagatgttaaccacttgtagcatcagaaatagtaatattaggttggtgcaaaagtaattgtggtttttgccattactttaatgcaaaaaccacatttacttttgcactaacctaatacataaaagtgtcactggagggaggggaatctgatatggagagacattggatcttgtggtgagggttaaagatgaaggaatctaggggacagtaaacaggcacagttcgtctggagcattgggggtttaggaagaatatctgaagtgggcttgggttcctggcctttgaaaatctttggatgggttaaagtaagatttacttgttctggtattgtgttttaatttaattcttaacctaatggggtacatgggtattgctgcttgaatgagtaaaatctcagacaaccctagggagtggttcaaggttataagacttagaaatggttaagctgcatgtctggctggtgtttgttgacagagccatgatccttcagaattcagaaatggctgcacgtgttggctcacgcctgtaatccccgcactttgggaggccaaggtgggtggatcacctgaggtcagaagttcaagactagcctggccaacatggtgaaaccctgtcattactaaaaatacaaaaataagctgggcatggtggcaggcacctgtaacccaggaggtggaagttgcagtgagctgagatcacatcactgcactccagcctgggtgacagtgagactccgtccaaaaaacaaaaaaaaagcatctatatgcttttttttttttccctaacatctactttgacccagttggaaatagcatatgcacattatttttcctaatctatccgtgtgagcacctagaatttgtaggtttcctgcaacaactgttttcttccttgaaaaatcatcttttcaagtggtaggtgtccatcttacagtatcgctctgtcgcccgggctggagtgcagtggcgtgatctcagctcactgcaagctctacctgccgggttaatgccattctcctgcctcagcctcctgtgtagctgggactacaggcacctgccatcatgcccggctaattttttgtatttttagtagagacggggtttcaccgtgttagccaggatggtctcgatctcctgacttcgtgatccacccaccttggcctcccaaagtgctaggattacaggcgtgagccactgcgcccagccgatttttttttttttttttttttttgagatggagtttcactcttgttgcccaggctggagtccaatggcgcaatctcttcaactgcaacctctgcatcccgcgttcaggtgattctactgcctcagcttcccaagtagctgggattacaggcatgagctaccatgcctggctaattttgtattttttttttagttgaaacagggtttcaccatgttggtcaggctggttttgaactcctgacctcatgtgagccactgtgcccggcccatcttattattcttaaacttacacatgtatgtggttttatttatcttttcagtctcactgtcacccaggctggagtgcggtggtgtgatcttgggtcactgcaaccttcacctcctaggttcaagcaatttttgtgcctcagcctcctgagtagctggggttaccggtgcctgctaccatgattggctaattttcgtattttcagt

SEQ ID NO: 17145 - DNA, 30820 bp, Human
acgcttcaagctcagtgtgaagttttgaatttgctaaagtcaggtttagtactggtgtaggattagagtgaagatgtcagtatttttcatcaacactgcactagtgggctggctcggctggctcagctgtcagcttgcttgtaagatgacaatgaggtactggatgtgaaagttgtactattaccttataatttatctgttttttagtgcaattttagttgtgctgaaccccgtcatacctggctgctttgacaggtgtgctattttagcaacatggaacaaaacagagaaagaaaaaaagagtgcatggtacgcttgtgctgtcagatccaggttgctctgttcctaagtttatggatgatttgttcagagttgttaagagacaaaaaaaggttaggttttgttttcacttatgtgacactgaatgttctcacagttcacctcacaggtcagctgttgctcatatggactgatataaagggatccctttccctgtctcctttctatttgaaattccaccattttgattaattcctctgggctaaccatttgcctgctcaatatatggagagcccaaggtggacaacctttcaaatccttaatgttggagtatgcattcatatatcagattaatttcttccttgatccaaagcatgaaaaggggtaagaggtggagttggtcaaaaacatgtgaggaaggaagatgataaaataatattggtcccattccccagagccatccccaaatgtcaccttgaatgctttaaaaaaaaattcttaatgctgaaaatgactagtaggagacttatgtttatactttgcatactaaggctggacactcttcaatcaagaagaaaagttgctaccagctaccactgaaatcttagaggattgttcttaatcctagtagatgaagagcaaatatctgcctttggtgcaagtcagctctgtacatccaatccattggtaagacatgtgaggaattaagtgtcgttctcgctattgagttcccagccttgccatattctcaaagaactacacactgaagttgcagaaagcatataatagacgacatagcttcagttatttaaattcaaattttaaaagtactttacataatctaaaggtacatgtacaagaccattcagcttcagcaataaataaagtcttactctagtgaaaatgcaggaagctttgcggaaatattacctagcacattttgaaatagaagcaatgttttatttcagagaagaaaatgaaggttgaaaggttttaaaatattaaagacagtttagcctcaatcgaagaaataacattttctagaaacaacagagaataaaagttacaacaaaattatcaacaacttgcaaatgattcaaaacagattttatggacaaaatgctgaaaggtgggccctgtacaccaaagggcacatacaaatccacataaaggcaaagcaccagttaaatgattcacagtctcatctaaagcccatcaaatagatacatctggaacatctttggatgtacattgtgacttttgtatctcaactagcactttgggaccttggacaaggtgttaggaaagaaatcaatatttgctcaggatcaagacttctcaagatgactgcgtgaggtagaaggaagagggagaagaagaacttgcccagagttcactgttcatctactatgtctgattctgtaggagtcttcatggccatgttcagtaatgattgcatactgacagtactgataaaactatcagtgttttgttctcagagctcttggtcctttcattttgtcagtgtgtttttgccctacgtagtgggtccacataccaacagagacatgtacaacttgcctctatcatcaactccttatgggctagttgagctaagttattcctggtggcctctgagtaaaccgcaagaacagaagcattactaagcatccctgtctgagtgcaagggtgtgtgttggcagtacagccccaatcttgcaaaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtgagtatgatacggtggacatgggcctgctgagggtgtgggcggtgggcaacagcagctggggccagggtggaggccgaggcaggcaggggcgccggcgttagcagctcgccgacgcctcctccgtggcccaccctcaagtccagcccagggccgtggtggaacacactttcgcctcaatccctcgctggggatttcattccctgggcctcctgctctccagaaggccctcaccagagccttttggggcagctgcagagaatgccatttcgggtggtgaaatgtggtccacagtttaccttcgctccgggaaagacccaggctccccacttccattttgacccctatcgggtggcgccctgcgagccttactctagctctctttaaacgacttttgaagtgtcatcccaaaggaagagcatgacattcagagagaggaggcacattaagaaacagagtcaattactttaagaatgcaatgccagttaggtcgagatgctgagagaggagggggatgtgtgtcagtaaaatcacctctctggatctgctgatgtagcatcctttagaaaagtagtggggggtggggaggggcaggggatttcagaaataggacccttcttgataaacgttaggactcacaatagtcttaaagggaatggagggaaaacacccttgttatgattcagctttgccatttgcctaggcatgtctcattctaaggcttcattttgaatcaaattcatctgcgtctttgctccagggctccggagtcaggcagatctgagactttgtcctgtgctcgtcagatgttaggtttgtgacttgggcaaattaacctctcagttccccagttttcttatccattgaataggtatcatattactgcctacctcataggattgtaagattaagtgccataatgcagtaaaaaaattagcactggggcctgacacctagtaaatgttcaataaatgtaagctattggtattattattataccaaagatatattattattttatcttctcttttcagttgatttcttttaggaatcatgggggcatttctaaggaaggacctagctcaggcattattgtcagcaggataaaaaaaaaaatccatgaaaacagcagccctgcattgtaggttctagacagaaaccaaatgaggttaaatgcttggtagtaagttcagcatctgataataccccacaagagtttgaaataccttatgggtcagtgaagaaagattatcctgatgctggtgctagaagatttttcactgtatattgttttttaaaaacggtcaagccttgtttgtggcagctctcaggtcatgctaaatacatttttcacaaaggcttcaagggaaatacgtggaagctattgaatgtcttgggcttgaatctttatgttttgcttatataattattgttcccgtgtggaacctagggaagggcaatgaaaaccagctaggattcttaggctcttttctcattgaaagaaggtggagtgagtgggtgggtgaaaggcgctgctttagggaagctgacaaaggagataacatgctccttaacccaaaggtgaaaaagaatgtacaaaacaagtctgggcaggggagggacaacagggtatagtgagaggcaagatatacctaaggcttcagcctcacggggctcctggccgtttctcaagctcctcaaaaatgcccccacttaggatttctgcgcttattgttccttctgcccaaaataccttcagttcacatgtttgttcaactgtctcctccctcagagaggacttgcttgaccacctatctagaacaagtgccctctccctgtccctgatacactcactccatctctttatttttcttcaaagagctttaaactatctgataatttgcttgtttacctacttattgctgggctgtcctgcaaaaatataatctccatgagggcggagatactgtctccatcaccagaaacacaggaacacataataggcactcagcagatatttttgaattaacaaactgtcaaggcaaattctgttctttactgcaataaacggaatggccattgagaggttagggtatggactctgggaaagtcactcaaattctctgggactcagtttccatatttataaaacaggaatagtaatgtgtatcctaccttctgcaaaagattgccttaagtaccttatgcaagagagaagggcagctttagacttttgcctatgtaggccggaaccacatgaggaattaacttaggcaggtgagaaattatcaagcatttaagttttcgcccaaagtgaatcttgcataaatgcagtttttatgactcttagttctccatgaaaacctccttgtgaagtagcggaaaatactagacaaattgggagttcccttacggtgtctttcaaatggtacactggggcctcaaagtcttatgtgactgttagggtgatagccagaatgtgctgcagagggaagatatgaggatacattgccttttatcagtttctcaatgtttttgagttgagtgtcccttttgataaatgtaaaaatttcattccctctttttggtgctacactgtaattataaaatcagattttatttagaaataaaccacgtactcattttaaaccagaacacttatgatatgcagtcgaaataacaatataagtggtatcatatacacatggacaacaaggtatagctgacaaacatgcattgattgtagggtttactcagaatggtttctcattctatcttttgtttactcctattaaccaagaagatttaattgagctatagtttttatatttttattgtagagataatacatttcatatgccttcaaactgtactttaaactgtactttcaaacgatgcttgcccttttccccagttctgaacctcctaatcatggctttcagatatggccttttcttctgttctgatttagaaaatcgaaaattgaactgcttcataaagcactaaaggagttttccatttataggattgctcaccttcattttaagtaataagtatttctttcaattactttctctaaataaatatagatttttgtataagtctattaaaaatagttccttatacctattcattatagaaaatttgaaacatatagataatagaaattagagaaaaatcatctatagttttataacctaaagatgactattgctaaaaattaggtgaattttcttctatattttaataagatgaattgctttttgagcacgtgtgctcttacaattgtattcttacgagtgacgtatttgactactaaaaagtttgatttttgtatgcgtcaaaaaaagtaagggcaaacaccaaatgttatatatttatatatatataaatatctaatatatataatatataaatatataatataaaatatataatatataaatatatattatataatatataatatataatatataaatatatattatatataatattatataatatataatatataaatatatattatatataatattatataatatataatatataaatatatattatatataatattatataatatataatatataaatatatattatatactatatataatatataaatatatattatatactatatataatatataaatatatattatatactatatataatatataaatatatattatatactatatataatatataaatatatattatatactatatataatatataatatatactatattatatatagtatattatatactatattatatagtataatatagaatatattatatattgtatataagataatatattatatattgtatataagatataatatattatatattgtatataagatataatatattatatattgtatataagataatatattatatattgtatataagatataatatattatatattgtatataagatataatatattatatattgtatataagatataatatattatatattgtatataagatataatatattatatattgtatataagatataatatattatatattgtatataagatataatatattatatattgtatataagatataatatattatatattgtatataagatatattatatattgtatataagatataatatattatatattgtatataagatataatatattatatatatattataaatatgtatatttttatatattattataaatatatatattttatatatattattataaatatatatttttatatatattattataaatatatatttatatatatttatatataaatttacatgtgttaaaaatatgattgtgttcttgtattcttacaattgtatacgtttcccatttcccacttaatatgaaaaaaatacactcatatgtaatgttcttagagacaactttaagatgttatttttaatggctgcatggtagtccagctagctagtaagtataccatattttgcttagccagtcacctacttttagacatttgactcattccatatttttgttattataaattccatcaggatgtatatttcagtacattaaagtttccttgcatttatgattatttccttagaatgaatttccagtgtggaatttctaggtcagaaaacataaacagcttaggattcttgatatatacatgatcatgagatattttccctaaatggttattccaatttacatgctcacctgtaatgcatcagtgtccatttcaccacaccctcactagaagtgggtattgtagttaagaaaattttcccttgacatttggcctgttattctttattttatatttacactctatctctttattttccacattttatattcctttggttagtgactgtcattttatatggttgttaagctgttgtatttcctcccatgatttggctttttgtgtatttttctcatttaaccagttgaatcatactttttttaaacacactctatgtgtatatatatatatgtgcactaatccttgatctattgcaaggtatcctttcgaagtttggtgtttgcccttacttttttgacacatacaaaaatcaaacttttttaacacattgtaaatttatatatatactaatccttgatctgttgcaaggtatgttttctaagtttggtgtttgcccttactttttttgacacatacaaaaatcaaactttttagtagtcaaatacgtcactcgttttctttgtgtttgatttcttccttggctagaaagtcctttccccttgagatatgtcataaaacttcactgcagtttttgttttaaattacggttttgttagtttacatttacctctttaattccatttggagttgtattttgatgtggataaaagatctaatttgattttgtttccagatagctagcaattgtcctaatataatttataaatacaacttccattcttcattgatttgctagccgactttaccatatattaaattcttatatataacagttactgtttctggactatctatttgtctcaattgatccatttattcttgcactgatagcactatagtatgataatgttttaatatattttaaaaattatttgctattcttatctgttggttcttcaaaatgaaatctagaatcattttattaagttaaaaaaaattcattggaccaaatgttttagctctcacatgccagtgagaacacatgatatttgtctttctgtgcctggcttatttcacttcacataatgacttccagttctatttacatttctgcaaataacaggatttcattctttttaatggccagatagtattcaattgtatatgcatagcacattttctttatccattcatctgttgctggactcttctatatcttggctactgtaaatagtactgtgataaatgtatgggcgcaagtatccctttgatatattgatttcctttccttttgatagataccctgtagtgggattcctcaatcatatggagatagagagtaaaatgatagttaccagaggttgggaagggtggaaggcgatgaagagaggttggctaatgggtacaaacagacagttagatagaagaaataggttctagtgttcagtcgcacagtacggtgactatagttaacaatatcttatgtattttgaaatagctagaagagagtacttgaaatgttcttacatatagaaatgataaatgtttgaggtgataaatatcctaaatattcaaatcccctgatttgattattacaatgcatacatgtgttgaaacatcacactgtaccccatgaatatgtacaattattatgtatcaaaaatttttttgaaaacaccattggggttacattaaatttattaataaactaagaatgaattgtcatctttaaataatttagtcttcccttcccataacataagtctctccatttataatttttttgtttatatccatcaatcaagttttatagttttctttttgtatgtcttatacattttttgttatttcgagttattgtgtgtatgaatgtgtatgctgatttttaaaaatcataaatgggatctgtttccactatattttctgtttcataggaaagctactgattttatgttctgttcttgtatttatccagtgtactgaatgctcttattaatgcagatagttttttttttaagtttattccctttgttttttttagatacatcaagtttcttttcactgaggtacatatgttctctcacatttcttcccttctcaccctcaatgtagacagccattgggaaagttctgactgcccagtgggattgatggtgataagacgagaactaatttaaaatatttaaaataattagctcaaaaaatagtttatttccatagttggcatccttctggacatatctgcctttgtttgctacttatctgatggaagatttggaagaagaaatgctgttataattctttagcttcaaggacacataatgaagtcatttgacatgtatgtctttagataaatgcataattatctttttgtcctttaagttttaaagggacaactgggaataaagtgcctgtcaaacaactgaactggagaaatgggggaggagcagtgatgaaataaaattccagtttatcagttgcaataaaggggaacagtgtggcaaagaacttgaaattataacttaacttcatttagtgagaaattacaacttgcatttagtttttgaattcaattggatatgtgccttggtgccacatttatcttcatgataacttaggccaccaacattattttcaatttcctgaatacaatccagtggtaaagtgagcctgaaagccagcctaggattgtttgccacatataaaccaccgaatggataattcacggcaaataagccaagtactgactctggttgacaatgtaaaattaaagttgcaagattagcctgaagatgtcatttagcttaagcaaagggggagtctgggttgatctctttcgggctctccccacctggcctcttcccttcagctccctccactgccctccttctctcagtggacagttctagctccatgtccaagcagattccctccctttttgagaattgtgcttttggaattgtcttaaagaccaatttgttaatacattccctctagtataagagaggggcagcacagaatggtggttaagagcccagatcttccagccagatctctgggtgtgcatcccagctctgacccttaactagctattttcccttgggcaggttactttaactttctgtgtctcaggtttcttacctgtaaaacggcagatggtgataatgagagtacttacctcacagggttgttatgatgattatgacatgagttaatatttgtaaagttaacatgtaatatgtgttttttaatatgaataaaagctctataaataattgtaatacaaagttagaacatcataagtatacgtaaataaaacttgatatggaagttcaggggaagaagtggttatatttattttcatgactcatcaaaatatcacatagttttaccatcacacttgaagttgaatgactttcaactgtttcaaaaattaaaattctctctgaaagaataaagtttgggccattgtaagtttggaaagctcttgaatcagagtatagtctcaaaaataatggctttgtgtaggatactattcctctggatataaaagttctgaaacgtttgttaaaaatcattatagttgtgtcttgaattttgtatgtagcattagttcgtatagacgtagagggcataggtactggcttgctttatttgaaatgtcatgaagaagtcagatgtagctaaatgttttcttttgtgtagtacttgacgtggtataaaaaaggaattgatgtggatttgtcagttctaaaccaggatctgtccccaacactgacccactgagaaaataagaaataagtcaggttggttgcttcttgcttcttgtccatttctaacctggacacttttttacagttagggacaacttttgatgaaataaagacaaatttcaatatcagcagagactagattaacacatgctttatagtaattaaaataaattaaaggcaatgataaaactccaccgttctttaacaattattcatgttctgatttttttggtgatacattttaaactctaggattatcaaaaagtccaaaaaagctttaatgagggaaggaagttaaaagtacactacattgctggtttgtctgtattaagggagggagtcagaggaaatataatcctgaaggggatgtaacaatttaaaaaaatgaattacatttttatgagttgtgatttgcttaggctaggtttgtaaggctccaaattgtaattctgcttgtttttcttaaaaaattagtcacttaaataactacatgaaaaaataacatgcaagaatgcatttacgttagtttaaatttacttctagtttatatacacacagggacagacagttttgaatagttgtaatcagagtggcatccccttgtgcccactttttacacatactgtcattttatttttttatttttattttttgttttgtgtgtgttttttttaatactttaagttctagggtacatgtgcacaacgtgcaggtttgttacatatgtatacatgtgccatgttggtgtgctgcacccattaactcatcatttacattaggtatatctcctaatgctatccctccccccaccccaggacaggccccagtgtgtgatgttccccttcctgtgtccaagtgttctaattgttcaattcccacctatgagtgagaacatgcagtgtttggttttctgtccttgcgatagtttgctgagaatgatcgtttccagcttcatccatgtccctacaaaggacatgaactcatccttttttatggctgcatagtattccatggtgtatatgtgccacattttcttaatccagtctatcattgatggacatttgggttggttccaagtctttgctattacacatgctatcattttatgtcaacatagtccacatacttaaagttttctggaaaacctaagactctaacatttttgaattttggcataagattttatttgtttatttatttatttatattttttgagacggagtctctctctgtcgcccagcctggagtgcagtggtgtgatctcagctcactgcaacccctgccttccaggctcaagcgattctcctgcctcagcctcctgtgtggctgggattacaggtgcgtgccaccacacccagcagttttttgtttgtttgttttgtatttttagtagagacagggtttcaccatgttggccaggctggtctcgaactcctgaccttgtgatccacccacttcagcctcccagagtgctgggattacaggcgtgagccatcgtgcccagccagcattaacattgtaaaccttcacctttgacatagaaagtgtaattttgaaccattgtttctgctataattcctttatttttccctaatttatatatttatttctaaactggcaaaattgtatatatgtattgtgtatgacatgatgctttgaaatatgtatacatgtgtaatagctaaattgggataattagcatatgcattacctcacatacttacattttgtgatgagaacacttaaaatctactctcttagcaactttcaagaatacaatacattgtttttaactatagttgccacgttgtacaatagatctcttgaactttttcctcctaacctaaatcttttatcctttgacccaaatttcccaatccccaccctgcacgcccctacgagcccctggtagccacccaccattctactcttggcttgtattagttcaactttttaagatcccatgtataactgaaactacgcggtatttgtttctctgcgcatagcttatttcactttacaaactgtcctccatattcatccatgttgttgcaaatgacaagatttcctttgtgtttaaggctgaatagtattccattgtgtatatacaacatattttctttatccattcatctgttgatagacatgtaggttgattgcattatgtcttggctattgtgaataatgctgcaatatacatgaaagtgcagatttctccttgacatgatgatttcatttccttttgatatatacccagcagtgggattgctggatcatatggtggttctatctttaattttttgaagaactttcataccgttttttataatggctgtactaatttatattcccaccaacagtgtgcaagggttcccttctctctgcatcctctcttgttgtcttgtttttgataataaccatcctaacaggtgtgaaatgatatctcattgtggtttcatttgcatttttctgatgattagtgaggttgagcattttttcacatacctgttggtcatttgtatattttcttttgagaaatgtctattctggtcctttgcccatttttattttattttattttttttgcaatggtgtctcggtctgtcgcccaggctggagtgcagtggcgcgatcttggctcgctgcaaactccacctcccaggttcatgccattctcctgcctcagactcccgagtagctgcctttgcccatttttaaatgggattatttgttttctttctattgagtaatttgagtctcttatatattttggatattaactccttatcatatgtatggtttgcaaatatattctcccattctgtaggttgtctcttcactctgttgtttcctttgctgttcagaagctttttagtttgttgtaatcccatttatctatttctgcttttgatgtctgtgcttttggggttatacccaaaaacaattcccttattttgagcaattattccttatttaggggtgcttaggttagttccatttttttcactattaaaatagggctagtatgaaaatctttgtcaaattgcgttttcctcttgacttgtttccttggagtgtatgaagataagcaaggttatgcagtcaaaaatatgtatggttttataggtctcgttatataacttgccagtttgaatagcgattttccatggacagggacagagtatgttttgtttgaaaaggcatattcaatattttagtttaattttatgttacaaaattactggtttataatagaagctatagaaaataaaactaagaaatattattggggaagaaaggaaaaaatggttcagaaacactgtcctgtgaagactgaaatgattgacaaaccttcagcttatactaaaataaaattgcattcttaaagcatagactgaatgactacggaggaggtggcacagaactgccctgggcaggtggaagaagccaggttgacaacagggaagttgccatcaatattcccaatgagatgtgggcattcgctttacattttaatcagtccttctgtaactttaatgttcatacaaatcacctgggcatcttactaaaatccagattctgatttaacaggtctgggtggggcctggaagtctacatttctaacaagctcccaggtgatgttgatgctgttgtcctgggaatgcaatttgagttgcactgttttagatctcttccttgtatgacatattatagtaagagttgactacaggggatccttggtcagttacttcagtaacttgaaagtgaaagatataaactgctggcctatttgaggggtgaaacaattttgctcattcagaaattggaggggttgtggggagaaggaaattgttaatattagatgagttaatcatgagaagttttatgtaccattcacaccaggttgttcagagactgaaggaggtacgaagttttgaagtggtactcaggttcctgctacttaactgaaagtgagataagatcagattcgttaggaaacaattctcaaaacagactcatttactttgactaaatgcgtctgaatgatagtagggagatagagtcattgtattttttagagacccactgttttagaaagtggaaaacttgttgcttaccattctgcttatcttgttgctgagattttaaataatgaatctccacatcacccttatgatactgaattattgccattaatcatttctcatagggaaaatggaactaagaacctatgctgtttcactgcttccatctccattttgctatgtggctttaagaaaatcacttaaaggcttatgttgagttcccatggtgaaaaatggaaatcaaagctcttgccttgttccccatagagtacttgctgaagttagtgggctttgaggtagatttcaagtgtttaaaaagacaaaagactttaacattgtaatattgtatatttattcagcatattatatataggcatatatcaagctattttatatatgatctaaatattctggcaatccttcgtaaaaaataaaacatcatataatccacatcagtagttaaattgaccttttgttcagtgtcacgaatcaagtaaatctgaatagtgtgtttcagatttgttttggccctttaggtaatcagttctgatgcatattgatgaaagatatagtaatttttttttttagatggagtctcactcttgtcgcccaggctggagtgcaatggtgcgatctcagcgcaccgtaacctctacctcctaggttcaagtgattctcctgctccagcctcccgagtagctgggattacaggtgcccaccaccacgctaggctaatttttgtatttttagtagaaatggggtttcaccatgttggccaggctagtctcgaactcctgacctcaggtgatctgcccacctcagccacccaaagtgctgggattacaggcgtgagcctaatttaattcacatatttaaatacttttatttccaaaggaggttaatggtaaatgtgatcatcaagtcaagcatgacactctgcttgtaaacacattgattttaaccagagttcagtgcatgtcctggctaggtgtggtggctcacacctgtaatcctactactttgggaggcctaggtgggaggatagcttgaggccaggagttcaagaccgtcgtggtcaacagagcaagaccctgtctctgcaaaaactaaaaaaaaaaaaaaaaaaaaaaaaaaattagctaggcacagcagtgtgcaactgtagtggcagctactcaggaggctaaggcaggagggcaaggctgcagtaagctatgatcaccctactgtactccagcctgggtgacagagcaagacaccattaaaaaaaaaaaaaaaaaaaaaaaagcatgtgtcctaaccaaaagatctctattgacccaaacttgtgcccaagaatagcaatcagaaaatttatgaaatgaatgatttagattcacattcaattgattcacaattgattttgattcacattcaaaaactgaaacaattcattataaagtttaccttactgttttatgaggtaaaattttattaggcaaattaagtaggattactatatatactaaaatataacaaataatctatatccagtacagtgtggggatcaggaactggggatctagaatcaaatgggcctgattcaaatcccatttttgcttcttaatctctagactgattttggttacttaacatctcaaagtctcagtttccccatctataaaataaatattacaacataaacctaataggatttttgtggggtccaaaggagataatgcatgtgctagaaacttaactttttatcctcctaaattcacacgtttaaacccttacctccaatatgcttgtatttggagataggacctctaggaggtaattaatgataaatgagatcataaggatggggctgtaatctgataaatttggtgaccttatgagaagaggaagaatgcatgtacaaagaagaggtcatatgagcacacagcaagaaggcggctgtctacaagccaagagaagaggcttcagaatgaaacataccttaccagcaccttgatcttggacttcccagtctccagaattgtgagaaataaatttctgttgtttaagccaccctgtctatggtatcttgttatggcagcctgaacagaccaatacagattttggtactgagaggaggagtattgctgtaacaaatacctaaaaatgtggaagtggccttagaactaggtaatgagtagaggctggaggagttttaaggtgtatgctagaaaaaagcatagacggctgtgaacagaatgttggtagaactatggatgttgcaggttattctgatgaggtctcagatggaaatcagcaacatgttactgcaaaatgggagaaaggtgttccttgttataaatggtaaagaacttgactgaactgtgttctagtattttgtggaaggtggaatttgttgagtaaaaaaattgactttttatctgaggagatttctgagcaaaaagttgaaggagtggctcagtccctcctgactgcttatggtaaaatacaaaaggagagagatgaattgaagaaggaattgttaagcaaaagggaactggaacttaaacatttggaaaattctgagcctttatgtattgcaataaatgaggaagcttgttctggagacaacactaagggtgtggctggactatctgtcactacttaagattacttatgatgttaaccagccatctgagcagaagtcaggaatagagtttggaaaaaagcagcagaaatattaccagtttggaccaaagagaacaggacagtatggtatagttatttggctgcaaacatggtttatctttcaagaaaagggaagaacgaccctgagggtgattcagagataaccagggctgccattcctactataggcccaaagtgcacaggcctggagggtaaggctgcctctaccttggtttcaaaaagtgagactgacatccaacagagccacataggtggggccatcaccctagccaaaggatgtggccaccttacagagctgtgggggtgatgctgcttttccagtgaacctgaagggcagaatattgaatcgaagaggattattcttgagccttaagagctaatggagtttgccttgctaggttttggacttgcttgggacctgtgacccctttatttcttccaatttctcccttttggaatgggaatgtctatcctcttcctgtagcaccattatattttggaagcacatagcttgtctggtttcatagtttcacagctgaaaataaattttgcctcaagatgaataatactgctagtctcacccacatctaattttatttagatgagactttggactttagattttaagttgatgctagaatgagttaatttcttttgaggccgttgggatggtataagtgtgagaaggacatgagttttgggggtcgagagtggaatgatatagactgaattgtgttcccccataatatgtttaagctctaacttccaacatgactgtaattggagatagggggtaattaaggttaaatgagttaaatcataagggtggggctctaatctgataggataatcataagtgtggggctccaatctgataggattgggggccttattacaacagaaaaggctgtctgagtacacagcaagaggtcagctactcacaaggcaagagaagagggctcaaaatgaaacttatgttgctggcacctcgatcttggactttccagcctccagaactgtgagaaagtaaatttcttttatttatgccattcaaggtatggtattttgttatggcagccaagcagactaatacagcaagtaaaactcttggcatgtagtagaaatcaattagacaaatatacaatatagatataaactgagtaatgggaaggaatgtttaccccatttaaaaggataagctgcttttaggaaaataaagttacaactaaggcactttggagatagtcctagtttacagaattttagagttgctcttccacaaaagtataatttaaaacaagcagcacttgtttttaattcatatattttttactattacttcatttataatatattatagggtaatatagtaatacagtcatgtgcaatatagcaacattttccttaacgacgaacagcatatacaatggtggtcccataagattataatggagctgaaaaattcctaccacctactgatgttgtagccattgtaatgccacagcacaatgaattacttatgtatttgtgatgacactggtataaacaaaccgactgtgctgtcagctgtataatagtatagcacaggccaggtgtgatggctcgcacctataatcccagcactgtgggaggctgaggtgggtggatcacctgaggtcaggagttcaagaccagcctgaccaatatggtgaaattctgtctctactaaaaatacaaaaattagccagccatggtggcatgcacctgtagcctcagctactcgggaggctgaaacagaattgcttgaacccgggaggcggaggttgcagtgagctgagattgcaccactgcactccagcctgggcaacagagcgagactctatctcaaaaaaaaaaaaaaaaaaaaaaaaaagaaagaaaaagaaaaagaaaaaaatgtatagcacagacaattacatacagtacacaatacttgataatgataacaaattactgtgttactggtttatgtatttactgtactatacattttatcattattttaaaatctactcctacttatataaaaaaaagttagctgtaaaacagcctcgggcaggtccctcaggaggtattccagaaggcattctggaatatgaatatcataggagatgacagctccgtgtgtgtgactgcacctgaagatcctgcagtgggataagatgtggaggtggaagacagtgatactgatgatcctgaccctctctgtaggcctaggctaatgtgcgtatttgtgttttagtttttaacaaaaaagtttaaatagcaaagaatacataaaataaaaattttgaaacagagaaaagcttatggaataaggatataaagaaaaacagttttgtacagctgtacaatgtgtttgtgttttaagcgaagtgttataaaagagtcaaaaagtttaaaaaaatttacaagtttataaagtaaaagagttgaagctaagattaatttattattgaagcgatacagttttttttttttgagacaatctcgctccgtcacccaggctggagtgcagtggcgtgatctcgtctcactgcaacctccgcctcctgagttcaagcgattctcctgcctcagtgcctcagcctcccaagtagctgggactacaggtgcgtgccaccatgcctggctaagtttttgtatttttagtagagatggggtttcgttgtgttaaccaggatggtctcgatctcctgacctcgtgatctgggaaatataaatattttaaaataaatttagtgtagcctaagtttacagtgttcataacattctagtagtgtaatgtcctaggccttcacattcactcaccactcactcattgactcacccagagcaatttccagtcctgcaagctccattcatggtaagtactctcaacaggtatagcattctttatcttttatactatattttactgtgccttttctatgtttagataggtttagatacacaaataccattatgttacaattgcatacagtattctgtacagtaacatgctgtacaggtttgtagcctggagtaataggctataccacatagcctaggtggtataccatataggtttgtgtaagtacagtctatgatgtttgcacaacaacgaaatcacctaatgatgcacttctcataatgtatcccccttggtaagtgatgcatgactgtggcaatattatattgctatacattataatagtaattttataaaaatatagttatattcaatttatagtattatatccttatactattgccattatatttataacaaatattattaatattaataattatttatgtgggcctgatagtgtattatcccagtgaaatgttttcaccttaagtttcgatatgtacttaaaaataagtctattgtttgttaaaactatctaataattcatggttttatcaattacaacaggtccctgttgtagtttctttctgtccaaatggtctctcaacttgacaaatctttaggagcatgaatttccatatttcaaaaaatgaaaagataaagaaatctcactggaaactgtggttgggcagatacaatatggagacaagttagattcactatgctttacttcctatgaatgcaatgacaccatatacgtgtgtcctagtatatgtgacatttatatgtaatattaagctcaaatttaaagtatccattgttcttttggaatctttcagtaatggaagtttattctttcacaggtatcacggttacatttatacataccgagtgtcccagacagaaacaggttcttggagtgctgaggtatagttgtatttatttttgcttctgggggtgtcaaggaggtatttgaaatttaggctggttttataaaagagcaaattatacattattaagtattcataaggtttaaatctctaaagctccaatccaaaattgttcatggatcattaagaaagctttagagaattttggtcccagtcctgtttagccatcattttgcagagttgtatgactttgggagaaagataaaaaagttgaagaattatgtcaaacttttagtgactatgtgaaatcttagaaagcatatcaaaagtaggtaaaataattaaatgaacaattatttaccaaatgataccaatatgagtattggtatcgtgggagattaaaaaacatgatgcttattttctaagagactacaatatacttgggaagttataacttgaaattaaacagttatgagtggaagaaactaggctttgtcaacaggtgaatctgggttccaggtctggtctcccctcctctctgataggtctatgatcttgggcaggttacttgacttttctgtgagccagtttcttcatttgtaaacggagcctaagaatcctcccttatgcacaaggctcaatttgaaaagtaaataagataacacacataaagaagctgtttgccacaaggcctggcacacagtgagccctcaaaaaagtgaactcctgaaaattgccacaactcctattaataactcaatctgtgcatttaaaattttctgaagtctagacttcaagaagttaaaatagctctcacgtttactgatttatcagtaagttggaaagtataaattacagaccacaaatgttttgaaccactgagatgaattaggccaagttttcaaacacacttttgctgtattatgtaaggatcattaaaactataatactaactaaagataaagttataccatttctaattgaaactatttatacctgtttatttaaaaaattctctgtatcactgcagagatgattgaataagaaattaaactttattatgaagaaagttatgtgtaaaatatactgacaaacacacacacacacacacacacacacacacacacacacacacacgtttgtatattatttcgccagaaatagctcttctccccagagaaatacccttcagctgctgaagaatattatgtaaggaaaggatcttaaatgcttagggtttaacaactttgtttttcaacttgttttcctgcattttgagtataacatcatatgagattgttacatgcttgtgatcatgttaaagaagagagggcttattgaacacaaatgccccctcatcctgttgtctgatctgacgttgtttatgtaataatattgtaattttctgcaccaagagagcagaagattggcatgacatccgcaaatagaaaatagtttaaaaaattctttaatttttgaaatgcatattgcatttttttctatctactaaatttaccttcttagcagtgcttttctaaggtgaaaattaaactagtgtatattctcagagctcataccacctgactggaaaaaatttctctagagcatattgaagaccagctgtgatctaatacatgtttccatggataactaagaggtgacagtatgggagatttgcaaatttgaagaatagctgagttcagtgacaggatgagagttgtcagtggtacaattcttgtgataaatgtattttcgaaactgggtaaatgatagatattaatactgatttttggaacaatgttttagtttgccatgctgcaggaaaaatcaaggcagtagcatgccaccatctgtgcatatattatgctagaaatctaggtaagtgagatttgttttaaagagtgtaatgaaatcaaaccctggccccactgaattatgaaagacagatatcatgtgtttttctagttttagagagacttttaggttaaatctttgcctagtgtattatcttatatgactcagactaaaagtttgttacattgttaatttagataattccacaatctactttcatttattaatatgtgatttgttggcaatacattattaaaaatgtactgacatcaccctgttgacatcagtgtcttcaggctttactgggtatatgatcaggagatcagcagatgttaaataattgtccttattaatctaagtaaaacactgtaaaataggccagtcatttgcttatgaaacatcagatccccaattcaaatagcttccatacttccagtgctattattcatttctgttagcatggataatcaagtgttagctacatatcagtacccataaaaatgttgcttctctgttttgttttgttttgagacagagtctcactctgtcgctcaggctggagtggtggaatggcccgatctcggctcactgtaacctctgcctcccaggttcaagtgagtcctgtgcctcagcttcccaagtagccgggattgccaccacacctggctaattttcatatttttagtaaagccaggctttcaccatgttgcccaggctggtcttgaactcctgacttcaggtggtccgccggtctcagcctcccaaaatgctgggattacaggtgtgagccactgtgcccggctatgcttctgttgataaatgactttacaagccacaagaagctaaaaagatgtgtggtttgaaatctttccacactttaggtgtgtatagtttttcttctgtttgatgaccctagcttcgctagatcctgtttggcccagttctaatctgaaaggcaagagactgggtcctgggattctgagccagttctgcctctggttgtctgtgtgactttgggcaagctgattaatttctttgcattcatattttcttatctgtcaaatgggaataactgaatcagccaataactgccattttgtgaggaaatagtgaaggcaagagataggaatgtgctttgaaaatgaaaaagtgcactgaggaaagtataaggaggcaatttgtgcctatgacctgcatttgcaatttggagactctatcttggaaccaacgaactgtttggacttctgcaagaatggccatgttattttggatgagttctcaatcgagctttaggaaggtggagggtaggtgagagagtggggtggagctgggtgagagagtgttctacatctactgtgaacatatgggggaacactaatatagagctaaaaagaatttttgtcatgttttcaatgaaaaattaccccaacataaggaaatgactgagagttactatggatagtgtagtatgctatcttcagcataccactatctagctgacagaagtcttcatgctcgccttcatgttttctcattaaatgctaaaaaaacaaacagctcccacctcaaaaatctaccagatggaatagctgaaaaacaacttaaaaaaaaaactagtcattgttcaattgctcatagcaatactattttattttacgtaaaatgacaggtttgagctgatgcctgaagcttggctcataagcttttgcaggaaattgttgttgatttcaggcagtgtctttgcaagacaactgatgtcaggaaaggaacacattttaatagtcacctgcaaataactgtctctttaaaaacacacaaataaataaataaaggtgaccttatatagtctttcattttcatgtcatagagaaaaccttgttacagtgacgtgctgatggagagaacaattttgggagtatagggaagtttcccaaggaggaaaaaatttaatgtgaagaatggcgcaggaaatattgtgaggtgaaagagtatgaggactgaactagccgtgcactgtgtgcatcataacagccaatttttaatttcctgtgtagcattttatattgtgggatgatggcagggaggatgggttgttggtttttcttttgttgttgttcctcaggctttttattaatgacctgtaggatctgtttttttgtttttgtttttgttttttcctgtttaactgcatcccctctgttggtgaattcattgtgggtaatggcctgtatacccttagaggtttgagatgtctgatggggagcaggcaggaagggcagggcaatgagcaagagcttgtacaaactaataccacctttgggagaactgaaatgacagctcattagctcctcttgcagggaaattcagccaaccaaagtaagctcttctggaatgttgtttttccttcttccttatgttttcaaatatttcaacaagttacacaaatgttacttctcttagcatccctagcacattttgtaggtctttttgtatcattatgagataggtaaataatttgcttggccttttattttccagacagcacctggggtacataaaagatatttccggaaaataaaaaatctcatttcagcatttcagaagccagatcaaggcattgtaatacctctgcagtatccagttgagaagaagtcctcagctagaagtacacaaggtactacaggtatgatttcctcttaatttttgacagggtttggaagctcagagttatgagtcaacctgttcataaccatataatcaattagaagttatgtaagaaaaatgcagtgagaaagtagatgtagccagcaagtcaaatgagaggtgacaatttatgtgctataattttcatctattattctaataacttttaataaatctctgtaaaaacatcaaaaattctataagcccataacattttaactgctcttgtctgtctcatcttgttctttcctgtccctttaataggtagctaagtatgatttcacttcactaattcagacacaaataatgtgaaagatggtataattcagagaacacctgggctgtcctttatctttgcttagtaaactgttttttccttcagggacatgaaagctaacgttagcctggcacacatgattctgatttctgaattggtggtgcttgaattaatgacatttttctgaagcaaaggaaattaaatagtgcactttattgttccactggcacatattgttacatatcctgagcaaacctattttagtgtatgtgtcgtgctaaagactgaataccagccaatgtctgtagctatctgatacgtgactgtttactcctctattgaatggggtttatcatttgtttggagtaagaggataggccttgattgaaacaataaatatttatgataaaagaaaacgagtccctttttgacagggacctaggctcaggcataaactgacaattagactcaagtggtgaattaaattaatgaatagttagcctttataatacaaatgcaaatagagctctaatttccaagttggctagttgtttttttctgcctaatattccattctttataactcagttttaaataatagttgcttgaggtatattactgtgttgtgtcattgtgagttttatgcagttggaaattttataagtttgagttaatctgtaattttaatagtttgtaagtttattttttcttgatttttgttatttttctttagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattatttttaaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttatttacctaatttgtcttgaaatattccttataattccttataaaatattcagagactgatgctattaataaaccaaataaaggattgatgattatcttatcggagtgattccctggaaaaggtaagtgcttttctgattttattgctgtccaagttcccggttgatgagcctacttcctgtcttctttggctggccttttattcatcaagtttttttttttttttttcaccttttctttcccaacatgagcatccttgctattttccagtacgtaatcacttgcacctttacagaaaggtcatatccttgctgtatctaaaatattgccatgctaacatattgtaagatgctgagtcaaggtagaaaaatgcacaatatatttccaagtgtgcagctctcttcagaaaaaaaaaaagtgtgtcagcaagcccaaaaggaacatgacagcttatcaaatacttattcatttcctctgaaatttgttcttaagagataaggtcagtagggagacaagcttaggtaattgtctgtttggctgttacaggcagggaacctttgtggtagtgcacaggtagaataagtctatagagaatgcctctgattaagtcctctgctataaataaagggctggatttaagatattctttcgggtagaatggacacagaattaaaaatgtgagaaacagctttaaactctgttaataatgtttcaacatcagcttatgttttatttgattcacttcgttaagcttagaatccaaagtctactactagtaaaacccagatttgcccttgagcatttcaaggttataggatgcctggtcttcctgttaggatgctatacattcaactttgacacctatgttttctcttgcagtaaatgggataccattattttgtagtttgcaactaggggggaagttaaactacccagtttggacattttcctaatttggggtgattggccaaacttgtagtaaaaggctgaattcttatcattaggtcatttagttcttaaatgaagattttttttttaatgtagcaagatataataaggctgactaactggatagagtccattaacatatatggaattgagatatatatatacatcttggttgcacacatacacgcagaaatagaactgttttctcacaagatgacaaaaggctatactacgtatcacattcagtattggacagagagagtaaaagcaggaatgcataagaactgatttttttttctttttctttttttagtcacctggtgggccatttaaacattttatttatttattttttaatttttattttactttaagttctgggatgcatgcgctgaatgtgcagatttgttacataggttacatgtgccatggtggtttgctgcaccatcaacccgtcatctaagttttaagctctgcacgcattaggtatttgtcccaatgctctccctccccttgccgcccaccgcctgacaggccccagtgtgtgatgttcccctccctgtgtctatgtgttctcattgttcaactcccactgtttttcatctttgtcactgattatccacgtgaccttaggtaagtcagtctgttactgttactgcatttgccaagtaggaataattaagtcgtactaacctcacaagattattaaggtacaataatttacatatatgtgtgtgcgtaattacatatatgtataactttaaggtagtaatattactgaatgtttaaataacattgactgatagtcacagatctctaaaagggagggtgaatagggaaggaatatacaaacgtctcctattataattctctctctataggagctcctgcccttttaaaaaataccctgagtgtgaggtgggatgcatattttgaaaaaaatttccagatgattgatactaacaaccccctacccccattgttttttactgatgggttgtgttgagatgatcaaggttgtcttctgctccatgagtcttttcactctctctctctctctctct

SEQ ID NO: 17146 - DNA, 55330 bp, Human
ccccgtctccccagaaagcgcggccgcccgtgtctgtttttgagggtctgtcgccaggtggttgtgtagttagtggaatcggcggatgtttttgtttggccggcccagcgccgtcccgagtgctgtgtgctgcacacaacttcgcacagctcagcggccgcggcccctgtggccttgaccgagaggcccggcgcgtggccggcttctccctgggcgggcggtgggaagatggaagcggccgtcttgtgggcagccttccccgcctgtggcccgcagggctcttcgatgtacttaagggaattattccttgagaagctacgtgtgtgcccccgcggatccctcccagtggaaatgcttgtcccagtggaagggccagggacagaaccggcccaggggggaagcggtgaagcagaggaggtcgtgggtcgccctgccctgctgagggcctactttccccgggtcccagttgcatgttgagggtatggagctgctgtggccgtgaagccttcggttcagttctccccttgtagaaagtgttgcgatgaagagcttcacggctccctgggagagagtgggtttccaggggctgcttgtcgttagggcgactcaggactttgctgtcgaggggaaaatgacaggttcgtttctgatctggtgagtaaccaactgttgcttctgccccacctcagtaatgacgcgtgtcggcgtcccgggtgcactagggtcgctctctgcaggctgtggtgtcacctctgcagggctcacggggccggctggggggtggctgtgctgacagctccccaggaatccagggttgagtgggtacctggaggccctggagatgcagggggtctgaggtttggccgaccacattttctctcctattcctttctgtaggtaattgcaatctagtttcaacatacaatgaggatttctgtctgatacagagaaagatacccagtgtctggagggtctgtcttaagaagtgctcttgaagtctgctgggatttcctttcgggactcacagagggaagcctgctccctgagggctttttctcaggcccaatagatcagggtaaggctgctgtgggtgcccctgatccccctgggccccgaggccaggcgtccctgacgtggcagggctagatgcagagtatgccttgggcttcagctgagaatatttgttttgcgagtcagtcactgaaaaatcattttgcttcctgtcagtgaagtgtggcgctttggagggaggcactgcccagcaggcggtggtcttcacaggaggtgtccacacaccaggcaccctggggacagctaggaatagacgcagtccgtggtgttgggacagcagaggcctctgccacgaggagctggaggtatgggaggcagctcactggttttgcctacctctggaaaagcagattctcctaagcctctgtggccaagtcttcaggcacctgagccagcgctggcgaccctcctggtgagggtctctgcaagcagcgaggggttcctgggggtcacccctcgctgtggagcctgagtggagcgtctgccttcacgtgtgccggggagaacagagattccctttggcgtcatgcatgtgtctggattctctcagaaaggaggaggacgtggaaggaggaggacgtggccagcaccatggtctcagtggggcttgaggagtgcccctgaggggaaggggcaggttggctcagcctgtggtggtttccatggtggtcactgccaaggctctgcagaagcggggttggggcctcccaggggccaagactgtcccctcagaccagtacagggctcccctgttggtcccctgtgccgtgttgtgcgtgtggagggcctgtctatagaggatggacaggctgtgatctgtctcctacccctggccccagcaggaatgctgcaaggactgtggtgactctgggctcatgggagtgctctcctgggagtagtggggaggggaagagtggtttagggggagcatccgataggaccaggtagccactgagcatgcctgtctggtgggcatagcctctgtgcctggtggggtccagccctgtatgtggacttcctgggggaccgcctgcatgctgggaaagtcctgcaactgtgggctctgggccggacccctcctccttggggagcgttgctgtggtctccgcagcctgttggtgtggtctgagaggggactggtgtgtggtggtagggacgcaggtgctcaggagggctcctcaggctgcctctctgcctgttactgctgctccctccctggtcctggggactcgctcaggcctggatgtgtggttttggacaccttggaaagaggttagctgtgagttttgctttgattgggctttgagctgctgagctagatctgtccaagcatgcttttgtggttttctcgagtctttggtcaccctgcgtagaattacctttacttttgccttcattttaggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggtaagcgtgtccaagcattgagtccacaaggagcctgcagtgtgggaccctgggaggacgtgggcacagcctgcagggcccgtgctgtgtggtcattgcgtttctagttggcgcagcttcctaatattcccctgaagtgtggttctgcttgtttaccacgtctttttggggaatagatgttgtaaaagattttagtctgtaggcttggaataatctgtagttttctatgtttttttttttggagacggagttttactctgtcgcccaggctggagtatagtggcgcaatctcagctcactgcaacccccgcctcctgggttcaagcaattctcctgcctcagactcctgagtagctgggactgcaggcgtgcgccaccatgcccgacaaatttttgtattttttaagtagagacggggtttcaccatgttggctaggctggtctcaaacgcctgacctcaagtgatctgcccgccttggcttcccaaagtgctggaattacagcacttgctcagccttttttttttttaaatagggttttgctctgttgcccaggctggagtgtagtggcacgatttcagctctctgcaacctctgctgccaggttccagcaattcttgtgtctcagcctcctgagtagctgggactacaggcgtgtgctcccatgcccagctaattttgtatttttagtagaggcggggtttcaccatgttgcccagggtggtctggaactcctgagctcaggcagtctgcctgcctctgcatcccaaagtgctaggactataggcgtgagccaccatgcccagccgtgcgtgaagatttttaagaatttcagtgactaaactttaagaaggaatgaagcccacgcaggaactctgtatgactttcaacccgaggggctctggcctgggcttcccagtgactgccggcatcgggacatccactgctgtggccttggccccgtttcccgtgctgtgccccccacttgctgcagatgccctgaggaaagggtggccaaacaaggggaggagctgtgagcacagatggggcctgccggtcaacagggcgggtagagccagcctggtgctgagcttgcagcttggctgggggagacgcctagagccccagtaccacacagaccctccaggactgccgggggtcagtgagcaggaccctctgaggtgtcagacctgccccacatgtgaggggaggacagcacaggtgggacgcatgcaggctgagctgcatcgggcggtgaggctgggaggttgcagtgagctaagattgtgctactgtaccgcagcctgcgtgacagagtgaaactgtgtctcaaaaaaaaaaaaagaagttttaagtgatttttgttaatattactctactttaccaaagtgaagtccagtttcttttcacagagctgtaaatactcagataattagtcaattcagacagaatgaacaaaaaatgctcataatccttcccatccagggaaaaccctgtcaaaaccaaggtgtttgtctttgtaaattaatctgactttgaagagatggttttgcttggatttctacctatgagtcaaaaagtctagggtttgtattaagagcttctgtataagaggtctaaaaatttcagctttactgaaattgaagcaaaataaacaaaatgtgatctaacaaaatgaagagccaaaagtctgaagtgctcccttccctggccagtaccagatgatgacctgctctgggagaggccgggcctggccgggccgcacgctctctgttctttggctcctgatgttgggtaggcaggactgaaggaggcagtgtttgcatgcaggacatgggggctgaagtggccagggctgattgagaagaaaactcgacctaaatatttgaaagcatgtattggagctaaaccgcgtactgtgtggttctgttcttttcctaacttgggaataaactattatttcagcttcgagtagagagagagaaacaaacctggacgagtgttcctggccgcggtctctgcagtctgggtttcccagtctccaggagatgctggtgcttcaggccaccttgccaccagtggaggagctcccagtgcgcctggcctgttggcaccatggtgctggacccacctctggggtggttgtgaggggcaggctctcaatacagtactgactgctgcctgaaaccgggtttactgccttgctgtggtctgagaggcagctgatctggcagccctgttcttaggccctgggcactacccctgggtgcatgtaggaggcctcagctgtgcatttgaattctgtgtagatgagggtgaagcttcttattttttattttatgtttagagacagggtcttgttctgttgcccacgttggagtgcagtggcgtgatcatggcttacagtagcctcaaactcttggactcaagcgatcttcccgcctcagcctcctcccagcctcagctgggaatacaggcacgagccactgtgcctggcccatggtgaagcttcttgatgtgcagccgtgggcggggatgctgagtctagttggttatggtgtgcactaaccaatggctccggtgtaggacccacctagagcatctgaggatgttatgcttcaggccagccagtcacgctggaagggagatgagaccccatctgagcagcgttttagagattttagagaaagaggatcttccttattccctgtggacagaacagaatctgccttcagggacggactgcttttataattctagtggtttaaaaaattaaaatttcaagtaaaaaagatagttcttttttttccccccttttttttgaggtggagtcttgctttgttgcccaggctgcagtgcagtgcggtgatcttggctcactgcaacctccacctcctgggttcaagtgattctcctgcctcagcctcctgagtagctaggattacaggcacctgccaccacacccggccgatttttgtatttttagtagagacggggtttcaccatgttggccaggctggtcttgaactgctgacctcaggtgatccacccgcctcgaactcccaaagtgctgggattacaggcgtgagccactgcgccaggctaaaagagatagttttaaggttataatctgtttttttgtaagtttgatatactatgattaaataataacagcggtaaataaacactttgaaaaacaggcagggctgggtgtgtggctcacacctgtaatgccagcactttgggaggccgaggtgggtagatcacgaggtcaggagttcgagaccagcctggctaacatggtgaaaacccatctgtactaaaaatataaaaattagccaggcgtggtggtgcgcgcctgtaatcccagctattcaggaggctgaggcaggagaatctcctgaacagagtcctgctcttctgctcagacgggtgcagtggcatggttatggctcactacagcctcgacctcctgggctcaagcgactcccccacctcagcctcttgagtagctgggaccacaggcatgtgccaccatgccctgctaatgtttttattttttggtgagatggggtcaagcaatctgcctgcctcggcctcccaaagtgctgagattacaggcgtgagccaccatgcctggccttacattgatttattgttattttttcttttctgttcttcttttttttcctgagatgaagcctcgctctgttgcccaggctggagtgcaatggcataatctcggctcactgcagcctccacctcccaggttcaagcgatcctcgttcctcagcctcccgagtagctgggactacaggtgtgtgccacggtgtctggctaatttttgtattttttttgtagagatggggtttcaccatgttgtccaggatggtctcaaactcgtgacttcaggtgatctgcctgccttggcctcccagagtgctgagattacaggcgtgaaccaccgcacccagccctattttttcttttcacttcctctctccagcatacatcagtttttattaacggattgagttgcacctgtatagaatgacattttttttttgagacggagtcttgctctgtcacctaggctggagcgcagtggcacgatctcggctcactacaagctccacctcccgggttcacgccattctcctgcctcagcctcctgagtagctgggaccacaggcgcccaccaccacacctgctaattttttgtatttttagtagagacggggtttcaccatgttagccaggatggtcttgatttcctgacctcgtgatccatctgcctctgcctcccaaagtgctaggattagaggcgtgagccaccgagcccggccaggaggacattttgtctttagtcttaaaggaaaagggaaagtcttttccatttgcaccagtttgaaattagggctcccttaacatggattactgcaggactcattcacatgagagttcatacatggggtgaaaagacaaacagggtttcctgataactctttttggttattgcatgaaatgagggataaatacacgcataatctgtttaacaaaactcctaggttcatcagaatgcaaagtagaaagtgtcttaaaagagactgtgatcagcaggcagacggcctgtgtcggtttggttcctttgactgcttcagatcttctaggaggagctcctctactacgagagcctggacttcagcctcacggacaagaacctcagataggcaaggctttgtgatgggtgctcctcctaccttcattcgaatgaggttttcctcccgccttcaccctgatagggtgctcctcccgccttcactggtgtcattttattttgagtttaaaaggatgaactggtcttggtcagccttaggaagggaagcatcactcaggtgaaaatacgtggcgaactttaaatacctagatattctcctcatgcatttaaattagagtgacttgagctgttagaaaagttgactgggtgcggtggctcaggctagtaatcctaacactggaaggctgaggtgggtggattgcttgagcccaggaggtcgaggctgcagtgagttgtgatcgcacctttgtattccagcctgggtgacagagtgagaccctgtctctaaggggttttgcatggttatccagagcagtctcttgaattttggttgtctttgacgcagctgcatctggagatcctctatgtgaggcatgtttagagaaagagaaacattgacccctggaattgatattcttccaagaaatcttttagtcttgttggtaaaggcagtcctcagatggtaccggtccctttgttagtggtgagcctacagagatggtgcctggtgtgcagagcgatgtggttggatggaggtgaacagagcagtctagggcccctgggccgcctgctggtcctagcccatcacagcacagtcattcagcagacatgctgcaccagctgattgtttgagcttgggcttggtgcacatgatggagtttgtctggatctcctgtcttggtattccataggaagatgagttggtccagcccatgtcctaatagatgttgttagcaggaagtctgaacttgaactatctcacatgaagaaagttccttctgctgcctctttttatttctctttggcttcatgaacagtcatgcacccccagtgccatccttttgagctccccaaggcctctgccagacacatcacctccaggggtgactccttgacccaccgtgccatcaccactggctctgcaccccttctgagccattcctggagcttgaggcactgtgaggtcaggggaaaagggtcagcgtggcaaggagagatggtcacccaagctggggtcatagagcagcttatggatttcctggaagtcagtgggaactcatttgggaacccccaaaatgagtccctgtggggtgtctgaaatggtggcagaaggggcaggaatggggtccggcagttctcttccctcaggtcctggcggatggatagcaaagtcctgtgtagacaaggtcacccacaggtggtatatgccggctgctaagggccttgggtggcgggccttggcccccgcagtccagagagtgtctgtttactattccctgcagggtaggcaccttgggccccagaattcggaaggcacttttttcctacctggactcacttcctgcagtgttggaggccacctggccctagtctattttatagagacagggtctcactatgttgtccaggctgatcttgaattcctgggcttaagcaatcctcctgcctaggcctcccaaagtgttgagattacaggtgtgagccacctcgcccagccccagccttagtctgtagtctaatgctggagggtagtatgttgactctggaataaagatgtcactattctggaactttttctggggtcactgtcgggaggcgttgtctcccttgagcacttgctgcagccccaggctgttgacctgcacagccgtcctcagagggtggggaagctgttctgtcttgggggcgttgagtccactaggtaggccctgtgaggatcccagctgtcacctagtgggtacctgcagaggttttgttttgttcttttaattgaggcggggtcttgctctgttgcccaggcaggagtgaagtggcgcaatcctaggtcactgcatccttgaactcctgggcccaagtggtcctcagcctcccaaagtgctagggttacggattagagccaccggccgcggccccctttggcttgtgtttttaagtctttttttcctccatgtttctggctgttaattttttataaaagtttgtatctggcatggattgaagcaggagacactggctcagtgcccagtggggagagccctgtgtgggtacctcccgggcggtgtgggtgcatgagttggctgctgcgggtggcaccgggaggccctgtgtgggtgcctcccgggcagtgtgggtgcatgagttggctgctgcgggtggcactgggaggcatggcaggggccatgaggccacaggtggcagctccctgtgcttgacctgcatcgggtctggagtggcgggcactcgggaaggaagcgccaggacgacacattggaaggaggagctgcagggcaggtccagccagtgcctgggagctcgggagggcacctgggtggacgcagcctgcaggagcgcctgctctcctgtatgaggaacagacctgaatgccgtttcagacactgactcattcctgccctcctgtgactttgttggttttctgggttttagtgcagattgtagctggcagctcacaacagagcccttcctggtgcaggctgacaggcaggagggattctcctctacagaaatggacattactatatctggaaacagtttttttttttttcttctttttgagatggagtcttgctgtgtcgcccaggctggagtgcagtggcgtgatctacgctcactgcaacctctgccccctgggttcaagcgattctcctgcctcagcctcccgaatagccggaattacaggtgcacgtcaccacgcccaactaatttttgtgtttttagtggagatggggtttcgtcacgttggccaggctggtctcgaactcctgactgacctaaggtaatccgcctgccttagcctcccaaagtgttgggattacaggcataagccactgtgcctggcctagatttgttttaattgaaaaagctgaagcaaataaaaattgtgctggggaaaactctgagtgctcagagcatgggctgcgtttctcactggcctcaccgcaccttcctctgcactcagactctcctaaagatgctggcatttactgaactaaaggtagcatttcgcagagcagggccgtgggccatgaaccacagtcatctggccatttagacagctctgccctgcccccggcgacttgggtacccaaccatgtcattcccacccctagctttgtggggcaacgttcctctaggccgggttctcttccctgaagcaccccaggcatgtagaagatgttctcagcagaggggagacaccacagtgtagctgatttctgtctctcttcactttcaccatatttacttacttttggtagaagtggggttgaaaatttatgtgaagttttctttactactggggacagcggggcagattactgccacacataatcacctctgctccagcctaggtgctacctgctggaggcgatggtggctttcctgagagcacctcctgggctcgggctggtggggagcttgattttacctttttatgtggaaataacttcaaatttacaaaatattcacaaaaataaagagagcagggactacccaggtgctctacatagagttgcctgttgctggggctgcgtcctcttttgcacaccctgccccgtcggagaggatcccagatgtggcccttgcccatgcacgtcaggcatgtgaaaagagcaggtgtcccctggcgatgggcagcaggctttgtggtgccccagccttggtgcaggagtcccctgaggtgagattcagggctctggccggctggtctcatgtgtttcctgagcgatggatgtgggcacggcgtcctccacctcgcaccacctggcatggggtctgcgtgtgtgtcatgccagggttctgggcctgcaccgggggctcctgccctgcctgtgcactgtttgtcgggggcttgtgcccgtgggtgagtgtatcttttcatttttagtgatgtctttaaaatattcttttttagtttggaaatctttggagagagccccctgttctttcactcaactttagaagttatacgcacctggccagcctcccctctcccattccttccattccattgttttgaagcgagtcctggccatggaattccgttcgtgcacccgtcagtgtgtaaaggttctgaaaagcagcctgaattttctattgtctgatgaaccgaagtttgttcatttcatcgtactcctcaaatttatcaccctttccccatgtggcatgtgcatgctgggtctgcttgaagaaactcgtccccactctgcagccgtaaagctgctccctgtatttcctctaggagtctttacaaattttttttttttttttaaatggagtctcactctgtcacccaggctggagtgcaatggcacagtcttggctcactgcagcctccgcctcctgggctcaagcgattctgcctcagcttcccgagtaactggcattacaggcgcctgccaccacacctggctaatttttgtatttttagtagagatggggtttcgccgtgttggccaggctggtctcgaactcttgacctcaagtgatcgcccacctcggcctctcaaagtgctgggattataggcatgagccattaatggctcctggccaaaaatttttttaataaaaataaaaggctgggtgtggtggctcacgcctgtaatcccagcactttgagaggccaaggggggcggatcacgaggtcaagagattgagatcatcctggccaacatggtgaaaccccgtctctactaaaaatacaaaaattagctggtcgtggtggtgggcacctgtagtcccagctactagggaggctgagaggcaggagaatcgcttgaagccaggaggcagaggttgcagtgagctgagatcatgccactgcactccagcctagcgacagagcgagactccatctcaaaaaaacaaaaaatagagatggcgtctcactgtgttgcctaggttggtcttgaactcctgagctcaaatgatccactcacatcagcctccgaaagtgctgggatcataggggtgagccatggtgcccggccacctcgaggagtcttgagccctcctggaattgctgtttggtgtgaggttgggtcaggcctggtgagtcatctgggttgtgagccagcctgcttggcctcctggtctcaggccagctgtgacctggaccttgggccacccagcagctttgtgctgagcctcagtctgcggttgggagggcaccccttgtctccagaatggtcctggcgtgtgaggtccttggtgcgtccgtgtacagtgggcggcaccttgtctccagaacggtcctggcgtgtgaggtccttggtgcgtctgtgtacatgggcggcaccttgtctccagaatggtcctggcgtgtgaggtccttggttcgtctgtgtacagtgggcagtagctttaaagttcctgcttcaccttgtcagacttctggttagagtcctcccgacattagtgttcctttaggaagcttggactctttacaccgttaattacactgttaatttcacttaaacatggaggtggcccagtttgctgcccatgtaagactacttttacttttttgagacaaggtcttgctctgtcgcccaggctggagttcagtggcatgatctcagttcactgcagcctccacctccagagttcaagtgagtctcatgcctcagcctcctgagtagctgggattataggcatgtgccacgactcctggctctctctaggacttctttaatgtcataatagaagctgatggttttctccataaaagtctattagatttatttctaggcacttgttaatatagtacttcttaaaattagcatttttgtttttagctatgtgttgtagatggatacaacatgttgtaagattcttttggatcgtctttgtggacagtatctgtgaagaatgactcctgcctcagtctcccacttgaacccaggaggtggagcttgcagtgagccgagatcgcgccattgcactccagcctgggtgacagagcaagactgtctcaaaaaaaaaaaaaaaaaaaggagcagactgtgctccttgccataggattttatccatgttcttttatttctgcctctcaaatactgtttaatcttaacgtatttttaaattttgtgtgatttttctgtttttgagaggaatttttgatatgttaatactatagatcttagtatattttaaaaactgatgatgtttgatacatgccaaatcatgtgtggaccataaatgtaaatagcaatgcccacaaacccacccatagcctaggaattgggagactcagcaccgccggctgaattcgcctgtgcggtgtgtcccattccatccctgttctgccgcccgtgggggaattttgtcagcttcactgagacacttagtaccctccccttacctgtggttttgctttccatggtgtcagttgcccatggtcagccatagtctgaaagtattaaatgggaaattccagcagtaagcagttcataagttttcagttgtgcaccattctgagcagcgtgatcacagtctccctgtcgtgtcctgcctgccgggagcgtgaatctaacctttgtccagtgcacccacgccgtgcagctgcctgcaccttaacccgcttagtagcaggtaccaacatccaggctggcgctcggtcctgttccaagtttcaggcagccgctggaggtcttggaaccatcccccttggttaaggggggactcttgtcattcacacaccatgaaatttacccatgtgaagtgtacagttgagtggattttagttcacagagttgtgcatttatcaccaccaccaattttagaaatttttatcacctccaaaggaaaccctgtgcctcttagccattaccccaacttcccaccttctcatcctcccccagccctggcagccacccatctgcatcctgtctccgtgtatttgcctgttgtgggcatttcatagaaatgtgtttttttgttcttttatgaaatgtgttttttttgttctttcactgagcatgtttccaaggtccatccatcgtgccccctgggtcggtgtgccattccttttcacggctgcgtaatgttcattgtatggataggccacgtttaaaaaaatctgttcatcttttgatggatgtttgtttttttcctactttggagctattatgaacaatgctgctctgaacatttgtgtaacagtttttaggtagtgtgtttttatttctcttgggtatattctaggagtggagttgctgggtcatgtggtaatgctgtttagtattttgaggaagtgccagattgttttccaaggcagctgtacccctgtatattctcaggcgctgtccttttgatgatacccattccatggtgcaggggcagcgatcgctcgggggttttgctttgcagttccacagtggctgaagatgttgcctggccatttgcatattttctttggagaaatgtctgttcagatctttgccatgttttcattggttagctgacttcttactgttgtcataagagttctctgttctgggtactagactccctattagatacatgacttgcaaatactttctcttcattctgtgggtcatcttattgttttattcagtgttctttgaagcacaaacatttacaagttggatggagtccagtttatctgctttctcttcggttgcttgtgcttttggtgtcacatgtaagaagcctttgcctaaccaagggtcttttaataggagttttatttatttttatatgtgcacatatatatatattttaagagctggggtctcactgtgttgcccaggctgttctgaaactcctgggctcaagcaattttctcgccttggcatcccaaagtgctgggattacaagtgtgagtcaccgcgtctggccactgttttcctatatatgataatttctacctttacctgatagcagtctagaagcatgtggggcttgcttgcttgctcgctcgctttctttctttctctttctttcttttttaaccaaattaattttttaaactcttgatatccattgcttgtgctgtgggcaaaggacgtgacctgcatggtacgcattcattctttgatgcttgttgagactttatggcccaataggttatacattttttataaatagtccatctgtgcttgtgaatatgtgtgttctttctttctttgatgcaatattctctatgagcttgttgggtcaaatgtataagtcatgcttacatttttaatatccttaatttatttttgcgtgaattggtttcattaggcttgtaggtttaacagttctcattgtagctcctggaggttttgcatttgatattttcaagatgtcccgttaggcagtgtgtacgcatttggaatttggtcacttccttcgatcatggtccagtagccctcatagccctcttcactccagtcatggtgtttctctggcctcagttcagctgatcggtcagcagtacccactttctgctccttaatgtacacctgaacattttccttatgtccagcttcagccttgctgtggtattttaaaactggaattacatatatatatatatatatattttttttggagacgaagtctcattccgtcacccaggctggagtgcagtggcgcgatctcggctcactacaacctccgcctcccgtgttcaagcgattctcctgcctcaagccttccaagtagctgggattacaggcacctgtcaccacgcctggctaatttttgtatttttagtagagacgaggtttcaccatcttggctaggctggtcttgaactcctgacctcatgatccacctgcttcggcctcccaaagtgctgggattacaggcgtgagccactgcacctggcctaaaactggaattttaaatttttaaccagattgacaacctcttcattagcaactttagactgttgacttatgttggattactgatctattttggatttgtttccatgatcctttttttccctttttctttatttttcctctgagactgagtcttgctatgttgcccaggctggagtgcagtggtgtgatctcggctcactgtaatgtcttcctcccgggttcaagcagttctcctgcctcagtctcctgaatagctaggattacgggcgtgtgccatcatgcctggctaatttttttgtatttttagtagagatggggtttcaccatgttggccaggctggtcttgaactcctgacctcatgatctgcctgcctcggcttccaaaagtgctgggattacaggcggaagccactgcgcccggctcactttttcttctgatgtattgactcagatggttttgctgttttggagtcgggggcatttttcctcctctactcatttggaaggtgcacattccatttaactctctgtattcaagttttttcagtattttactgtggtcacgtacacataacataaaatgtaccatcttaatcattgtaagtgtatagctcaggggcatgaagcactttgatattgctgttgctgtgcagccatcaccaccatctatcttcagagcctttttgtcttcccagtctgaaactctgtcccagttaaacaggaactccccattcctccctccctggctgcgggcgttcaccgttctactccctgtctccatgaatttgactcctcttcagtccctcacataagcgcaatcaggcagtatttgtctttttgtgtctggcttattgcactgagcacattttcaaggcttttccatgtcattgcatgcattggaacttccttgccttttaaggctgaataaccctctgtatgtggagataagcttttgcttacccattccttcctccatgggctcttgggttgcttccatgttttagccatcgtgaataatgctgtgaagaacatgggtgataagtatctgagcctgttttcagttcttttgggtgtatacccggaagtgggattgccaggtcacacggcatttctgtctttaagtgtttgaggagccacaacactgttttccacagcggctacacctttttacgttcttgccggcggtgcgcaagggttcagggtttccacatccttaccaacattttttttttgttttttgttagtattttttgatagccattctaataggtgtgaaggtgacatcatagtttggatttgcatttctgtgtttattgagcatttgcacttttgaagaattgtctatttgagtattttaaccagttttgaattggattattttttgtcaagttttaggagtttctggatattaatcccatttcagatacgtgatttgaaaatatttcctcccattcactctgctgtgtgtcttttaatgcacacattttaacatttttcatgaagcccagtttattttttctttttgtttcctgtgcctttggtgtcttattcaagaaatcattgccaaatccagtgtcatgaagcttttcccttctgttttaagagatttatagttttaggtcttatgtctaggtcttcgattttgagttaatttttgtgtgtgaaatgaggcaaggtccaacttcacattcttttgcatggccatatccacttgtcctggtgccatctgctgaaaagactgtcttttcccctctgaatggtcttggcacccttgtcaacagtctctgctggatacgggagggttcgcttcagggttctctgctattcccatggtctatatgtgtgtcctttcgtcagcaccgcactgttttgatgaccgtagctttgtggtaagttctgaagtcaggaagcgtgacttttacagctttttcaaggtgatttggctgttgggtgttccttgagtttccatatgaattttagggtggattttcctatttctgcaaaagacatcattggtattttgataggaattgcattggatctgtagatcactttcggtggtattgacatcttaacaatattggtcttcctatccatacgttccctagtgcatttagtgggtcccatggtaaagtatttatgtgtcagcatgtagactgggcttaacaaaaatccaaggaatacttgatgttggaactctggtgacctccctcatttccggggttcttttccctggtgtgggttcttttttttttttttttgagacaaagtctcgctcttgttcctcaggctggagtgcaatggtgcgatcttggctcattgcaacgtccgcttcccgggctcaagcgattctcccacctcagcctcccgagtagctgggattgtaggcacgcaccaccacacccggctaatttttgtatttttagtagcgacggggtttcaccatgttggccaggctggtcacgaactgctgacctcaggtgatccgcccgcctcggcctcccaaagtgctgggattataggcgtgagctaccgcgcccggctcctagtgtgggttctgacttgtctgcagtcatccctgaggtgggcattgcggctgctgcccccaggcctccttcatcttgcccgtattgccggcatctcagtccacccagccctcagggactgctttctgtggttgtcatatgtatgtctttgcttagttttcttatctgaggtctgtttccccttaactcttctgtccgagttgagtgggggtgctcatcgcctcagctgggaagctgctcttccatgctcttcctcactctaattttggggttttcagcctcttgctcacatgagctccctcagcctcccaagtagttggggtcacagacgcacacctctgcatctggctcttaagtttttaaagcattttcatcaaagcctttttgctcacaacttgtgggctgttgacatttccagaagccctgactctggagaagatggtggcttgttgtgatgaggtcagaattttttctcacatctcatgggtcagaagaaataaaaacaaacagaatctttctttctttcttttttaagagatagggctggctgggtgtggtggctcatgtctgtaatcccagtacttcgggaggctgaggccaggagttcgagaccagcctggccaacatagcaaaaccccatcttcactgaaaacataaaaattagctgggtgtgggccgggagcggtggcttatgcctgtcatcccagcacttgggacgccgaggtggacagaaacctgaggtcaggagttttgagaccagcctggccagcacggtgaaaccttgtctctgctaaaaatacaaaaattagctgggtgtggcaacgggcgcctgtagtcccagctactagggaggctgaggcaggagaatcgcttgaacccgggaggcggaggttgcagtgagctgaaattgcgtcactgcactccagcctgggcaatagagtgagactccatctcaaaaaaaaaaaaaaaaaagactcactgaaccagaagagttaagtgttgtgctattgactgcacatggtttgcctcagtcccaagtggtaaaaacagactgctcccaaaacagcaggccatgaggtgaccaggtccagcccagcccagcctgcagaggaggagccctgtggggctgtgatcagagcccagcgtcccagtgcacctgccgatgccctctccagcctctggcttccttccgttggctgtccttggagggctgtgcttcgtgggcaggcgtttggtgtcctgagcatgcagactgcccttggagtggtgggcaggattgttttagcctaaaggggttccacatctgcacgggagctcttgctgatgggtcactctggcaaagttcccccggcgggttccctgtgagaaggcacctcacggtcagttctgggtctggtgagtgttctcctgcaggctccacgcttgagccaggttctgccggaagaggcggcgttgggttcccttggtggatgagaggcgccgagggtcttggtggctccatgtgcccccaagggcagcactttgcatttcttgggagacttgaagatgactgatgtcattttagtgagcacggtaaaacagcacctgttagcggcttataccttgagctctgtctctcttcttggaggtgacatggggaccagtgcccacctctcccatggcgtctgagtggacagtgtctaaggttttgggcccgctgacacagatgtggttgaagtcagcttgtgtgcagatggggtcacatagaaagaatgaaaactgttgaaggctttgctcagcatgttttctttttggatattcaatctgataaatgttgtagtgaatgagaagtggatgaaatcttttttttttaattttatttttgagtcagaatctcgctctgtcacccaggctggagtgcagtggtgcgatttcggctcacaccaacctccacctcccaggtttaagcgattctcctgcctcagcctcccaagtagccgggactacacgcatgtacctccacattcagctaatatttttgtatttttggtagagacggggtttcaccatgttggccaggctggtctcaaactcctggcctcaagggatccccccacctcggcctcccaaagtgctgggattacaggcaggagccactgtgcccaacctaaaaagtggatgaaatcttcaaatggttggagatcgtgaattttgttttagcagcactagggatagtagaaatacaggtgtcatggcttagggagaaaaagtatgaacacatggttttgttagcagtagtactgtcatttctagtttatgtgatgaaacatcttaatgtactgcttcaaagatacactgagtgtttgtgttttaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcaggtacgtggctcgtggcccccacagcctttctgcgtctctcacccccaccctccagggagagggcacctggttcaggctggtcacggtgctgccccctgggctcaggctccccgttgggaagcctccgtctcgtccagccctggagctgtaggaggagtcgggtgcactgggctctggatctgcgactcggggggtgattctcatccatgcctgtcactgggtgtttcttccgttttgagttgcgctcccccgccctgccctgcccgcacacacgctgatgggcagtggccagctctggggactggggatgctcagggatgtgttatgctgtggctgcatgagcgtccgggctggggacagcaggagtgggacccggtgagcacacccgggccatgtgggtgggggtctgtgtgctgggcctggagggtgggttttggaaatatgtgaggagtggtttatttcgagggccttgctctgaaggttggtttagctgggactgtggtggggtggggagggctcgagagagctgagagagtgggagggaaggagcaggacttttcctttttaaaagaacaaacccaaactcttacattttgatagtaggtttgagtttatagactcatctgatactgtgaaacagttctgaaaaaatgggtttacagagtgaagtagcttctgtgagatgcacaaaagtaattgaaaacacaagcagctctgcacacggcccaggacctgcggccagcgccctctgcccacgctgcctagtgaggagccgctggtcttttggaagagctgtctgctgctggcgtcgcgtggcctgagtgcctcttggaatttcctcatggtgcttttcactgccatcctgggcacgaagcgaaaccatcctgctctgctgtgaggtggtgacttgctcacaggaagcttgagtctacagggttcacggttgggtccccgtgcggtggtgcggtggccggtgctgtctctgcctcgcagactctgcctctgcagcgtgagccctgttcagtcacctgccgtggctgccttgtgctccagggaactacagagtctggtgctctggtctggcaggtggtggtttgtgggtctgatttggtgtggtggggtccaaagttttctgacggccttggtgcgtcttggctgtggaatattccaggtctcccgtgccgtccacctgggttgccccactgtgtgtctgtccatggaacttggggctccccgggcaggtctgtgagccagcccctctccaagtgagatcctcacgtgtccacagagttgaggcttcagtgaatgtcttttggctgttgaatgagttaaccgcatcttccgttccatgatgtgacttggctttccatctctcctctgtcctcacctcgtagcctccagggctcctggaaaggacagcacggtttggggggctcttaagaggccagagtcaggaagtggctgagcggcgggaagctctgggggctggaggcattggtctcggcccccgcgatgttggggaaaggaagagagtggaggcattggtctcggcccccgcgatgttggggaaaggaagagagtggaggcattggtctcggcccccgcgatgttggggaaaggaagagagtggaggcattggtctcggcccccgcgatgttggggaaaggaagagagtggaggcattggtctcggcccctgcgatgttggggaatggaagagagtggaggcattggtctcggcccccgcgatgttggggaaaggaagagagtggaggcattggtctcggcccccgcgatgttggggaaaggaagagagtggaggcattggtctcggcccccgcgatgttggggaaaggaagagagtggaggcattggtctccgcccctgcgatgttggggaatggaagagaggcttttttgggaggaagttgagggttcagatcttgggtcttatctcggggctggacagaactccaggtaagtcacagaggagctgttgaagggcagattccatggaaagtgggcatggatgtggccaaacgggacgtccagcggtgggaatcatcatttctactctcataagctgggacacgagggccagaatccctgcagtagcaggacacgtgggccagtgggcaggggccacggggacccaggcagctgggggtggcctggggcgtggtggagccaggcaagggaagggggagggttgcaaagaagaggtgacccgctggaacctgccagctgggccccctctgcttcatcgctgcctgttaggcctcacgtcctgttgtgtgcagaatacgtttgtaaggagagaacatccccacagcccggccagagcagctcttctggcagagggggcagcttctcgaagtcacctgggaaggagcagaaggagctgcctggacttgagccgcagcagagcagtcggcgtggagagcctggaaacctgcctctgtgtgaacgggctattgggagagactgtgcttctgccttctcctggccagggatggccacggcttggtgtggtttcatggttttgaagctttggaagtacctgatgcatttgattcctctgtgtctctgtgtacctgccccagcctgaccctgtggtgggggcaggtggatgaactggacggggtctcttgagaggccagcaggcgccgagggtgctgcagcgatggcgggtctgtgctggctgcgcatataggccctggtttttgttctggtgtgtgtggccgttgaaggccgcagggagaacgggggcggcagcttagctttataaagggtgagcagcgatttgtgtgtatgctggtggcgtcccactgtctcctgctcccgtggcccacccttcctgtcctgggagcgcatcctgcagctttcccagtgtctgtcctgtggcatgctgggcgctgctgcccacatcgtccttgctgtgctgcgtgtgtggcctctgccagtcccacgcacctgctggcggcattgggcccagtggcaggagctgggtgctgttgccaggaggcctggggtcggccactctgtaacactgtgggccctcaccccaggagctggcctgtgcctcccagcagaggcgattttaacctgaccgtcgcctagccctgccctgtgtctcccccatgtgtctggaatggacgcggaggcgctcagcttcttcccggcagtggggatgcctgagtgcttcttcacttctgtcctttctcgtggagcctcccactgttgatttttacatgggaaatatcgagcccttgagagccgagtaaggaaccttgatccttctgagtggatgaggctgcatgtgtcatgggaccttgggcccaggtgctgtcaacggggcccctgccactgccgatggcgtttgttaaaccaggttggggagcagactagtaagtttgcttagcagccagtgcgtgataaagggcttcctggtgatgaggagatttcttccgcttcgtaacagattcccaggccaaatgtccttttggccgaggttttcagaagtgtcgattgcaagctgagggacaggcaatactcagatgctccggggagcttggtttttggagcccacattttcctgcctttgcttgagttgatgtggatcttgttactcttagccccgatttcctgcctgagggtgttcagcagcattgaggaaaacccagagatcctcacttcaggggacatcagcgcagcaacgctctgcctcgccatggagaggcctggccttgggggtgggggtgcggggctcggcctccctccttgagcctccttttctgagcagtttggagtccggggtccttgcatcttgtagtccagcagtctttgccttcacaccctcggtcctttgaaaagctatgacagtaccctgaggtgggcaggtgggaacccggggacagaggcgttgggggagaggagggtctcagggctgtgaagcatgtgccagaaactgatggccacggctgtcctgaggctggcagggcgcgcgtgtcctgcagctgtggaggatgacaggtgttgggggcccactcaggccaactccctcgttgacttcctctcccctttgaggtagggtcagggtgccccggcactgtgacgagcaggcctcatgcggccaggcctgggggacatggtgaggacagggctgagggcagacccaggtggcctactctcctgcgaccatctgtgtcatggcctttgcagggctctgattttcttctgatcaccctggtgtggatgttggctgggttgaggctggcggcctgtgctgtctggcgcactcttctgtccactgagaagggagcaggtgctatcaatggaaatgggaccctggctgtggggaaacgtgtgtcgggatggaggcgctgtgcagggcagggcagcaggtcggctgtgtgccaggcccccgtcatgctctgtccaagccaggatgggcccagcatgtggttttctgtgcacctggtttctttccagccgctccctccattcccagctgtcctggaggtgggtcctcaagggtcccccattctgtcctggccccgcctttgtgggcctttctggttctgtgaaggccccccccgccgccagcttgcggaggcctctgtcctctctggagggtggaacctgtgcaccggggccagccccctgctcaccttggcctggcggtcccctctgtcccctccatcccctctgtctcctctgtcccctctgtcccggtgctgtcctggggctctctagtgagggtggtctgttgtcctccccaggatgggcctgcaggacccctgacgtggatgcctcttggggtctcacctgcatggtatctgaggccttttgcagaaggagcctctgggtttgactgacggaagtgttcactgttctcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtggggctgggcctgtcccgcgtggagtgcaccactggccacggggcgtgggtgggacgctggcagctcctgcagagggtgggctgcacccggtgggtcctggcccacagcagtgccttgctcagcccaggctgggtgcctggctgccatgggttgcagagccctaagtggaggctgcgttgtcctatgcctggacggaagcacaggagcctgtgggggctgcttgtggctgtggggcgcgtggtggggctgagacgcatgtgcggctccctaaagctgaggctctgctgggcccccccaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtgggtgtttgcggcgctcgtctgtcctgccgcatgtgtgactgtggatttgtgctgccgtttgaccgggaaacgtgtgattggctagagtacatcccttgtgttcttaattctcgtttttatttaacgtatttgtttttaaattataaaagtgatacatttcattgtaaaatactgaaagtgcagtgggcaagaggccctgtgcagacagtaccctgggctgtggcagcatccgcccggcaccctccagcgtgctttagctgaaggagctggggtcgggaaggtccctgcagtacttgggtcttatgtctgtaccgtctgcgtgtctgtgtgtggctctcagataggatgggcttgtgggttatatggaataataaatatagagtcaactaatatcctgttttagtttgtaaatgattctttttcctccctaaaattaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacggtaagaactggcgccgtgtccggaggaggtggaagacgctctttctagcagactctgtcctgctctgtgttgccagctccctatcagcatggtccgggagccactagcatgcaaccgcatacatcatttacattttctagtagcctcactgaaaaatggaaaagaagcaggtggaatttactttaataatatgtcttattttactcagtgtatggaagagttgatttcaacatgggatcggtaaacgttactgaggatatataagcttttcaccttctttgccatctgatgtgtattttacgctcagcacctgtcacttcagactggctgcgttttgggtgcccaccaagaggactgtgtggctgtggctccctatggggtggccggtctcgacgatgcagacccagaaagcagcttagttgggggttttcatccagagtgggcctcggctaacttctgagggtggcgtgaagccggaggatctctggctttgcctccagccctttaacttcgtggtttgcgcatgttgtagaaagggctctgggagtgtgtccacggcccacctggactccagcctgggcttgtgcttcttggttgcccaggcacgtgttgcagccatgtgtagtcacctgcacccttctctagactggtcctcggaaaccggggctgtcccctgcaccctgcttgttagtcgcacctctgggattgtctgtcgaagggtgtgtcctgcccacatgggttgtcaaagcacatagagctccagcacctcagctccagctctgagccacaaactgagcagaaatcacggtgtgtttggcttatttgtctaaaggtcccatatccctgatttcttggcctaccctttctcttgatgaatcactgacccgtgctaggtcgcttcttctgggatgaggcctggccctcttcctctcttccacgttcccgccatcgcggggtccacgttcccgccatcgtggggtccgcttcccgccatcatgggattcaaccaagctgggccatcgttgcttcgccctctgttcccctcatggcagcagtgctgggctccctgcttcccgtggggtcccgcagcactcggcacctgtgaggattggaggatgggctgtactcttttaaagactggggatagggccaggttctgtggctcatgcctgtaatcccagcactttgggataccgaggcgggtggatcacttgaggtcgggagattgagaccggcctggccaacatgcagaaaccccgtttctactgcaaacacaaaaaattagccgggcatggtggcgcatgcctgtaatcccagctatttcggaggctgaggcaggagaatcgcttgaacctgggaggtggaggctgcagtgagcggagattgtgccattgcactgaagcctgggtgacagagtgagaccctatctccaaaaaaaaaaagaaaaaagagagaggccgaggcgggtggatcacgaagtcaggaggtcgagaccatcctggctaatgtggtgaaaccctgtctgtactaaaaatacaaaaacaaaattagccaggcatggtggcgggcacctgtagtcctagctactcgggaggctgaggcaggagaatggcgtgaatccgggaggcggtgctctcagtgagccgagattacgccactacactccagcctgggcgacagagcaagactgtctcaaaaaaaaaaaaaagaaaacacaatggaaatatatttttattctttgtctctgattttctgattttaagagtaacacgtttttcttggagaaatttagaaaataaacacaggctccaaacagtgctgctggctcttggtgaacccgggtggagctttaacccctctctgaagctgcgctctccaggctgatcagaccagctatccttttccgaaacattcccttggggacctgagaggagccagggctgagccgcctcagagtgagcccagggctccatgggctcatgcttgtcctggaaggtccttctctagcctctggtgaccgtgggaaagcttcccccgcctcccacagccatcacgctctggcttggatgccttgcctgccatcagctctcagacgcccacctggtgcccgctgctggctgctcaggacgtacgctggttgcctgcccttcaaagcaggaagatgcatcactcttggactccctgtcttcttagcagcccggagcctcctttgcccctagggccctgctcctgtgctcccccacatcatgctcccagcaccatgccacctccctcgaacagagcaggtgtggaggcctctgagtgtcagcgcctttcagatcatggtcatgcaagttgttaagtgaatttctacacccgggtttttttgctaaggagaaaatgaaggatgagaagtcctggtttctttctttctcagtatttgggagtgcacaggtgagccagtggccatggtgtgccttgagggtgcacctgctgctcttctcagcacggccgacacctcccattgcctggagcctgagccacagacctggaggccgtgggtctctgttttgaaagaaacagacgtttcgaggctttcttcttggggtttcaaaggatatgtttttttgtatgaacatttttgagtattatctatgacatttgttcagagtgatgttatggatacgagtcttgaaggactgatttgtttctctctactactttatttattcagccaaagagacagatgctttcagtaaaacacctgtttctagatgaagagagttcatgtgtttttgggcagtcttacttttttttttgtcttctctctccttcttgctctggttttatcttcagatagctctgaggagcagtttcttttcttggccatctcttacttatttaaggtaatttgtgctttataaattttggtgtttttgaaagcgaagtttctagggactttgtagtaaatacgtctgaaattcagaatgatctgtgaattttacaacccgtttactaaagccacacaatgatcagcatctgaagacttcagctaagacaccacttaggacgtgcaatggccctaacttaacacatttgccagtcgtcacctctgtttgcagagccagcgcaggtccagctgagttgtgctgggttggtggagcgtgcgcctctctctggggtctgtgtgctgtgccctcacccaggcagccaggctgtctgcacaggcagcctcagtgggtcctggtccaggagaggttgcgatcttacctggacgctgccccttctgtgctgacagtgtcatgggagtagaaattctccatcaggagcatcccagtgtgttcctgtagcagcagctactcgtgggttcagagtgcaggggaggggcctctggtgagcagggcctgggcctcgttgctaacagccactctcagggccttggccgaaggtgatttgaaagacgggaccggtgatgtgttcccagaaggtgcgtgggacctgatgactgacagcatgtgtcctttggttcagtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaaggtaagccacggtgagggctgccccgctttcttgccgtcacggctcaggctcaggcacaggcacaggcacagacccagacacgggcagcagcgttggtgtgcacggaggctcaggttagcgccagttccgtaaaattcacaaatcccggaacacttgattttcccactgggctgttgtttccttttaaggagacgttatcatttgtgctgtctgtgttttctcacataatcagttgataaaatttaaggcacagaataaaatttttctctttaacttgggcctgagaaactatttgaaaagaatggtttagatcttacactgtgttgaagagtaaaggtagcctgaatgatgagagtgagaaatgtttttgttgcattttgtaaattggcggggagccatttaattgtgcgctaggccatcaaatgcagcattttgaaagggctgttttagattattggcacttaaacactcctccctgatgttgtgaagggagggacggtacctgcagaggccttgtctgccccgagggtccccggccagctcctctgcagagttggtaggtagcagccgtgatcgttgccaaagaatgtctggggaaaggtccaggcagcaaagatgtttttatgactaagaaataaatgtaggagaagaaatccgcctatctagaaggagaactagcaaaacccagggcaaatgcaggcttggcatggtgaggagggagtttacgagcgatggtctgtgtacatctaggttggcagggtgaggaagtagagctggtgtgtcccatatttggtgaaagaggaattttaaaactaaatcggatttggagacgttgatagaaagtcattgccactgtgttttgccgtgtgtctctgcagttgaccttgacacgctccggttacacgaagcagacagtagggtcagaccctcttgccacaacattggcagctggttctcagccttcttgcccttcccctgcacatccaagtcagaacagcagacagttgaaataagacacagaattgttgtacaattttcttttaaaacaaagacgttcatctcttatggacgtctgtgctcggagtgacgcagtgtcttcatgatgccacacaggtcagcgggtccccatggtctcagggcccttttcatcccctgaacttcttgtggctcctgtctgcagagcttcgccccttttatcctgttttacatttgggcaacttgaatgagagccattaagcttttctttctcttagaaacttactcctgtgcacacagctgagaatttcttatgcatccttttgctcattttgtgcctgtttgttgttctgttctgggattcttctgtttagttcaccatagtatagtacccagactctagaatgtctcttttggggctggcgtcaattacgttaggtccatagaataaaggcttttctatttcaaggtgagcgcttggttttctcttctcccaaaggctgttattgttggcacgtgatccctcctctgctttgggggcctcgtgttttttctgaggaacgtttgcctacaggaccctctggcagccatacctgtccgggccctgggccgccccattgtgcccaggagtccaggctggtgcctggtcccgcagcctttgcttccgtgcagcccaccgaggcatcctctggctgtgtgggcctccctctaggtggactgcccttctgtccttgtcttctgtgccctgaggactgagctgtgaggaggttgccagcaggtccactcaccattctcaaaatagcttccagcgcttctcttcgcacacagttgtaccattttcactgtagagcagtaagttacctttttagctttttttttttatcagtggcttcctccattgccattgggtcacagggctgaggaccccgcacggttattgggtcacaggactgaggacctcgcatggttgaggacctcgcatggttggagctgcttggccctccgctgtggtgagcgtggctcctcataacacccaacgcttagcaggagcctttggagaccatttttgttgctttgtagctctggaatcattttatttttattttttttctggggccattgtaaggaaaacacaatgtgactgagacacaggtggcctcgaatcacctgttacacccaatgttcacaatgactcaattgatgaaaagggcgtttcctgtgagctgatgggaaggtgggtggagaagcaagtggcctgaaagtccactccgaggtgaggcgggtggggtcctgcccctcagagaagttgggggtctctggagaggtggggcgggcggggtcctgcccctcagagaagatgggggtctgtggagaggcgagtgccagactggaatggggaagtcattagggaagacagccacaagcaagcttgttggttggtatagaaatgtgacttacgatacttataataggatgaaaaccaagaatcagacatttaaaaacccagcatgaacgttctcatcagtaaagcctctccatcatttttcttaaatataaccacaatattttcacacctgaaaagagtaattcctcaatggcaaatacacagtctcacttaaactgtaatttaacagtctgtgtgttgtgtttatattttgcttccacttgaagcagcttgaacaaggctgtagccgttgagtgccaggcccctgagactttagtgtctgaaggaaggagatgcctcctgggctgcactgttggccccggtctgccccttgtacaggccctcccgcaggctctgccgtagccgcgactcagtctgccgagtgcagaggttcgggctgttgctgtgagctggccctgccagggctgacttccccggggctgcgtgtcagctgggtgggggccacgccacagctgggattccagcctgtctgatgagcctgtgggacggatctgcagctggcagagggcttgtctccaccctgtgctgaggttggtgtctgctgacatggtgaggcaggtcagtgcagtcaggaggagcagggtccgcaccgtgagctggtgaaaggggcttgcatttcgagtccttgggatttccagtcacagtgatgcccttgccagaggctccggggcgtcccctttagtccagggcagctgtggtcccttgaagtgcacgtgtggaagtccccctgccgtgcacgggcgctgagcacgtggagaactgtggccctcaggaaaggaaggatgcatgttcctcggggtagaaggtgcggagtacgcagctttgtcccttcaggattgcagaggacggaggcttgaggcagggttgttggagggacagtgtggttgctgctcgtgagctgaaatgtctgcctgtgttacgctgtgattttccaaagcgtcttgtggcttcgatacagaaacctttgattgacatagcaggtggccaggtgggcaaaatattgcggaattgttcttgcagacttaactaggttttagtttcttagagtagctggtttggattagataaccattttgccatttggaatatgtgacaagttccagggactggaattctaggatcctgactgatacattgacggggtctgagaggcttatgcccgagttgtatcgagcatgttctgagcttttcccatgtgcagttcagtgacagcctgagatggcccagagtcagtgagctttgagaggagtcttccttcttgtatgtcaacttccagtcacatttccactcgagggacgggttgggcttgcctgttgtgtcgtggagcctggaggctcaggtcctgtttttttctgattttatggatgaggaactgaggcactgaacggtccgggggcctctgtggtcccggctgggggaggggcctgtgtggtcccggctgggcaggtggctgagcacccagacgacagcgacctctgttcctgaccacggcctcctttgtgcctctggtcagtgctgcaggaacgcatcctttagcctgcgtgctggcggctggagcccggcctgcatgtggagctgccgcagagaggccaggggcgtgtggggtgcatgcatggctgagacagggccacaggggcccgctttgggatagaccaggggttagggaagtccctgcagcgtggagatggttatgagtcccacatggggcatcctagctgggccgagagctggaggtgtggaggaggggttgtggaccatggttggggagggcctgctgcaaggcagggacgtctgcacgtctcagggctcctgccagacaggagtggtggttctgagggttgcaccagaagcaggagatgggggtttacggtgcccgttagatagctgtggagaaggtgggctgtaggtggttgggggaaggggggtctcccggaggtgctgggaggagactccttcaggctccatctctgctggccgggtgctgttgcacccatagaggccaagactggggttgaccactggccttggccctgcagaggccattgggattgcagtgagcagttgaatgtcgtaatcagggcgagagctcggggcgggggggggaggctaggaggtggaagaggaggcaggaagtgaagtgaggccccaggccctgtgccccagacaccagctgcgtcaggacgctgcaggctcagtgctgaatcccctcctgctgctgtacaggcaccagggatgctcatgagcagcctttcagcagcccttctccgcattgcccagttccctccggccagtgttcccaggtgtttcacaaacaccttttccttaagcctgttggcgacattgaacaggagggagggagttttgtcacctcgcatgtgcccctgccttgggatccagcattcccacatgacagctgtgctccctgcggctgacacgggaggctttttgttgaggtgaggcttcccccttgtatttgaattggctgtgaggtgctctaaggcgccgagtgtcatttaaaatcagaggcacctcgcagccgaaagcactgctgcccggcgtcatggcccagccttgggagaactttcttcagcctcaaaacattgctctgagtcctgttaagttgtgtagttttgtattttcaaaacaactttttgaatgacaatagtaaccatacatacttcaaacggttttaggaaagtttgcaggtttaatgaaatgaaaactgtacccagtgataatatatactaaggattatttaaagtgttttatgtcactttaaataatcacaaaatccttggttttatgtcacacttcctgttgtcagtaccggtcctgcttggaaggaagcctcagtggctgggcttggcttgttgtggcgtcgcctcgccctgttagcctcgtgccagagcctgtccggccccctggactcgggacagtgcacagagccccacagaccagccccaggccgtcctcctgacctcgggctttttaccatttcacacttccggtttttataatgtcaaaaagactttaaaaagaggttaaagccgtctttttccaaagacttcttatttttaaaagtcagatttttttttcctgaaagctcccatcacaatatttgggaacgtggcacggacttctgtgctgtggggagcggggcttttttccctgcctttcttgaaaatcatccacagccactcaccactccctgttttttttgtttgtttgtttgtttttgcatttttgacttaagaccttgaccagagatcagatttaatgttgccttccttttatttgctaacttcgtggcccagtagagctctgtgggaatgcccgtttaaggcccctttagttatgtgagataccttttcttcctcaaggtaagtgaattattcattgcagaaactgtcatgaactcgagtgacgtgtttaatattggcgcatgtgaaataatctttcacagtttttttcagagagtaactgtgtgcctgggcactgcacccagggccgcagcctttggcgttagggaagcacacacagtgtggcccgagcccacggggcccacactgccgagcagacagtacatgcgatgccttgtttccttaactgaattagtattttggtggacttcacatttatagtaagttttataatagattttataatcttcagttttcaaaaatcactttatttataattttttcaggagataaatctccccctaaacttgaaccatcagatgcattacctcttccttcaaactcggagactaattcagaaccaccaaccctcaaaccagtagaactcaacccagagcagagtaaacttttcaaaagagtcacatttgataatgaatcacatagcgcttgcactcagagcgcactggtaagcggacgccctccagagcccacccgcgccagtagtggcgatgtgccggcggcggcggcctccgcggtggcggagccagcaagcgatgtaaacagacgcacttctgttctcttctgcaaatcgaaaagtgtaagccccccaaagtctgccaagaacactgaaacccagccaacttctcctcagctagggaccaaaacctttttgtctgtagtccttccgaggttggagactcttctgcagccaaggaaaaggtcgcggagcacatgcggagactccgaggtggaggaggagtccccaggaaagcgcctggacgcaggtaaatgccgcgggcggccctgagaggcgcccttgccgaccagtgcctggagcgtccttcaggatcattggtgtgacgggggggggggggtgtccagcttctgtttttgcagcattctcttaatttccagagaagacaacagtgcagtgttttctttgaaaagccttgagttgcgggtctgaggccggcgccttcgtggggggcctgtttgccacgagagattgtgcaaccttgctgggctgccctgggccaggggtcgatggtccttggtcctgtcttctgccacatacttcctctctgatttttttttaagagagtcttgctttgtcacccaggctggagtgagtggctcactgcagcctccaactcctgggctcaggtgatcctcctgcctcagcctcttgtgtagctgggactacaggtgcacaccaccactcccagctaatttgaaaatttttggtagagatgggggtctcgctgtgttgtcccggctggtcttgaactcctggcctctgactcccaaagtgttgggattagatgtgtgagccgctgcacctggccccttctgatctttaaaaaagtactgagaatgaattcaggtgtagttttaattggtcatcttgactttgctgtgcacatctggataagctggtgactggccgctcccagcacttgtgggagctcgactctgcaaccctcagtcaggtctccttgcagccccacagacctaggacctggggttgagcctggcccttccctggacctctgagaggacctgcccctgtggtaaatgcagtactttgcagttgatttcagcaacatttactcattgttttatgtggccctcttagccacatatgtgatgaggtattaggacctgctgaaatagcactggaaagcgcttctcatctcttgctgcgcttttgtaactgaactctgttgaattcctcggtgagggtgttgccgtgtgtgtgctgtgctgggagcactttgaggaggccgctgtgttcctgcagcctctgctccccgcccctcagaggaagctgaggagtttgtcctttaaagaggagcagctgtcatcggtttgcttcttcggtactggctgcgcttctggaggtgccggctcaggttgccagcgactcttttctggaagcgtgtctggagcatgtttgtcattttggtttttgtcccgagtcaaggcttggttcccgtctgtcctgtctgcctgttatacctagataaggagatgcgcattttctcctggctgtgctggtgtgccgtggtgcctcgtgcacttgagcagtgagagagggtggggctgggtgggtgttgcttatttcccagagtggcagcaagtgagtcctgtgtcatggagcctcaccaggccgggtgcagatggaaggctgtggtgggcaagacctgcccaggccactccctcacatcttgtccctgttccttctgctggtctctggcctgaagcgtccggggaggggagtgagaccaggcactgtcaaaggtctttgtgcagaaggaggctcacttcctacccttgccagcaagcaggtcatgcgtcttgttgccaaagtaatttctggtaaatttcattttgatttgtatgaaaattttgcacgtaactgaatgtgtagaaattttctacccatgtccttttactttgatggattgatgttaaattggcattttaaaataatttgaaaaagcttttttgctttctaagtaataggaagctattgaaatgtttcacaagataccaataagaatagatgtccttgactcaggactgggggatgtgtcttaaccacgttggtctttcttagccacctttggtgaaagactctgacctggttttccaagcaccccggaaattctgtgatgaatcgggtcagggtgctgtgcactgggtactagaggttgggtcagtgtaattgtgggcgtcccctctgcatgcagaacttggagttcggctgacgctccacttcctcggggtttcacgtctgtcggcggcagaggtatggggctgcgtgcgtggaggccctgccggccgtggggctggggtttgaggcggcctcccgtcgacactcagcaggatgctcacgtggtggtttccaccaggtggccccacctgaccgggccctgccccagctgtgggctcccactgtggacagttttgccggctggcggccacgtcctcagcaacctctcaggctcgttcatcagatgtcccttgtagaagagcacgtgtcccctccgggccactgtcttacattggagtggagtgttttgcgggcttcccgtggtgacggtggtgtagagcagtcttactgcagaccttcagtgagcgtggcccatggtggcttttgagaatcatggtgccctctgatcctgactgaagtggagatttctgctctctcatttccgagtgacagtggatttccgtggaggtgcggtgagttcctgagctctctcctgagcagccgggagcctcagcagcattaagaccaggccctcgggagtgggaggcattccactgctgtggccgaggcgcccggggaagggctgggcgtgctctgaatggtgccagtcccgccatccgccctcgctttggtttcaccggaaccttctggtgctctgcacatgggggatttcttgcccagagctgcagttcttcgcagtcttaggacaggaattatccggaaccttctgatgttttccatacatgcatctgtgtgctctgaactttagggagttatctggcattttccagcacacgcacaattctgagttaggctgaacagggtcgctggtcctgaggcgacgcactcactgtgggcctcctgcccgtgtcgcccgcgggccggctgtgctgtgcgccaggcttctgttcctgcgatggcccagccccagagtctggccctgactcgtggcttccttcctccgtgactgcacgctcaccagcagtgaaccgtcacctgaagcggccttccactcgccgccgttgcggagacccctgctgcgagtctctgtgtgcacgtgctggggcgtgtgagagcgtgggggtgtctttgtctactcgccgccgttgcggagacccctgccgcgagtctccctgtgcacgtgctggggcgtgagagcgcgggggtgtctttgtccactcaccgccgttgcggagacccctgctgcgagtctctgtgtgcatgtgctggggcttgagagtgtggggatgtctttgtccactcgctgccgttgcggagacccctgttgcgagtctccatgtgcacgtgctggggcgtgagagcgcgggggtgtcttcagtgtccttcggctgttcagggaggaggctgagctgtcctgccctttcattcagactaaatggctttttcactgttttccaggttctcactttaaccactaatgtgctgggtagttcactctttggaccctaatcattttctcttacctcaacttggactggagttctgctaagcggccgttttggaatgcacaaagatcactgcatcttgcctttcacttaattcttgcggatcacattggaatcatcagctcaaacatcctctagacaaaatcacaaacagcagccctggaggagctctcccccaccccagcccaccccctctgtaagtcagagcccggcagtgggaatggtgctggcgcccggtgcacgcctggagctggcgggatgtcgtggcacctcagccttccctctggacagtcacgaaggacgcagaggagagcccggcaccgactgggagcctgctgcagctgacgacacagtggacagcattctgaggctgtcctgagcatgtgcggagccgtcccatagtgactggtggtttgggtgtgacggccatgcccaggcgcgttgtgctgtgtctgtgccatggggtatggaggaacttggctcggcactgtctgaggatgtggcatggacagtgcgtgctcactcactcgctagcatcttctgtatttctgggttttctacctgatttccttctccccttacttccccttcctctgttttttccccacaatgcccagtggattcttgagcagtgctgctgtttgtctcttgctggtcaccacgctgagtgcccctgcggccaactgagaagtcctgctcgtggggtggggcatctgtgcgtgggatcttgtgcaggcgtctgtcctgggccttgggtctgtctctgaccatcccagctgcattgtcatggagctgggtcccagcaagagcaggtctcgtgcaggcgtctggcctgggccttggttctgtctctgaccatcccagctgcattgtcacggagcgagtcccagcacgatgggccttgggtctgtctctgaccgtcccagctgcattgtcatggagcaggtcccagcaagatgggctttgggtctgtctctgactgtccccagcggcattgtcacagagcaagtcttgtgcaggcatctggcctgggccttgggtctgtctctgaccatcccagctgcattgtcgcggagcgggtcccagcacgatgggccttgggtctgtctctgaccgtcccagctgcattgtcatggagcaggtcccagcaagatgggctttgggtctgtctctgactgtccccagcggcattgtcacagagcaagtcttgtgcaggcatctggcctgggccttgggtctgtctctgaccatcccagctgcattgtcgcggagtgggtcccagcaagagcaggtctcgtgcaggcgtctggcctgggccttggttctgtctctgaccatcccagctgcattgtcacggagcgagtcccagcacgatgggccttgggtctgtctctgaccgtcccagctgcattgtcatggagcaggtcccagcaagatgggccttgggtctgtctctgactgtccccagcggcattgtcacagagcaagtcttgtgcaggcatctggcctgggccttgggtctgtctctgaccatcccagctgcattgtcgcggagtgggtcccagcaagatgggccttgggtctgtttctgaccatccccggctgcattgtcacggagcaggtcccagcaagagcaggtctcgtgcaggcgtctggcctgggccttggttctgtctctgaccatcccagctgcattgtcacggagcgggtcccagcaacatgggccttgggtctgtctctgaccgtccccggctgcattgtcacggagcaggtcccagcaagagcaggtctcgtgcaggcgtctggcctgggccttgggtctgtctctgaccgtcccagctgcattgtcacggagcgggtcccagcaacataggccttgggtctgtctctgaccgtccccggctgcattgtcacggagcaagtcttgtgcaggcatctggcctgggccttgggtctgtctcggaccgtcccggctgcattgtcacggagcaggtcccagcaacatgggccttgggtcggtctctgaccgtccccggctgcattgtcacggagcaggtcccagcaagagcagggtgctgttggaatcttcttccgtgtgtgtttttgttgagaggttgaaaaatgcaccaaaactgctcttcttttaacgatggtaaaagtgaaactgaaaacaggagatagtgggctctcctttgtcactgcgtggggccctcagggctctggtcttcagggtgcaggctcagcccacctgcttcatacggccaagcttcccatgagccggagaagccgaggtggcagcttgggtgccagcggcaggggcgggcaggggcgggcttgtatcccgtgttgtggggttgcgttcccatggctccgtgccctcaggtgtctcggcagccactgatcagggcctggtgttcttacacctgtggcctggaggatttgtggtgtccacatgggttgggggctgggagcctgagaccagaggagactacggcccatcagtcagacctgcaggcctccgcctccccaggtgggccctggggcttctcttccctgtggggaggggcggtgtctcagccgctgtggccttcagtctctcagaagaccctttggggacctcccgggacagtttcaggtgtgctgtggacgtacctggtgacgggcaggcttccggggactgcgcttggctgggctgtgggacacctttgcgccatctcctttgggggcagagagggacatttctgtgttcagtctttggcctcctaggaggtcactgggaaggcccttgagggtgggtggaccctggccgctgtgggaattccgtgcagctcctgtgttgatggggcagcggctctttcctggcagccgccgcctcttttaacgtatttctcacagtcaccagctttactttcagcgttaaaaaaaaacctcgtgctgaaaaagttgctgaaagttgccccttgctatttacatgatttagaggcttgggctcggcctcagtgcctgctgtttgcaaatgcctcatggaccgggcacccatctctgcagaccttaggccctgggttccccacgttgggccccacctcaaggctggcctgggcttcagaatgttctgggctgaggtccttgcaggggtgctgaggtgcgggtcatggtggacatctcccagctggctggaagagcctcccagggcgggagttggcagggccgagattgagagatctcagaaccatagctgtcttagattattttctggtggtccaggtggaggctgggagggtccgggcagcgcaggccaccttgcagctcccccgaggttctggggactccaggcggtggctgcagagcctcccgggatgtgtctgtgtcctggtctggcttcttggcttcctgggtgaccccgcactgccgcagcccccagaccgcctgttagcaagccttgcagctgtcccacccccgccaggcctcctgctgggtggtgtctcggttgggctgggtttgtctgtgctgcccacgtcttcccgggtgctgtcacattttcatgggtgacacgcagaacctctgtgtgttcttgcgtcatacgcgcactcactgaatgcttaggaaaattaagaggggcattttatcattctcctctttctgagaattaaggacttgccttgtgttttaatccccttcctggccccactccatgcacacggagccggggccgtcgtggctgctgagtggtctgtgcatggcttggctgtgttggtgctggcacagctgcgggtgatctcgtgctagggccctcaggctggcacctctgggcagtcttgtgaaggccgcactggtcatcgtcttcccccaagtggccgttgctcggccaaccagtaactactaaaagcctccccacccaggccctgggctgcgtctgttcagcctggagcaggctcaccctgcacctggggtctggagtgtgctgggggccgggctgtggggtgtgggtcgccaggctcgtggctgctctctggagacgggtcacacgcgttggcagacccctctccgggcctgtgggctgaatgctggcaggggtgctgggctccgtccgtccactgctgatgcgagctgggtgggcttcccttgccttcacccactcaggttggagtagggatggagtcgctgctcctgaggggttctcgggggccaggacgggacttttaattccctcttgagacatcttcggggcctgagtgtgcagggtctgagcccactctgtgatgagtatggggagcatgtggagccccagggcagctcagcgtgtggctcaaggccttctcctgtaggtttttaaatttatttgttcccttgccagaaatgagtatgacacccccaactggccacagttcctgccttaaaatgaccgaggttaaaatgagaaacacagagcttcccttggaggtcacggtacattccagtccaggagagacggagccggtgtctgacttgagtctgtggagggcagcagtgcacccgcccaatctgtgcattcccttctgagcttgatttagcccctctgtttcagtcagtcatgctcattgagaacagacagcaagtgtatgaagcgggtggaggctgattcagcccctgtattgaaaagtcggtcgtgctcattgagaacagacgggaagcgtacgaagcgggtggaaaatcccgcagtccagccattcccttcaaaacatgcctcccagccactcaggaggctgaggcaggaggatcacttgagcccaggaggtcaaggttgcagtgagccatggagtccattgcactccatccttggtgacagagtgagacatcgtttccaaaaaaattctacagaaatgctctatttacaaatttacataatttcctttggaaatagatttaaaaattttttaaggatgaggtaggtaggcaggaaaacggggttctttttggataaaaaaattcacatggccgggtgtcatggctcatgcctgtaatcccagcactttgggaggccgaggcaggcggatcacgaggtcaggagattgagaccatcctggctaacacggtgaaactccgtctctactaaaaatacaaaaaattagccaggcatggtggcgggcgcctgtagtcccagctactcgggaggctgaggcaggagaatggcgtgaacccgggaggtggagcttgcagtgagccaagatcgtgccactgcactccagcctgggcgacagagtgagactccgcctcaaaaaagaaaaaaaaaatcacacacccctttagctctgacacccagagggcccccagcaggaacatcatccccccgttgtgactcccatgggggacctcatcggggggccttgggcagatgtgttgtttcccgttgactgacaaagtcaggatttttagggggaaaatactgagatttgccttattttttaaacattgagatgatggaattgtgagtggtgttttgtttagctgtgtacagtacttgcagcttcatggtgagtgaggccagacacactcagacacggcgatggccccggattttgtgttttaaagtgtttcgtcagcatttttgacttcatgttaacacttgtcttttgaaccaaggttttttctttttaaaacctgatttcctattccctggagctctgctcctgtgaacatgtttttgtgtctttggtggccccttcggcctggtgaagtttccgttcaaacgcggccggtgcccacgtggacaggccgcccccgtgtttgcactcacaggttgcacatctgcccccatggcaggctcacggcatcctttctttgccttcacagagcctgtctaaagacccgggcttgtcaagaggagcatcttcatggtgctcagcaaactactacgatcggagccgactgcagtttgttaagttgatttcatttaacgagtaactttggtgtctgcttactgtaaggactatgctcgggaacttgggagtgaaaaggaagatgctgtcttacctgtctgtgaaacgtgctttgtaagatgtgttccaagtgtaacgtcgttgagtcatgcttcagtgtgccctggttgtgctgagctcagggcctgcccgcctgtgttccaggtctcaccaacggctttgggggtgcgaggagcgagcaggagccgggcggcggcctggggaggaaggccacaccccgacgacgctgtgcctccgagtccagcatctcctccagcaacagcccgctctgcgactcgaggtgggcaccgcggccctgcgcttcccaccacgcagctcccagcaccgcccgccccgcctggctgtcctggaagccgggacattccagctcccatcttagtgttctctgaaaaattctggcctgggattcatgtgtgctctgcccttgtggacagtttcccatgctgcatattaatctgctttatagaattcaagcagaagtaggaaaaacactgcgtgaaataggaacacaattttagaatctgcaatgaagttttacacttgatctttacctcccagaatctggcaatgagcacagccctgcctgtctgccctgtgaaggccactttggcctcctgagtcccccctgccacaggttcactccctccagacctgcgcacccacaggcccgtctggccgcgggggtgtcaggcaggatgcgtggccagcttggtggcggacagctcacgggacgaagcccgagtgaggctgaaggcaggggcggggcgcctgactccctctgctcttcctcccgaagctttaatgcgcccaaatgtgggcggggcaaaccggctcttgtgcgacggcacacgctggaggaccgcagtgagctgatctcctgcatcgagaatgggaactacgccaaggcggccaggatcgcagccggtgagtcgcccggacctgcctccatggctctccacacctcctggttagcgtcttagggctcgactgctggggactggactccggctcagggagcatggtgccctgtgtggagccccaccctggccaacctcccggggaagggttcatcacacaccgaggggctctgggctgtggccctgccggggtgcctgcggaggtggcgcctcctccatcctgccttcgtttccctgtggaacgtccagctctgtgtggctgctggttgccaggcactgtcaaggctgtctggggttgtttaggttcagtggtcatttgcagctgcacaggggactgactgcagggtgggtgccctcaacttcaggcccctgggggagggggaggccccagggtttggggtcgcacagccctcactgtggaaggcagccatgctgtgagggggcatcaggacggagatcccccaggtgggagggacagcagggagctggtctggcggagggggagccaggactttggtttcccatttggggtgtcagttgtgtaaatgaggcaggagcatgctgggagccccgtccttgcggcaaggagggctcagaagggactgtgctgggcacctggagttggagccttgtagcctggagggcaggagcttccctgggtccgtgggaggctggtggccccaggtgggctgcagggacagtggggatgcaagggcctggaccccacaggggaggcagtggtgctgccggggtggctgagaaaggcctgggagctgggctgtgctcgggggacccaccctgttgctgcaccttttgtgggggggcggggcgtgccccgtgtcctgctgacgcctgtgtcctgctgacgcccctctccgcagaagtcggccagagcagcatgtggatctccactgatgccgccgcctcggtgctggagcctctgaaggtggtgtgggccaagtgcagcggctacccctcctacccggcactggtgagtacggctctcgtggcgcctgcgggtccagaggaggctcacacagctgcggggcgggggtggtccgaggaggctcacggcggtggtccaaggaggttccacagctggcgggggggcggggttggtcagaggaggttcacacagctggaaggggcaggggtggttcggcgaggggggcgtgggggtggtctgaggaggctcacacagctggggtggggaggcgggggggggtgccagtgacaggtggggttgtttatgggtgtgagcctcacaatgacctcagcgggtccttctcgtgcagatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggtgagttgagaggccttagactccggggaccggctggggtggttgggggccgtgggctcggtgacctgagtgtccctgtggtgagcagcgtctttgtctgctgggccctggcacagctaaagtcggaggtgagtgctccgctgtttgcctggtggagaagggcactgcccagccccctcgccgggactgtgggacgggcactgagcaccgggtctgtctctgcccgatggcttcctctccctctcgcctgagccccattggtctggactgtctcttccctactccttacccatgtgtccgctccagtgttgggggtccctctgctgtgctcccggacccctgtactgcaggacatggcccctgcccgggcctggcctctggccctgttcttagagccttctgtcccagcatcatccagctctgctcagacatccaccccatcacaggaggctccccctgtgccctgagctgcttttccccagagcgtctgggaccctcatgtgccagggtttagaccccaagatccctctgtgcaggacacgctggcagcacatgcctctgggaggagctgtggccccggctgtgccctgcgcacgtggcccgggcaggtgcttcctggttccccgtggagctggctgcacttgggacctggcgcaggggctcggggccacctgcctatggtgtgcctggagcaggactggcagcacaggcatccctaccgtctttctcttccttgcctcgacctctgcctctttggccacgtggccactgcttcttgtcaggccttgagcgaggcccacaccttgtccatccgagggcccctttgatggggtctccccaaccaccggcctctgctccagggcccaccctgactctgggcttggtgtgtgcatgtcttgtcactaagcaggcactgggaaacgttttggaggtggaggaggaggtgatggtttttatgccttacttagctccccgtatccccaagtcggggaggggaagggaggggtgcactcctggcctcgggcctgtccctgcacggggcccagctgtcttggtggtgctgagcagggcccctttctatcggagggcagtgaatttgttagatgattacatggagcctgctgaaataccatgtgcaagcaatgattttccgcttgtttttccttttaaaaaggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagatttggacggtgtggccattttattcctacagccctagacggctaggtgagccccaaggacgggtggggtgctggctgcagggggcggggacacgcctttatcttgaaaactgtcatgggatggcattatttgttatttcacctgatcatatttttattttaaaacttcagttacataaaagttttaaatgctttttttaagcctacaccgtttgtaacatctccatagaaacttggaaatcaagtcttccttagatagttgctgtcctgcatctggcaggtgcttcctatctgtcgtggctctccttcccacagccagccccgcccggcaggcccctccccaccacgagcagctggtggcccccaggatcactcaccgcccacgcagaaaggaagcccacgcagaaaggaagcgggtgcaggagccaggtggggacaggccgtggagcactcagggctaccaccgagaagcccagctaatggcgggtgcagtttgcaccccttctctgccacccacagcctgatcgtgctgtcgatgagaggaatctgctctaagggtctgagcggagggagatgccgaagctttgagctttttgtttctggcttaaccttggtggattttcaccctctgggcattacctcttgtccaggggaggggctgggggagtgcctggagctgtagggacagagggctgagtgggggggactgcttgggctgaccacataatattctgctgcgtattaatttttttttgagacagtctttctctgttgcccaggctggagtgtaatggcttgatagctcactgccacctccgcctcctgggttcaagtgattctcctgcttcagcttccggagtagctgggactgcaggtgcccgccaccatggctggctaatttttgtatttttattagcaatggggttttgctatgttgcccaggccggtcccgaactcctgccctcaagtgatacacctgcctcggcctcccaaagtgctgggattagaggcttgagccactgcgcctggccagctgcatattgttaattagacataaaatgcaaaataagatgatataaacacaaaggtgtgaaataagatggacacctgctgagcgcgcctgtcctgaagcatcgcccctctgcaaaagcaggggtcagcatgtgttctccggtccttgctcttacagaggagtgagctgcctatgcgtcttccagccacttcctgggctgctcagaggcctctcacgggtgttctgggttgctgccacttgcaggggtgctgaggcggggctcctcccgtgcggggcatgtccaggccgccctctctgaaggcttggcaggtacaggtgggagtgggggtctctgggctgctgtggggactgggcaggctcctggaagacctccctgtgtttgggctgaaagcgcagcccgaggggaggtccccagggaggccgctgtcgggggtgggggcttggaggagggaggggccgaggagccggcgacactccgtgacggcccaggaacgtccctaaacaaggcgccgcgttctcgatggggtggggtccgctttcttttctcaaaagctgcagttactccatgctcggaggactggcgtccgcgccctgttccaatgctgccccggggccctggccttggggaatcggggccttggactggaccctgggggcttcgcggagccgggcctggcggggcgagcggagcagaggctgggcagccccggggaagcgctcgccaaagccgggcgctgctcccagagcgcgaggtgcagaaccagaggctggtcccgcggcgctaacgagagaagaggaagcgcgctgtgtagagggcgcccaccccgtggggcgaacccccttcctcaactccatggacggggctcatgggttcccagcggctcagacgcggatcctggcctcgcccgccgtccaggtcgtgcgctctccagggttctgtctcccagggcgcgccctcgccgcggtcct

SEQ ID NO: 17147 - DNA, 20017 bp, Human
tcaatgtgtgctgtccagactgtgaaactcatcctctttccataatttccacacacaaaaagaaaacttactcacacaaggcctttcttgtggttagcccacaaaagatggagagataagtgatgtgaaacaaacaacttaaaattgaatttggacatcccagttctaaaaatcctttataggtttaccccacccaccccaagcaatgcccaccatccctctcttacatcctcctcctcttgctctcatcttccaacaaacttcaaattcttcttcactctgttaggcagagcaattacattctctcaagctctttctcccaaactcagctccaggacaacctttcaaaatccagagccctttgctaacctgcccaatggagttggacttttctagcttcaactaggttcatcattttagctgatctgcctgtggccagcttccccacattggatgccaacctagtaaaacagtcatccataaatcataaggaaagctaaaatgtatcaagcacctactatgtgctggttcgaggttaaatgcctcgcatgagtcatctcattcaatttccacaaaaaccctttaagataaggacaatttgctgggcacggtggctcatgcctgtaatcccaacactttgggaggctgaggcaggcagatcacctgaagtcaggagttcaagagcagtctggccaacatggcgaaaccccatctctactaaaaatataaaaattagccaggcattgtggctcatgcctgtaattccagctactcgagaggctgaggcaggggaatcatttgaacccgcgaggcgaggttgcagttagctgacatcgtgccactgcactccagagccttttaagactctgtcttaaaaaaaaaatatatatatatatatatatggactattagtatccccattttacagatgaggaaaatgagacttcatagagtttggggtgcctgtggtcatatctataattgtgaaaaagtcagattccaaagcattttaccaatattgcctaagtgagtgggagggaagggaaggctctctggagtcgggctatgctggacagcggggttcggaaactctggtgaataaagtggtagttgtttctatgaacatggagtgagaaggcccaatcctaaacacaccagtgcttaaggcagctgcagagaattaaaggcaatagaaaaaggggagctggatggcaggagcttggatggggaagacttcaagggcaggtgaagatgccaacagcttcctgcctggaggaccgaagaagggttgggcttcactgcagacctccaggagacagatttgcttgttgggacagagtagggaggtgaaagcgaggtgaggaagttcgggggtgggggaggtgcacacagctccactaaagagctggaagaggccgatggagtattcatgagacggctgatccaggaaggactgtggcatattaatatggaaaaggcctgtttgtttgtgcttggagaggaaggagccagaggagaggggagcaaggtgggcgggagctggggagagcctgcagcaagatctgcagagcccgaggtgctctcggcctgggccctggagaggacgtagggtaagtgatggggcacaggctgtgcgtcagggggaaggtgctggggcctgaaggtcccgaggggaacctcagacggccttatgccttctcacaaagaaactggaccatcatctccgacccgcaccccggtcgcccctcgaggacagagggtgggcgcaggaggctggaccgagcggggcggagctggatgcctggcgccggcctccctcccggcaaccccgccggtcctctcaggtgacagctcacgccggcccccgccccgccccccgcatattcaggagccccagcccaccctgcccgcgaacagccagcgctggaggagcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattgtaagtttcgcagcccctccgctgccagggtccagggtgcggggtctggagtccgggatggaggagctctgcctgtgtcccgcgcctactgacacccctagcccgagaggccacctgaggacagcgccgcgggcaggtcccctcggtgggtgcatacatggtgcccatcgcggcaccgtgaatggaggtggctgagccggagagtcaaacgggacccgtccccagacgcgcggcccggcccgggacaggcagcgtggggcaggagctggcgcccggtcctggcagcccggggagcccaggtggcggggcatacaatggtgctcattcacccgctgcgcagcctccgcccccgccgcctcccagggggcgccggctccaaccagacgccgctgtcgccccgaggcggcctctcggccctgcccgcctacccacgtctcccttccgagggccgccgggggctgcgggcgcgcgggtagggcagagactgggcccggtcgggtgctgggtgtggtttcgagctcgcctgcggggcgccagcctggcacttcgcggcctggggaggtcgtgggcaccgggacccctgcctgggtccgagctggcctcttaaaagggccgccttttaagatctctgatctgttcagagatgggcagcaggatggagactctccagctgtgagctcgcctcatcttgatatgacttgtgacctccctgaaacctcacacccacccaggggcattgaattgcaggcaaacgggatccagagagagggtctgctttctgggaggtgccggctcctcctgctcccctgcagcagtcagggcttagcagagggaggaccgggcagctgtgctgccgaaggggcgctccgagtgggaagatagtacccgcttcacctccctacacctcctttctctgcgcctcccccactttcccgtcgggttttcccgcaccatggggagaggaggaggcgctgtctctgcctgtcgttcacgtaagaacaacaacccgagccaccgctcactgagggccggcagcctgctaggcacaaccttacattccatctgtgatttatttgagctgtccacgtctccatctattccccaccgcgaccgcgcaagggcaaactggcacagtggaaggagtcgggcagatccagggcggactcctggcgccgccgcccactctcagtgaccatggacccttcacgttctgagccagtttcttcgactgcaaactggggcccgtaatagcgcccgcctcccggttctgagtattctgtaagataatgaatgcatgtaatggcacacagtgcctgctatacagaagattctcaatacgtgggagttcgcggaagagctgcgcccctaggaccccgctcccagggtcgcttgcagccccggggacgcccagcttcctgcactgtctgaggactgccccaccccgtgtgtgtttttcagagaggtccaccgggagagcggggccccccgggtcccccgggaccgccgggagtgcctggatccgacggcatcgacgtaagtctctaacctgagaccagggcgggagggaggcggcagacaaaggagaactttgtgagcgctgtggtgggggtggggacttcggggtgcccggagatgtagtgcccctcgtcgccaataggcggcgccggcccgcaccacaaggacgccgtttgttctgcaaaaacctcaaaccagccctgacatgcggagcccgttatagccgccgacagacaaggagctgctgttcagtccgccggccgcagctcacagcgaggcctcatccccctcctctcctttcccctccttgtggggtaggaggcgactcaacccctcaccctgcctctggcacatctggacgcttcttcaggttcgcttgggagccttggccagaccaccgaccagcttgggccagactcctgtctcttcccttcggttttctctccccgatttagaatcagctgggcttgttccctgcagggtgagggttaaatacctcattctgaaagctcccgcaggagggccgcttgatgtttaccagtctggacagacttctattcaacctggtgcccccaccccccaaacacaggatgctgggcccccggccaggccctggctgctgagggctctgaaatgcctggaggcctctctggggctgaatcgcactctaccggccctgcctgcccaccaccaagggtcctttggcactggaaggaggtccttccctccttgggaacactgaatttcccccttgcagtcccccttggtccttgccactggctcagcttcccgttctcctgccctgcagtctggaatagagctgctgcccaactcgctcatcccccttcacgtttctctaaaagccccaaccttcctcccacacgtgcccaaatccaagaggcatcagcttggagcccccagccctggtagtgggtctcacagctggcacctcatgacatcagcatgtctgtaccttcttgcatgttgctgtcaccctctccagcccggccagggttattctcatgctcctgtgatttgtttttggtttttatttttgaggaaaagggggctcttttcccaaagattgcaaggcttaggggacctggacagaagagaggagagtgaggagagcctttgggagcggcctgccagggcctgtgtgtgcccacttggggtagtgtgagccgtagtgtgctgtctcaccaacttgtatcttgcagggtgacaatgggccccctggaaaagctggccctccggtgagtgctttatcctctttggcctttgacccttcctgctcttgccctcctctggctcatgtttgttccatctctgttttcaagggacccaagggcgagcctggcaaagctgggccagatgggccagacgggaagcccgggattgatgtgagtagctgagtgtcgggtggggcagggtagggctctgccaattgacctccagggcctggctctggcatcttcactgatctgttcagagatgggcagcaggatggagattctccagctgtgagcccccctcaccttgatatgacttgtgaccttcctggaacctcactctcacccagggtcattgatttgcaggcaaccggggtccagagagagggtctgctttctgggaggtgcaggttcctcctgctacccctcagcagtcaggacttagtctcacatttctggcctccaaggatcaggctgaatatgttgggtggggctgtccttgtgtgccctgtcctttcctccgctcttcccctgacccctacccacagccccaggcatgactcaggagagaaacatcatttagctgataccacagagctcccagggggcccccaaggtcacaggctcttgaacacagccagccccaggggcatgaggacaacatctgatgggggttacactgggtcagtcactgaaagatgggagaaaggagaaacccccatgacttgcctctgccctgctggctcatgaggtgtgaccagggctgggacagtcaccaggaccccttcaaactcatccacaccctgcaacgattacaaggcatattgccttctatgttgcatcagttctcacatccacccagagaggcacccagatgagaaactaaggctcagaaaaagttgccaatggcctggcgtggtggcttatgcctgtaatcccagcactttgggaggccgaggtgggcagattacttgaggtcaggagctcaagaccagcctggccaacatggcgaaaccccatctctactaaaaatacaaaaattacccaagcgtggtggcgcatgcccctggtcctagctacttgggaggctggggcacaagaatcatttgaacccaggaagcgggggttgcagtgagctgagactgtgccactgcactccagcctgagcaacagagtgagactgtgtctcaattgaaaaaaaaaagaaagaaaaagaaaagagaaaggaaagaaaagaaaagaaaatgaaaaagttgtcaaggtaggacatcaagcaaatgaccaatcttgacccatggctaggtcttctagactcctgaacccggaggcatgaagcctgggtctggcataaagccaaatctttgggctttggtttctcatctttcaaaagaagggaattgttctgcctgcctcctagggttactatgggaactggggaaaaggaaagaaaggtgtggaggttcctaggccttcatgaggtgtggcaaaaaggagcctcggcccacccaggagggacccttgaacctgccctgctctgtgggtcagggagcaggttggccctcattgatcctacattttcattcttccccagggtttaactggagccaagggggagcctggccccatggggatccctggagtcaaggtaaggggcctgctggggcctcagcgtgggcaatctagggccagcgtttgggagtggctgtagagaggaagtaggagccggggaaaccccagcctctgagcctttctcgttgcttctgcagggccagcccgggcttcctggtcctcctggccttccggtgagtacaacctgcaagggcttcgagggactcttgggggagaggggacctgcagagggagccatgaagccaattttctttctttctgttccagggccctggttttgctggacctcctgtaagtcctcagggatggggcaggatccccagaactcccagggaaggaggggacaacagaaaggcttcgagggaatggccaccatgggaaggagccagcttgctgtgatagtgtcaggaataagtggacctgccagagacccagggccagcccactctgggcctgtccactggctctgcaattctctggtccttaaagcctcagtctgtcagtctctctggggttggcaaaaaaaaaaaaaaagtaaaagtggagaaacgggctttgggtgcctgtctctacctttgtgcccagggtatctgaccctctgaggcatcctgaccatcaactctctgctccccaggggcctcctggacctgttggcctccctggtgagattggaatccgaggccccaaggtgagcctcagccaccctctgttcactgcctcctgccttctatctccaagctggcaagctgggtggtctttctggaagttcctgggcctgctcctggccactgggaaactcctccaggtctggggcagaaacccctcctatgagcccacccggcactaggtcttttagggacgccgctggccccatcccctgtcaatcaggccttcatctcccaagatggtggatctcacaaagtgaccgggaagacagggtggagagggcagaggcaggacctggaggagggcactagggtaagctggtaagggctggtcaggggtatgatttgggcttcttttgcttccagggggaccctggaccagatggaccatcggggcccccaggaccccctgggaaacctgtaagtgtccccagacccccgacatggcaaagtgcaggggaaggagaagggtctttgagcaagcctgcggcgggaaagggtcaggccaagctccatcttcatgtctcctctcagggtcgcccgggaaccatccagggtctggaaggcagtgcggatttcctggtgagagacgaggtctggggcggggctaacacaggggggcggggccacagagatggggaggcggggccacggagatgggggtgtctggagagatggggaggggctgcagtgcaggggttccaccaggtgaggcggaggagagcacggggcttggagagatgggggcgcactgcccagctgatcacaggaccctgtgggattttctgtttccagtgtccaaccaactgtccacccggaatgaaaggtcccccagggctgcagggagtgaaggtgagagctcctggcctgaatcttgggagggtggtgcaggtgacaggaggggacctcgtattgagctctctccttcccttcaggggcatgcgggcaaacgcgggattctgggtgatcctggccaccaggggaagccggtgagtgcaagggctgagggctgtgggtcagggatacgtggagatggtcctacagggctctgtccccttcttcgtcccttccccttcccctgtgggttctggggacagagccttgagccgggggctggaggcctgtgctccaggtcggcatgtctctggtcatgtctccttgcttggcttttctctatctgtaacacaggactgtagggttcgtagtagtccctcccgtctgcttgtgctggggaaaagaggtggtatctttgcttgtctgtatatgtgtctttccatctgcctgcctgtctgacagctcatccctgccctttagggtcccaagggagatgtgggtgcctctggagagcaaggcatccctggaccaccggtaaggaacaccttgcctcagtggccctcttctccctcaccccaggagcccttcatggagtcattcccctgctcaggcctctagcttgtaaaagagacacctgtgtctagctgggagcatctctggatggggagatggaggctgaaattgtcaggaatgagggacaggaaccaaagctgtcagcaagaagcccaggctgaggtccaggtctgccactgtccctttgagtaatgcagtgagtccctcctcatctctgaacctccatgtcccatccatgagacagagactctgctgcctacctcaaaagggcactgtaagattgaaggtgggcatcagacaaggtatcatgaagtgggccttgcaattgccattgctgtcatttttctttctcaacagggtccccagggcatcaggggctacccaggcatggcagggcccaagggagagacggtaagtgaatcttggggtgttctacaagagcttccaggagctgccttctggcccctggagttcagccaggactgacctgcaaccctttcctctccccagggccctcatggatataaaggcatggtgggcgctatcggtgccactgggccaccggtaagcctctttttgctcccctacccctgaggctggagctcctacagctacagccacagagtgggcatggctccccctgagcctgtgtgacctggattcctgcttgtctttcttgccagggtgaggaaggtcctaggggaccgccaggccgagctggggagaagggtgacgaggtgagtcctcaggcacccattgttcagtcaggacccctggggagtactgggcaggacaaggcaccccctaaggctgtgtgtgtgagagtgcatgagtgtgtgcgtgagtgtgaatgtgtagtgtgtgtgagtgtgtagtgtgtgtgtgtgtagactgtgtgtatatgagtgtatgtgtacagtgtgtatgtgtgaggctgtctgtgagtgtgtgtagtatgtgtatgtgagtgtgtgaggatatctctgagtgtgtgtgtgtgactgtgagtgtatgtatgtgtgtgtgagtgagtgtgtgtgtgtctgcccaagtgggtgacctgctggggaggaccatctgtgccaagagcccagtcagcccaaattcagactttaggcgaagccctgggatccagtcccatggtcactggggccagacaatgagattccagcaaatcagccatggggctaatgggatttggtctcgatcccagttctcttaactctttttttttttttttcccaattaatagacctgttgggggaagcggttttaagtttacagaaaaatggagcagaaaacacagttaactgttattattatttagttttttaaattattttcttttctttttaaaaattaaaaaattcttatacttttatttttctattagacagcagagatcatctagttgttttgttttgttttgtttttgagatggagttttattcttgttgcccaggctggagtgcatggtgcgatctcggctcactgcaacctccgcctccctggttcaagagattctcttgcctcagccacccaagtggctgggattacaggcatgcgccaccatgctcagctaattttgtatttttagtagagacagggtttcaccatgttaggctggtctcgaactcctgacctcaggtgatccacctgcctcggcctcccaaagtgctgggattacaggtgtgagccaacacgcccagcaatatctagttttttaatgcaattttttaactatacagaaaaccagtgagagtgatataaagaatccccatgtacctatcacaggttccaattcagttattaacattttgtcagtcttgtgtcctctatcccccagacccctccttcctttgattttgttattgctttgctctgatgttttcaagtaaatccttaacatcctatcatctcagccctagatacttttgtacatatctctaaacaataagcactcattctcacataatcacattatcacaactgacaaaataaacaagtactccctaacatcatctaatggccagtctctgttcagtttttcccaattatctcaaaaatgtcttttcctggttcttgttcaaatcaagactcacacagcatccacacactgcattcggttgttgtgttcctttggctgagtggagtgtggggccttggccaaggtctcagtggattctggctcccacccctgctctggctcagcccagcctggcctcctggcactgacttctcctccctcctgctggtgccagggcaggaagggtactcccaaggctctctcctccggcccctgcatggtgtggcctgtgccagaggaactctgggacctagaggccactgttctcagtggttcccctctctgcacagccagacaggggcccaacatcctgagggtgacctgatctctctccgctttgcagggcagcccaggtattcgtggaccccaggggatcacaggcccgaaaggagcaacggtaggtgccagaggcctaggcccaccaggacagaggccagggcccagctgctttgtccaaacccccagaagagaagcctgggatgctagtctgaactctgcaactggtgggctggctccataacctcaggaaatgcctccctttctgtgcctcagtttcttcacctgtaaacaggggtgatgacatacgggaggtcatggggagcttgcagcagtcggggacaccaccctccacactagggaaggactgtgttccgtgaccctcatccccttcccacttcaactcccctcccccagttggccagtggggcttcctgggatgaccagagccactccctccctgcacactgcagctgtctcagaggaacaggggtgggtggccagaccccagacatctccgcattatcactctcccttgaactttcctcctgggtagggccccccaggcatcaacggcaaggatgggaccccaggcacgcctggcatgaaggtaggagtggggctgctgatgggactggggcaggggcaggaccttgagtcctggattctagacaccaagagcctggggtcctcaggtcatggacatgccctttcttgcctctggatctcagtttccctacctgcatctgggtagaagccatggccctctggctggagctttaatttgtatctttggttatctgtctatcccagggcagtgcaggacaggcgggacagcccggaagtccaggccaccagggcctagcggtaagtgtcaggtggagccacaggggctggccaggggctagtggctgatgaggttagaatccacacacacccggggctcttgctcaatcaccacctcttgccttgttaccaactctgtggcccctggcctggcgaaggcttcattacttggacaattactctagccttctctttggccattccagtcctccatgttggctaaatgggatctgaccatttctgcactatagcaccttccatggctccccaccgcctccaggaaaaagtcattcagtccagtccttcaataagtagttattgaggtcgggtgcagtggctcatgcctataatcccagcacttcaggaggctcagctgagtggatcacttgaggtcaggagttcaaaaccagcctggccaatgtggtgacaccccgtctctactaaaaatacaaaaattagctgggcgtggcggctcatgcctgtaatctcagctactcaggaggctgaggcaggagaattgcttgagcccaggaggcggaggttgcactgagccaagattacaccactgcactccagcctgggtaacagagcaagactccatctcaaaaaaaaaaaaaaaaaatagttattgagtatctgaggtatactaagtggcaggtaaacaattataaataggacagatgcaatctttgtcttcatggctcatcttaccattcaatgaccaccataatctgaccccaacctgcccctcctgccatatcagcaatggcccctctctgtcctttcccttctcaacaggccttggcttttctgcctccacacctttaggcctttgctggtccctctgtttgaaatgccctttctggtctctttgtgccttcttatcgttcagggccatctccattccatacctcctggagtccagtccatgggagcctgccctccctccctgtgggggtactgagtggccaaacctgtttctgtgcacacatgcagacttgtgttcctgcgtgcactcacatgggctcaggcacctgagagcacatatccatctcttccacgtagaccccaggtcctggaagacaggccattctctgtgccccactcctctgccaccactgtgggaatgtacagttaagttcatcatgccgtggctggaccttctgttgttcagctcccacaggtgggggaaatctggattggggatgggaagcaaagcagcaggtgcatggggctccctcatgccagggcagaaactgacttcaacttctttctgcagggtgtgccaggccagcctgggacaaaaggaggccctggagaccaggtgaggcgatcccaagctggggacagaattgagcaaggaagtctggggccaggaagacagcaaggcccaggcctcagccaagtctcagaggctcagccagaacataagccccttgggcctaaccacctccctcctgccacctcccacccatcatgcactcctcagcctgcctcagtgcagataggatggcatggcttaaaatccagaggagaaacaaacaggaaaatcaggagccaagaggattgaaccaagaataccctctcccccgtcccagctcatctggttccaggctctgtttaggcttcgttgggtttccctgaggccaagggcctgactgggccacccagactgacctgagaactgttttcctgcagggtgagccgggcccgcagggccttcctggattctctggtccccctgggaaagaggtaaatgccccctgcactgacacaagggttcctgctttagggtgaggccatggggtggagccctaacctagggagagctccgagttagtctggctctgccctgacccaatgattcagggaagctctttctcctccctgggcctgtttccctatgtacattgcagggagggtggggactggctctgttctggagtgtgactttcctagatggccaagttgatgggctgggaatccaacaggcagagttgttcgttcatttattcattgcataaacattcactaaacacttgcaactatgagtctcctcttcatatggagggtatagtttaatggaagaaatagacatgaaataaatgatcacgccgggcgcggtggctcacgcctgtaatcccagcattttgggaggctgaggcgggtggatcacgaggtcaggagatccagaccgcggtgaaaccccgtctctactaaaaatacaaaaaattagcctggggcggtggcaggcacctgtagtcccagctactctggaggctgaggcaggagaatggcatgaacccgggaggcggagcttgcagtgagcggagatcgcgccactgcattccagcctgggtgacagagcaagactccctctcaaaaaaaaaaaaaaaaaaaaaaaagaaagaaagaaatgatcacatgataagtaattcaaattgtgttgggtcctttgaaagaaaactacagggacccaaaaccatggaacaggtggtctgggaaaccttccctgatgaagcaaattagctgagacccagggtagggaggggctggccaggtgtggaagggtgggttccaccaggtcaaacgcttagccccaatttctccttcctccagggagagccagggcctcgaggagaaattggtccccagggcatcatgggacagaaggtaagtgcctggcacaatggcccctccccgggggcctctgcggcagctggcactgctggatacagcatctgctccgtgcagcccgtgagatgcctccccaggcagggcctaggtttgctttgctggtctgccaagtggagaaaggaccccctgccagtgacagcaggaatggagggcaccctgaccatgcggtgccaggcctcggtgcgggaggctacccctgctgagagctgctgaggttgtgaccttctctttccatttcagggtgaccaaggcgagaggggtccagtggggcaaccaggccctcagggaaggcaggtgagtgcaggccagctaaggtgggcagggcgtcatatccaggcccctcattccatttattcctttggtttcttttctcctcagggccctaagggggagcagggcccccccggaattccagggccccaaggcttgccaggcgtcaaaggagacaaggtgccagatggggctgggaaacacctgggaaaggggccctataacagggggagtggggtcggcaggactcagatccttccggagcctccaaacctgcggatctcagggttctggtctggtcggcgaggcggagttggaaagaggggtgtggccgaaagttaggtgggggaccccgtggaggggggagctcgccaaacccctcactgcccgctttctccagggctccccagggaagaccgggccccgcggcaaagtggtgagttccagcacccctgttcccagcgacccccaaccctgctctgcgtccccgccgccaccgcgcgtctgacccgtggttctctctgcagggtgacccaggggtggccggcctccccggagagaaaggcgagaaggtgagcgcgcggcctagggaagggcggggagcggcggctggccccggggtccccgcggcttcgtgaccgctgctccttgtgcctgcagggcgagtccggcgagccggggcccaagggacaggtgagtcctcccctcccggcgttctccgactttcctgggcggccactcccttcctcgacccccaccccccactctcgcccacccgggcgccttctcacccggctctgctcccacccccatccccccgcagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggaggtgagtcgggccccggggtaggaggtgcttcttctaggtagatctgttctggggtgcggcttacccgccaaaggctagggattcccagagactcaccgacttccccgagactggttccaagccccagagcagacaggaaggctgtgagtgcagcctgagggattaccccgcgaccttcccaagtaagcccttggccctgcccaggtacaatctgttcctcagcttgggaattaatgactcaacaccagagtctcctccatggcggcctcacgctcagccaggtgggataggagcggtgggcccttgtagccaggggcttcttcctgaaaggcctctgctttcagggccgggatgccactgaccagcacatcgtggatgtggcgctgaagatgctgcaaggtgaggggcagcaacccctcctcacagtcagttcgagggcatcgccgccccctcaccccctcccggagcctccacgtgttcacttgtctgaaaatctggagtcctgggggctccttccagtccagtctctgaagggttttgggaccttgaataagtcactctgggcctttgacttccgcaaaacagagcccacggaaggtggtgcttttctgtctgcaaacctaggggccagggcccatcggaatgctctgcctcccctagtgttactgctgacacccatctcatagacttccctctccctccctccctccctccctccagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggtgagtgctcctctgcggtgggcatgggggccaggcagtgaggatttgtccaggccggccctttccccattcccttctcaggatgacatacagacccttccccggttcctcagccacatggtccaggagacactcctgggctctttcctagtagcaaacggatggcaatgaatgtactatgttatcactcggggtttctggggtttgtttttgaatgtgcttagtggtaccccataagcatctttccatgtcaatagagatggggcggcagaccagcagagcagtaaagcaggcaggctggagccacacacgggtgtgaatccagactcccctttctcatcgtggctctcagacgagttacctgctaatttccctgggccttaggtttactatctgtaaaatggggacactgaaagtaccaacctcatcatgtggcagtgaggactatccttagagtagtttacatagagtttgtcttagttcactgagacacagtaaatgctagatattgttatgcttgctttcctgtaataaactttattggttacataatcttccatcctttgtctgcaccttcctttatttaacaagccctgcgtgaccatttccaactttcctctattacaaactagcacaaaacaggaataatttctttgcgtgaaacatagcaaaaaatagaggaaaagcattttccaattctgaaaaatgaagatttccttttttgtctacaggaaaacgtggagagaagggtgatccaggagaagtgggacgggggcaccccgggatgcctgggcccccagggatcccaggtaagccattggccctgcccagctgcagtgtgttcctcagcttgggaattaatgacgtgtggacactgcggtctcctccatggcggcctcacgctcagccagctcagtccttgatacccagcttctgcacccctttggagcaccccggagtctctgggtggttccagctctggaagctgggcctctcaggacttcccaggatccaccaccatcacttcacagaggtgatggaagggatgtttgctcccaaagctcactgattgggagctgggggtaggggacaatcacagaatctctgcctctggggcagagtcctttctcctatggtgttttggcctcattttctccatctgaaaagtttccccaccttcaaaattctgggcctgagacaagaggtgcccctaatgtcttgactttctcctgttcacaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccaggatattggagttactctatcctggagttaactaggatagaggagttgttgggcttctcttcttgtggatggggcagttgttgctgggcctccattgcccaggcaggaaggacagaggctctggagggggagggaaggatggggcgttttctctgggcacctgaattctgagcattaggatagcatggcagttttgaggaacatctgtgggaggaacctaggaatggaagcaggatgctgacctgctgtgtaactttgggtgaatcccttttgagcctttgtacaactgtggcaaggactcacctgtatcttgttcatgccagtatagcacacccagtgtctcgccggggtctgccacttggaaggtcctctgtgagtttcagcacccacggtgtgctggccctggggtaggagctggtagtgaaagattggaagaccttgttcttgccttccaggggtttccaggttcatgagaaaaacagatatggacttggatgaaaaaagtccgggagagactagctcagatctgatctgtaccacctgggggttcccagcccatagctctgtaggccttcaaggaggaagaggaggggaagggggggaaggggctgaggctcggggactccagcctgaagtccaagcatgtgcggaagcctagaccctcccaccttaccacaaacttggctccaagtcccctctatgctgacgcatccttgccctcctcctcctccccactgccctccactagcccatcctccctcctccctcctcccctcaacacacatttatcactagtgacatctcagccccccctaccccaatccagggacacaggagggacacagtggggttagactgagggccactgatgtggcttcaccctcagtgcttgggcaattcccaagttacagcatctcagtccccagagaaggccatgctgccactgtagccgccaagggccccctggagtgcagggcacagaggaggaagggagaggatgtgagctgcaggaggcagctgaagccaagccttgggcaggctctcaggtattacatacctggtggggaggagggttctcccttccctaggctggatccctcacttgctcctagtgcctggaaccttaggtttagagagccactctactccttgaagtctcttgatgcaccttacctggggccctttccttatccctctctgcagcattcccagagatggtccactggagggtttcagcaccacagagaggctgatgattcacaaatctcatgcagttacacctcattccttctgacagcaatttgaaggggctgaaagggggctaatccctaaggaccagtggttg

SEQ ID NO: 17148 - DNA, 12715 bp, Human
ggggagtgttaaattccaaacagctgctttacttaagatgcgattacgcttcagagataccaatgggcattgctgtgttcagcagaaagaaatgtaaatgaaggctgacttgattgtggcatttagagggaactcctggtacctggaaatgtgaatctggactcttacctgtgtcatcaaagtagtgatggattcaatactcctcaaccactctcctaatgatcagaacaaaagcaaacaagaaatctctctataaaatgaataaaatgtttaagaaaaaaaaagagttcgagaccagcctggacaacatggtgaaatcccatccctacaaaggttaactgggcttggtggcacgtgcctgtaatcccagctactcaggagactgagacaggagaatggcttgaacctgggtggctgaggttcccgtgagctgagattaaaaaaaaaaatcatacttccctagtatctaaagttgatatctgattccaggcctctttcaactttttttgtttgtttgtttgtttttttgatatggagtctcgctctgtcatccaggctggaatgcaaatggcacgatcttggctcactgcaacttccacctccagcgttcaagcgattctcctgcctcagcttcccaagtagctgggactacaggcgtgtgccaccaagcctggctaactttttttcttttttttttttttgagagggagtcttgctctgtcccccaggctggagtgcagtggtgtgatcttggctcactgcaacctccgcctctccggttcacgccattctcctgccttagcctcccgagtagctgggagtacaggcgctcgccaacacgcccggctaattttttgtatttttagtagagatggagtttcaccgtgttagccaggagggtcttgatctcctgacctcgtatccgcccgtcttggcctcccaaagtgctgggattacaggcgtgagccaccgcgcccagcacctggctaacttttgtatttttagtacagacggggtttcactgtatgttggccaggctggtctcaaacccctgacttgaggtgatctgcaagcctcagcctcccagagtgctgggattacaggcgtaagccaccgctcctggcctaaggttggctatttttatggttatttcttgattatatgataaacaaggggtgggttagtaatgaatttttcagaaaaggggtggggatcccccccaactgaaggttcctccactgtttagaccatatagggtaacttctggacgttgccatggcatttgtaaactgcctggcgctgctaggagtgtctttagcatactaatgcattataattagcgtataatgagcagtgaggacgatcagaggtcaccttcctgtcttggttttggcaggttttgaccagtttctttgctgcattctgttttatcagcggggtcttgtgaccttttatcttgtgctgacctcctgtctcatcctgtgacgaaggcctaacctcctgggaattcagcccagcaggtctctgcctcattttacccagcccctgttcaagatggagtcgctctggttggaaacttctgacaaaatgacagctcctgttatgttgctgctgctgccgccaatggacagcctttaacgtgcccgccagccctgctccaccgccggcctgggctcacatggccccatccctcctcgaacctcctagcctgttagttactcaaatctgcaagctctctgccttctcagggccttcaataaatgcatttcttctgtctggaaggctcttcctttccctcttctagccaattcctattcatccctgagtttcagattaaaagtcacttcctttggaaaccttacttcgctacttcgctacttactgcactacttcgcagcatcacaactatgatggaaatccttacttacgttaaatatctggtttctaggtcacctccctgacggggacggtagggaccgtcttctcgttcatcagtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgccccgaagcttccccgcgtccgcccgaggcgcttaccccctcccggagccgctgccacccaaatcgggaggctgagcggggagcgctggccggaaggcccagctgcgccgcctccagcagctgtgtggccttgagccagccactctgcctttcagagcctcggctggcccacctgaaaaacggaaagaagacgcctaccgtgcagtgttattgtgaggatttgcacgatgatgggcatagaatttgtggtgcacaattggtgatgagtgaattttcttgccttcctcccccaccttctctttgaacctgcggactgaggaaggacgcctccatcccccaccctacaggcctgtgttccagcgcctgccacactatggagtgatgtgttcacacagctgtcctcccctgcccatctgttagactgtgggggcagggattccccgttccaggaaaacaccgtgcagaggaggggctctggcagtgtggcatgaaagtggaatatgccacccaaatacccgccaggctagagggccctgggagagtgcaggggacgagtgcctcagaagcccagccccggtacctggtctcagctccacctggggtgggtcccagtgtgcagcagaagggccgagtttggagcccctcccctctcctctaggtgggggatgggggatttgttccagggccgtggaccctccagggtgggatgcgcccctgctcatgacactgcccgcaggtaccgctattaccagaatgtgtgcacgcaaagctactccttcgtgtggtgggactgggcccgctgggagcgagagatagactggatggcgctgaatggcatcaacctggcactggcctggagcggccaggaggccatctggcagcgggtgcgtgcccactgtcccttccccaccctcctctatggcgggagccaccgtaggtgttttcacccgccccccagcatgggcgcagtgtctctctctagaagtgctttcagcgtgcacagtggcttgggcctcctaaaaactgaggcttccggccgggcgcggtggctcacgcctgtcatcccagcacttcgggaggcctaggcgggcggatcaggagttcaggagatcgagaccatcctggccaacattgtgaaaccccgtctctactaaaatacaaagaaatagcaacctgggcaacagagcgagactctgtctaaaaaaaaaaaaaaaaaaaactgaggcttccagtttgaggagtggggctccttcccccatctcccctatgcagccaatcacctggtcccttggatccaactcatgggcagctctagatctgcctccctggaagcttctgtgctgcaatggctgctccaggctctgcttaagctcttcacacagttgccctgcccttccatctggcactcttgctccatgaagccttctaaggccttcctgttgggggaaagcccctttgtgccccatctcctcacccatgcgacaaaggcaacacagtgaactcacctactcacaggtctctttcctctgggctgtgggctccttgatggcagcgttcggattttgtctcagtagccctagcacccagcacaaagaagcaatgagtgaatggttgttgaatgaatgaatgaatgaatgaagatgaatatatttctatgtgtgggcccttcttcctcaggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcaggtaaaaggatggaaaagggaaggggcagaatcggtgatagatggtcatgggcccaggaagggtggtattaggccggccccagggctcttaactgaggcggggggctgcgtgtatcctgggagatgagggccttctcataggacagcagtggccatgctcaccacccttccttctgttcctccagcaccgggtcctggaccagatgcgctccttcggcatgaccccagtgctgcctgcattcgcggggcatgttcccgaggctgtcaccaggtgaggttccgctcaccccctccacttagctcagagagggaattttattcccttctagaacatgacttaaaaacttaagctctgggccgggcgcagtggctcacgcctgtaatcccagcactttgggaggccgagttgggcggatcacctgaggtcaggagttcgagaccagcctggccaacatggtgaaaccctgtctctactaaaaatataaaaattagctgggcatggtggcacgcgcctgtaatcccatctacttaggaggctgagacaggagaattgcttaaacctgggaggcagacgttgcagtgagtcaagatcacgccattgcactccagcctgggtgacgagcgaaactctgtctcaaacaaacaaacaagctctggacgtaggcctgggtttgatttctgactctgctactaattagctgtgtgacttcgggcagatgacatgactgctctgtgcctcagtttccttacttgtaaaatgggatctctacccacttcgctgtagggtttgtaattatctctcgatctatctgtgactttgcacagagtgctagcaaatggcagcccttgggagtggcagcaggggtgctccagtgtcccttgtccctcctgttcctctgtgcttcccagccatcctctcacatgtggttgggaaaagtcttcaaggctcacctgagacctcccctccttcaggaagccttgctagtgccccgcatgacctcctttgcacctgctaatgtctggctcccatactctcgtaggacttaatgcatgccagtggcctccctgcccgcctctttgcccccatcaccaggtggcaggaaactcactcattcattcaataaacttggtccagctgtctgaggctgccagaactggctgtgctgggtcctgggaggcggcaagaaaggtgcccaagggcttacccctgataggagagatatgttggctgaaggatacaatgtggggacaaggacaggaatatatgtgggttccgctctcctctgccgggagagaggggcaggaagggctcagggcagagcccagccttgaaaaatgagtgttgcttggacggacgcttggctaatgcttgtaatcctagcgttttgggaggctgaggcgtatggatcacctgcggtcaggagttaaagaccagcctggccaacatggcgaaaccccatctctactaaaagtacaaaaattagccaggcgtggtggcgggctcctgtaatcccagctactcggtaggctgaggcatgagaatctcttgaagccaggggccagagactgcagtgagccgagatcacaccacttcactccagcctgggtgacagagtgagactccgtctcaaaaaaaaaaaaaaaaaaaggaaagaaaattaaacacctcatgttctcactcatagtgggagttgaacaatgagaacaacatggacacaggaaggggaacatcacacaccggggcctttcgcggtgtgggggtcaaggggaggagtagcattgggacagatacttaatgcatgcggggctgaaaacctagatgatgggttgatgggtgcagcaaaccaccatggcacatgtatacctatgcaacaaacctgcatgttctgcacagaactgaactgaaagtataattaaaaaaaaaaaaaaaagctgggtgcggtggcccacacctgtaatcccagcactttgggaggccgagacgggcggatcacaaggtcagcagatcgagaccatcctggctaacacagtgaaactcagtctctactaaaaatacaaaaaattagccgggtgtggtggcgggcacctgtagtcccagctactagggaggctgaggcaggagaatggcatgaacctgggaggcagagcttgcagtgagctgagaatgcgccactgcactccagcctgggggacagagtgagactctgcctcaaaaaaaaaaaaaaaaagaaagaaaaaggagcgttgcttgtttcaggccacaggaaggggagagatagtgaaagtttttcagagaaggtggccagggaaggagaagaaaggactgtaggcagagagcatagcctgtacaaagccatagaggcaagagaaaccaggagctgtagagaagttggcaaggctgttgaacactatggtgaacactatggcggcttccatgaaatatctgagcttttgctccccactagggtgttccctcaggtcaatgtcacgaagatgggcagttggggccactttaactgttcctactcctgctccttccttctggctccggaagaccccatattccccatcatcgggagcctcttcctgcgagagctgatcaaagagtttggcacagaccacatctatggggccgacactttcaatgagatgcagccaccttcctcagagccctcctaccttgccgcagccaccactgccgtctatgaggccatgactgcaggtacagtgcctgggtggggtgggagagccccccagaccctcaaaaagaagggagtagcagatgtcagtaggggtaggcagagggactggaataatgcctcgccataacacacagtactttatagtttaccaagcacgtgtacacatgcgttgtctcagtgaatcccactgtggttgagaggtgagctctggaagccaacaacctgggtcacacctcgcgctcctatttcctggccgtgtgacttatgactcatgacctccttcccagtgtctcgtttgcttttcctgtaaactgggactacctcataggtagaataacgcctggcccagagcaaaggccactaagagctagctatgaacaaggattttgtttcatctctgcgtggttgctgaagtaggcactgcaggcaggaggtgagtggatgtgcctaaaggcactaagtgcgcatcctgctacaaaactgtgaagccagggctccttcctgccacttaaaggaggagtggagcagagggcgcccaagtcaggaatgacttagtggagaggcgtctgtgttggccaggaagggaacagatcagctcagcctttcttgagcagtactgctccaagtgtgacccaaaaccagcagcagcagcagcagcagcccgagctgtgagatggcaaattctcaggccctacccaagacctgaaggagaagctacattttttttttttttgagacagatttcactctgttgctgaggctggagcacagtggcacaatctcatctcactgcaaccttcgtctcctaggttcaagcgattctcctgcctcagcctcccgagtagctgggactataggcacccgccaccacgcccggcaatttttgtttgttttgagatagagtctcgctctgtcacccaggctggagtgcagtggcacgatctcagttcactgcaacctctgcttcctgagttcaagcgattctcctgcctcagcctcctgagtagctgggattacaggcgccccccaaccacactcggctaatttttgtatttttagtagagacggggtttcgctatgtaggtcaagctggtttcaaactcctgacctcaaatgattcgcccacttcagcctcccaaagtgctgggattacaggtgtgagccaccttgcctggccaatttttgtatttttagtagaaacaggtttcaccatggtggccagactggtctcaaactcctgacctcaggtgaactgcccacctcagcctcccaaagtactggtattacaggcgtgatccactgcgactggccttgattttgtttttgagacagaatcttactctgtcgcccagactggagtgcagtggcacaatctcagctcactgcaacttctgcctcatgggttcaagtgattcttgtgcctctacctcccgagtagccgggattacaggcacctgccattacgctaggctaatttttgtatttttagtatagacagggtttccccacattggccaggctggtctggaactcctgggctcaagtgatccacctgcttcagcccctcagagtactgggattataggtgtgggccaccacgcccattcagaaacctccatgttttaaggagccctctgggtaactctcatgttcacccaagctgctgaaccctgtcctggagttttcagagggacgcgtatgtgccacagagcgtcccgctggtgggggtcatgggaagccatgacctgggatagacagtcgtctgtagagtggggtgaacattccctgggccctctgtttcatcactcctcttctctgttccccctacctcctgtccacagtggatactgaggctgtgtggctgctccaaggctggctcttccagcaccagccgcagttctgggggcccgcccagatcagggctgtgctgggagctgtgccccgtggccgcctcctggttctggacctgtttgctgagagccagcctgtgtatacccgcactgcctccttccagggccagcccttcatctggtgcatgctgcacaactttgggggaaaccatggtctttttggagccctagaggctgtgaacggaggcccagaagctgcccgcctcttccccaactccaccatggtaggcacgggcatggcccccgagggcatcagccagaacgaagtggtctattccctcatggctgagctgggctggcgaaaggacccagtgccagatttggcagcctgggtgaccagctttgccgcccggcggtatggggtctcccacccggacgcaggggcagcgtggaggctactgctccggagtgtgtacaactgctccggggaggcctgcaggggccacaatcgtagcccgctggtcaggcggccgtccctacagatgaataccagcatctggtacaaccgatctgatgtgtttgaggcctggcggctgctgctcacatctgctccctccctggccaccagccccgccttccgctacgacctgctggacctcactcggcaggcagtgcaggagctggtcagcttgtactatgaggaggcaagaagcgcctacctgagcaaggagctggcctccctgttgagggctggaggcgtcctggcctatgagctgctgccggcactggacgaggtgctggctagtgacagccgcttcttgctgggcagctggctagagcaggcccgagcagcggcagtcagtgaggccgaggccgatttctacgagcagaacagccgctaccagctgaccttgtgggggccagaaggcaacatcctggactatgccaacaagcagctggcggggttggtggccaactactacacccctcgctggcggcttttcctggaggcgctggttgacagtgtggcccagggcatccctttccaacagcaccagtttgacaaaaatgtcttccaactggagcaggccttcgttctcagcaagcagaggtaccccagccagccgcgaggagacactgtggacctggccaagaagatcttcctcaaatattaccccggctgggtggccggctcttggtgatagattcgccaccactgggccttgttttccgctaattccagggcagattccagggcccagagctggacagacatcacaggataacccaggcctgggaggaggccccacggcctgctggtggggtctgacctggggggattggagggaaatgacctgccctccaccaccacccaaagtgtgggattaaagtactgttttctttccacttaaactgatgagtcccctgggtctgtcaaaatgagaaggtcactgctgccacgcttgggaggactcagggctatagcatggccctggggtgggacctgttctcccatcccttgcctcacgtccctgtttttgtttgtttgtttgtttgtgacggagccttggtctgttgcccaggcttgagtacaatggcacagtctcggctcactgcaacctccgcctcctgggttcaagcaattcttgtgcctcagcctccccggtagctgggactataggcatgcaccaccacaccaggctaatttttttttttccaagatggagtcttgctctgtcgcccaggttggagtttagtggcaccatattggtttactgcaacctctgcctcccgggttcaagcaattctcctgcctcagtctaccagggagttaggactacgggcctgtgccatcacgcctggctaatttttgtatttttcatagagataaggtttcaccatgttggccaggctggtctttaactcctgaactcaagtgatccacctgcctcggccttccaaagtgctgggattacaggagtgagccaccgtgcccggccatgtctctctttttaacactaatgttaccctgacctttgaacgtagaatgcccttctgttgcaggaaaacctcttttcaaaccatgtttgtcctttgctggcatgccacagcaacagtcaccaacacagaagacttctgtgaccaaatatttggaggattttccccacacacaccaagcagcagacatcagctgggtgtcctccaattcagttccaatgtaatcaaccagagacagcatcagatcccacagggttagggtgcagatccatgagaccaccccctccttcccaacggttacaagtcctgatccctggaacttctgactaactggcttcaagttggagttcccatgacccccttcccctctttggagtcaactcatttgcgacagtgacccacgaaacacagggaaacccttattatgtttattgctttattacagaggaaaaaaatttttttctttcttttttgagacagggtctcactctgtcatccagaatgactgcagtggcaggatctggctccgtcacccaggctggagtgcagtggcatgatctcggctcactacagcctccatcccccccaaaccccacgcctcagcgccccaccccgcaagtggctgggactctaagcatacaccaccacacccagctaatttttttgtagtttttgcaaagacggggtctcattctgttgccctggctggtcttgaactcctgagctccagcaatccccttgtcttggcctcccaaagtgctgggattacaggcatcagccaccgtgcccaacctcaaaggatattttaaaggatagaaataaacagccatatgaagagatacagacagggcggtctggaagggcccagagcaggagcttctatctccatagagttggggttacatcaccctccaggcacatggatgagttcttcaccttctgtcagcctccacacgttcagctctcagaagcttcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcaaagagaggaaaggctgttttttgaggcctgaggcgccccaacatgacaacgaaagactgtaaccatggtcatgtgagttatgagctaggaaccctggacgaaaccaacacatatacaatcatctcccacctcccaacacctttactttcacagcctctgcagcaaactgcggtcactataatcgctcctgtggcacagaggcatacccaggggaatctgcccagggggccactctgtgcccacatgggaacccacatctgcttgtaaagcctcccctccctctgaccagaaacgaggacagtttgttgttccaagcagtgggctcatgtctgttttggctcagaacagggtggggagagcgggccagggacccgcaggagggctt

SEQ ID NO: 17149 - DNA, 83349 bp, Human
  misc_feature (1)...(83349): n = A,T,C or G
caaactagaagggaagacaaataaacataattcaaatttgtgctaagagagaggtatgtacagggcacggcacggtggctcacgcctgtgatcccagcactttgggaggccaaggcaggcagatcacttgaggtccgtagttcaagaccagcctggccaacatggtgaaaccccatctctactaaaaatacaaaaattagttgggcgtggtggcccacacctgtaatcccagctactcaagaggctgaagcaggagaatcgcttgaacccaggaggaggaggtggcagtaagccaagattgtgtcactgcactccagcctgggtgacagagcaagactccaactcaaaaaaaaaaaaaaaaaaggagaggtatgtacagagtgcccttagaacacagttcattgtgtagtagggagaagaagtaggcagggagtgggaaaaggattgtgttaaggcaagttacagaaaggatgttattatttatgtttatggtgaatcacaaagaatgattgggatgttaacagctaaactagcagaaggtcattcaaaattaacattaaaaaatcttaaaaagcaatttgggcaccacaaccttctctgtcattgtattccagctttgcttaagtgaagattaagtgaggtaatctgtgtatggcacacagtaatttaactccataaatgtcaattgttgttatcagggacagagaattcaaaattagttgacttcctccatggaaaaaaacctctaccttctttttctacagaagtacctagaagggctgggcgtgatggctcacacctgtaatcccagcactttggaaggccaaagtgggaggatcacttgagtccaggagttcgagaccagcctggggaaaatggcaaaaccccatctctacaaaaaaatctaagagaaattagctgggagtggtggcacgtgcctgtagtcccagctactcaggagtctgaggtgggaggatcaccgagtccagaaggtcaggctgcagtgacccacgattgcaccactgcatttcagcctgggtgacagagtgacaccatctcaaaaacaaaaacaaacaaaacactccacctccttttatacagaagtacctatgtggcaggccaggtctcactaacacagacctccataacaatgatttcggtactgactgagtggttaagttaaatattaaaagccagtgcccttatacaaaggctgggatgtaacaaaagcccaccaagagttttgcctaggcctttcctgggccttaaagcatgacaaaatagaaaaggaatttttaatgacccacttaggattaaacaagttttactgtgggtctgaagaaactccccagacctccacaaacaagtttatggagggtctgaaggaactccccaaacctctgtgatttagcaggagacaagataagggtaattgccccagcacctggacccatttaaattaagtaaatttactgagaccccagaggaaggtcttcagcactcagactttagatatagattaaaagaagttaatcacttatgtctttagatgaatgcacgcttacacatggacatatggcgtagaaggtatataagctctggaaaactttgtaattttgagttggtctggtgataatttccaggccttctccctgtagccagttgcagaagtaaataccgtcttcctcctcggttcatctgcatctcgttattgggccacaaaactagcaggccaaccctcagtttggtccaggaacacctaggtgggacaggcacaatggctcatgcccataatcccagcactctgggaggctgaagcaggaggattgcttgaggccagaagttagagaccagcctgggcaacatagggagactctgtctctacaaaaaatttttaaaaattcaaaaaaatacaaagaagtacctacatggttaccactatccaaattgagtattatttatacattagattaataacttttaaatattgtatttcagctatgaccaccaaagattatccatcattgtggggctttggaacaacaaaaacattcaaaattcccattgaacatctagatttcaaatacattgaaaaatgttcagatgttaaacatctggaaaaaattctttgcgtgctcaggtaagcattttaaaatcattacatgttttagtatgacagttttaattatcttgttgttaccttctaaaggtaaaagctacattagaaatatctgtttttgcccatgcatggtaggtcccaaaatagtggttttgatcctatggttagtttggagagttccacctaggtctactgccagcatgagacgcaggctaattaatatccaggagggtatttttcttgccttctctacattttctaggagaaggtaaagtagctgtgaaagcagccattaggatgggctgtgatggctcacgcctgcaaccccagcactttgggaggctgaagcaggtggatcatttgagctcaggagttcaagaccagcctgagcaacagggtgaaatcctatctctacaaaaaatacgaaaattaccttggcctgtagtcccagctactcagaaggctgaggtgggaggattgcttgggccttggaggctatagtgatccctggttgtgccactgcactccagcctgggtgacagagtctcaaaaaataaaaaaataaaaaataataataaaaaaaataaaaaaagctattaggaggtaagcttatctcaccagcctaggctggtggcactttcccacttcatatcacctgacaacaagggagggtgacccaccgcacactgatcacatggagggtggtggggaggcctgacggtaataccagaaggcagggaattaggaccttctcaggatagagctccattctagtgactgtccaactgaatatacatcaaatgtggttgttaaaaatgcacatttgagggccctattcccagcgattctgcttcaaaaaatctggggtagggccagggaacatgtgtttttaacaatggagctggctgattgatatgtaggtgttcaaggaacccacttgaagaaacactgtcctgagtaccaccaacctgtgacacctcttttggatttcttttctttctttctttctttttttttttttttaagactggatctcactatgttgtccagactgatgtcaaactcctggacttgagcaatcctcctgctttggcctcccaaagtgctggggcctctttgggcctcttgagctattttcatttggataccagagttctattgcagaagacacttgtggagcatgaactgctttccaggacatctagaattcctattaccctgtggtggttctttatttcctctatccctattccttatcactgggttcttccctttttctctttcatcacctttagcttcctttcttccctgttggtccacagccagatgctgatgtgataacatcatcatttttaaaatggaaagtgaaaaatcaataatatcaattgttttcccttttttagcagaatattatcatgtatacttggtcaaggacggataaataaaaatgaaaagtttattggatgaaacagttggaaagctacagttataataatgttggttccaagaaattttatgaatagcctaattcagtgataatatattgaacttggaattgttttttaaaatttaatttggaaatgaaatttatttatatttttctggaaatgtaagagtgaacagacctaagaaagaatgggaaaggactgattttccttaaaataaaaggaacagatgtctccatttaactctctaaggaaggaattctgttccttgagtggttggatttcagggtgttttgtttaagctgtttatctgccattttcttcctacctctttgaaataaaaaaatttatgaacagaaactccttgttgaaaaggaagtccaaattctctttctgctagtctctaatattgaatttatgagcttaatatcatgtacaaaatgaacatatgaacatatatatgttgaagagaaaatattgtttttgttagattaaaattttgtttctttggttgatattaaactgaaatttatatgatacatgagatttgaaacttagaaaaagtaaatgataaaatttttttttatttttattttttgagatgcagtctcactctgtcacccaggctggagtgcagtggtgcgatctcggttcactgcaacctctgcctcccaggttcaagtgattctcctgcctcagcctcctgcatagctgggattacaggtgcctgccaccacgcccggctaatttttgtacttttagtagagagtccatttcgccatgttggccaggctgttctcgaacacctgacctcaagtgatccacctgccttggcctcccaaagtgctgggaatacaggcctgagccacagtgcccaacctgataaaaatttaatatagttaactattcattgatatgtttattgacttcatcataagctatatatttaattaaaaatcaaactatgagtctgcaaaccagatgctatcaagcaaattaccatccatgatccataattctttttatatttttaactcagacaaatatgtaagattcagtaagttttaatgtttcaaatgttttccaaaaaattatcagaagctcccagttataaaatagttggagaatccattcaccccaaatgaactacctgtttgtgtgtgaggtagcaatcttctgtgacactattacccttaattcatatgaattccctcttcacatgaagagtacagacaacaaacagggacagatgagtctcattattcattgactcttggtgttttcatagtgtgttaaatgcctgatttcaattttacagcaacaaaaaataccaatatttattctgaaaggtaattgtatgttccaagcagccgatattaacaacttccatcacgactctaggaataattcgcagttctgaaccatgttttagaaaaacatttccagcaggtctgtgcaggattttttcctattccatcattggtaataattgcacttcttgcagcaggaacttgaaattcttctgttgcaaactgtaagactgctgtgaaaggtgtactttcaggaacagagtactttgtacgccagccgcgggtcagacctcagagtgatcttaaaggaaacctttgacatggtggcgccgggaggaacccagaacccacgccaactccgcggagcaaccccaattcctccatggtgccggggaccacaccgccccactcacccttatccagtttttaaagtgtgtgatgaaaattggttactttggagttcctttttttcttcttttaatcattccatagattaacgggtaaaaatggagactatgcgggttaaggaaagagactgggaagcagcccttgagatctccacagaacctcagggttccatggaacccagcctgcaaaccgctggtctagatgatcctaaataaggtgctaactctaaaacttatttatttctttttaagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaaggtatatagtaataccaattttccatagatattgttgagacattctatatatgtttacttcacttatcggaaatcctaggcttcttgtttgtccgtaaagggcttttagtgtcaattaggcaggattggttgctttttacacccaggggaacattgcgaattcgcgtgtgtgtgcgtccgtacatgtgtatatttaaattgattgaataatattctgtcctattaaaaaacctataatttaatcatcttcaataaatagtgctgtataaacatgtttatttgtaattttttttcttttttttttgagatggagtcttgctttgttgcccaggctggagtgcagtggcacgatcttggctcactgcaacctctgcctcccaggttcaagtgattctcctgcctcagcctcccgagcagctgggattacaggtgcatgccaccatgcctggctaatttttgtatttttagtagagatggggtttcaccatattggccagacttctcgaactcctgacctcaggtgatccacccacctcggcctcccaaagtgctgggattacaggtgtgagccaccatgcctggcctatttgtaattattttgcacctccctgattatttcctcaggataaattattataattcaaattgcttggtcagatgtggttgctcacaccacctgtaatcccagcactttgggaggctgaggcagaaggatcacttcaggccaggagtttgagaccagcctgggcaacataggtagagctgtctctacaaaaatataaaaattagctggacgtggtggcatgtgtctgtagtcccagccattcaggaggctgagacaggaggatcgctttatcctgagagaccgaggctgccgtgagctgtgatggtgtcattgcactccggcctgggtgacagagtgagaccctgtctaaaaacaaaaagcaagagaaagagaaaaagaatttaaattgtttgatcaaaggatttgaatatttttaagccttttcaaacatatgttctcagaaaagttgtaccttcatacaccacccccaacagtgtataagaatgcccaagccaggtgcagtggtgtgtgcctatagtcccagttactcagggaggattgcttgaacccaagagttcaaggccagcctagacaatacagagagacctggtttctttattaaaaaaaacaaaaacaaacaaacaaaatgcccatttttaggtactctttgctggatactgtaatcatttttagtcaattaaatagttgaaaaaatggtagtaccatagtcccttcttatctttggggcatactttccaagacccccagtagatgcctaaaactgcaaatagtactgaagcctaaatataccatgctttttcctctatatgcatatctatgataaagtttaacttataaattaggcacactaagagattaacaataaaaaacagaacaattataacagcatactgttgtaagagttatgtgaatatgagctctctttctctcaaaatatcttactgtattgtactcacctatttttggatggcagttgactgtgggtaactgaaaccacagaaagcaaaattacagataaggggaggactattgtagtatattttttgattgctagaaaagttgagttatttttcatgaatctgtcacttaaatttcttcttaaatatttacagatttcttttaatcagctttattgagataaaatttacattccatataaattaccaactttatagtgtacatttcactgagttttgacaaacgtatatgatacagaacatttccatcaccactaaaagttttctcttgcccatttgtggtcagtgtagaccccactgcctggcctttggcaaccactgaactgtcagcatagttttgccttttctagacttgcatataaatgtaatcatacagtatgttgtcattcctgtgtgtcttctttcacttatataatgcttttgagattcatctgtgttgttgcatgtgtccatagtttgctcctctgagttgctaagtagtatggaattgtatgaatatcccacagtttgtttacccacttacctttgataagacccgcagtggatgcctaaaacctagataatactgagccctaaatatactatgttttgactgccaaaatgttttccaaagtggctgtaccattgtgcaatcctgacagcaatatataaaatttccacctgctttacatcctggtcagcacatagtattgtccgttttgttagttttagccatcctaccaggtatctcattgtggttttaatttgcgtatctctagtgactaatgatattgagtgtcttttcatgtaacttctattgtgaggtgtctttacatcctttgcccgttaaaaaaaaattgccttgtgttcttattgagttgccaaataattgttctttatcagatacgttgcttttttgcccaggctggagtgcagtggcaccatcacagctcgctgcagccttgacctcccagactcaagcgatgctcccacttcagccttcagagtagctgggaccacaggtgtgtaccaccacacctggctatttttttttttttaattgtttgtagagacagggcttcactatgttgtccaggctagtcttgaactcctgggctgctttggcccctcaaagtactgggattacagcatgagccaccatgcccagccatatttttttttttttttttttttttttataggttaaaacaaacctttgctcttgttgcccaggctggattgcaataacacagtctcagctcattgcaacctccaactcccaggttcaagcagttctcctgcctcacccttctgattagctgggattacaggcatgccccaccacccccagctaatgtcttatttttagtaaaaacaaggtttctccatgttggtcaggccggtctcaaactcccaacctcatttgatctgcccatctcggcctcccaaagtgcggggattacaggtgtgacccaccacccccggccttttttcatttttttttaacagtatctttggaaaagtgaaatttttaacttttgatgaaatcttttttttattgtttgggcctttgtgttttatctaaaaaatctttgtttaatccaggacatctaatttttctcctaggaagtttatagttttaattcttatatctaggtctataatcagttttaatttttgtattggtgtttgaacaaaaagtgttcaagcaccatttaataaaatattatctttaaatttcttggtaccattgtcaaaaatcagttgaccaaatctgggtgtggtggcgcatgcctacagtcccagtttctctggaggctgagacaaggggatcacttgagcccaggagttttaggctatcatgcactattaccaagcctgtgaatagctgcttaactctaggctggacaacacagcaagacctcatctctaaaaaatcttttttaaaaaatcaactgggctgagcacagtggctcacgcttataatccagcactttgggaggctgaggcgggtggatcacttgaggtcgggagttcaagaccagactggccaacgtggcaaaaccccatctctactaaataccaaaaattagctaagcatggttgcgtgtgcctatagtcccagctactcaggaggctgaggcacaagaattgcttgaacctaggaggcagaggttgcagttagctgagatggtgtcactgaactccagtctggatgacagagcaagactgtctcaaaaaaaaagaatcagttgatcttatgtgtgggtctatttctgactctttcaattctgtttcattattttattttttatatttatttatttattttgtactccttgaggagcaaggctaccccctaggcagcctgcccacagtagcctgtttcattattttaaatgtccatctttactccattaccttcttgtcttgattacaatagttttacagtaactcttgaaatcttactgtaataagaggctggaaaaaaaaaaagagactggaggtagtacaagtcttccacctttgttctttttaaaagttgttttggctattctaggtcttttgcttattacaaaataacttgcttgtgtttgaattgggattgtgttgaatttatggatcaattttggaagaactgacatcttaatattgaggtttcggatccatgaacattgtatatttcttcattcatttaagtcttcaattttttttacagcaatgtcttatagttttcagtatgtagttcttgcatatttttgctaaacttattcctaagcattatatgtagctcatgctattataaatgttaatatttttataatttcaattttttgctcatcctgtcatctcagttatgaaattttgtttttttattatagtgaaatacatattacataaaatttattatcttaaccagttttgagtgtacagttcagtagtgttaagcatattcacatggttgtgcaaccactcttcagaactttttcatcctgcaaaacaaatgctatactcattaaacaacaactccccattttccccactcccctgtcccctagcaaccaccattctattgctgttcctataagtttgactactttagatacctaattttaatttcaatttttaattatacaagtttgtatttatctaattgctttttcatattgacttcatatcctgcaattttgttaaattcatggattagttctaggaatgtttttgtagattcattggattttctacctgcaggatcatgccatctgtgaaaaataagagatgtgcttcttttccagtctgccatttatttatttatttatttatttatttatttttttatttttttattttttacttgctttattgaactggctagaacctccagttcagcagaagtggtaagagcagatcctcgcctatttcccagtcttacagggaaatcgttctgactttcactgtgaaatataacgttagctttaaattttgtgtagatgccctttatcaagttgaagttttcttctgttccttgtttgatgagaatttttatcatgaatgggttttgaattttgtgaaatgctttttctgcatttattgagatgaacagatgattttctttgtagtctgttaataaggtaaattatgtagattgttttcaaatattataccaaccttacattccaggataaactctacttggtcatgatatatcttttacaaatatattcctggatttgatttgctaaaattttgcgaaggatttttgtgtctatgatcatgagagatattggtcaatagttttattttcctgtaatatcactgtctggttttggtagcagggtaatgctggcctcataagaggagttgggaagtattgtctcctcttctgttttctaaaaaagttggtatatgattggtattatttctttcttaaatgttttcaattcattgttgacactgtataggcctggagttttctttgtaggaaagattttaactgtgaattcaatttttcaaatagatacaaggctgtttaggttatctttagagctctctttctgtacggcttcctcctttctgatatttttttcccccgaatcctcacagtcttggcctccctaacgtccaaactttgtctgctgaattcagcaagaccacagggttctgtctgggtacttttcctgtgctgcagcctggaaactgcagtgagttggagcaaatgtagggcttacctcatttgttcacccttctttcaagaatcactgtcctgtgccacctgttgtctagtgtctgaccaccatcactccatatatcttacccagttttctagaatttaggtaagagagtaaatctagttcctgactccgtcaggccagaagaagtccctttattgatttttctttttttttttctgagacggagtctcgctctatcgcccgggctagagcgcagtagcacaatcttggctcactgcaatctctgcctctccagttcaagtgattctcccgcctcagcctcccgagaagctgggattacaggcacgtgccaccgcgcccagctaatttttgcattttttctattaatgtgtttctcattgttttgtaagagttctgtactgtatattgtaaattttcctctagcttgttgtttaccttttaaatgttgtgtgtggtgttttttatttttttaaatttttatgctatcctcttaattttattctttaagaacttttcattggcttttatagttaggaaggttttctctccaccagatacatatttacttatattttctcagagtttcttcagtttcattttgcttaagaaattatttttgggctgggcacgagtggctcatgcctgtaatcccagcactttgggaggccgaggcaggcggatcacctgaggtcaggagttcgagaccaccctggccaacatggtgaaaccctgtctctactaaaaatacaaacaatcagccaggtgtggtggtgcatgcctgtaatcccagctactcaggaggctgaggcatgagaatcacttgaacccaggaggtggaggttgtagtgagcaaagatggcaccactgtactccagcctgggagacagagctagactctgcctaaaaaaaagaaatatatgtgtgtgtgtgtgtgtgtgtgtgtgtgtatgtgtgtgtgtatgtatgtgtatatatatgtgtgtatacacatatatacctcgcagattctagagaaccagttttttggtttactttattctatttatatttttctggggttaaaaacaattttaaaacatctaaaaacaatgttgaggtatatgtattctgtaacttagaatgctgctttttaaactttctgccttctcattttattggcttgagctcaaaaatatggtaattaatctaccagtcaaaaatagcactttatgtccagactttttggctttgttttcaggatgcagacagcttgattttagttgaagagcctaggtttttccccattgtgtgtctttgctcttcttgaccacttcttttttttttttttttttttttttgagatggggtcttgctctgtcacccaggctggagtgcagtggcacaatcatagctcactgcagccttgaactcttgggctcaagtgatcctcctgattctcccaagtagctgggattacaggcattcaccaccacactcagctaatttttttgtagagacaggggtcttgctgtattgtccaggctggtctagaactcttgttggccactttgcaagttagtctccttctcacttgcctttctttcatactttgtttgccacttgtccccttttctccattctttctcgctcccttcctcctctataagtcttcctcttatcttttaccattcttaccttattgcttttctttttcttctcatatttctcctctttgcccctttccaccctccctgccttctatacagatagaacagataatatagttgttgggtttttttgctgtatcccagtgcttttaagagtgtctaacaaatattagaaccctcaatacatcttttctgaataataagtaatacagtttcacagataataaatctcttactcaattttttttctggcacctgtgacaatttaataaatgttaagaacctactatatgtcagacactgaatcacaaagatgaaattaagacataggccctgccctcaaggaatttacagtataagaagagagactaacaatagatgatttttaaatctttatgctaatgtattatggaggagaagcacttttagcccaactaggaagttctgggaaatcttgctgaaaagaatgatgaataaggtattgcaagataaataaaagtaggaagggcaacaacaatgtatatatacttaacaagactgaactgtagacttaaaaatggttaagatggccaattttattatgttatacatatttaccacaatttaaaataaaaggtaggaagtatgttccagatagtgaggatggcatggatcacattgtctaaaaaattgactcataggaaactatgataaatatagctgactcttgaacaacacaaggagttaggggcgctggctccctacacagtcaaaaatctacttacaacttttgactcccccaaaacttaactattgatagtctatcgttgactgaaagccttaccaataacatgaacagttgattgacatatattttgtatgttatatagattatatactgtattcttacaataaagtaagctagagaaaagaaaatgttattaggaaaatcataaggaagagaatatatatttacaatgtattaagtggaagtggatcatcataaaggtctttatcctcgtcatcatcacattaaataggttgaggaggaggaggaagcataggaggtgttggttttgctgtctcaagggtagcagagatggaagaggtggaggagatgaaaggagaggcaggtgcacttggtgtaactttatagaaatcaatcataatttctgtctgacttttgctttttcatttccttaaaaatgttactatatggtaccaatccttcttccaccgtttgctttagttttagtccccgtatcacagagggtagatgttgtgaaagaagtcaaaaacagtcttgtgtaatcggagcccttctgccagattgtctaatgttagtttattttctggcattgcttcttctatgtcttctcattgtctggcactggttcagaagcacttaccttcatgaagtcatcttctgttaattactgtggtatggtgttagcacttgaatttctccaacttccatatcttgaaacacttcactcccaactttttttggcatattcataatctcttttatgatttccttgatttactctattgtaaatcctatgaaatcccggacaacatctggacagtttttttctagcagggatttattatttcatggcttttttttttttttcttagagatgggatcttgccatgttgccagggctggaacgtaatggctattcacaggcagggtcatagcacacagtacagcctataactcttgggctcaagcgatcctcctgcctcagcctcctgagtaagtggggctacaggtgcatgtgccaccactcctggcttaatggctttttctataataatgatggcatcttcaatggtgtagtccttctagacgttcatgatgttctatcagggttctcttctgtagtgttgacaatcctttccatagagaagggcgtgcagtgaagttcttttttttttttttttttgagatagagtcttggtctgtcgcccagcctggagtgcagtggctcgatcttggctcactgcaagctctgcctcccaagttcacaccattctcctgcctcagcctcccgagtagctgggactacaggcgcccaccaccatgcctgactaattttttttgtatttttagtagagatggggtttcaccatgttagccaggatggtctcaatctcctgacctcgtgatccgtctgcctcagcttccaaagttctgggattacaggcataagccaccgcacccagctagcacgcagtaaagttcttaaagatctttgtgaccccctgatctagaggttgaattagagacgttgtgtttaggggtaagtagaccacttgaccccttcggtcttgaactcatgggattctggatggcctgggacattgtccaacatcagaagaactttaaaaggcagtcccttagtggcaaggtacatcctgacttcaggaacaaagcattgatggaaccaatacagaaaaagtgttcttgaaccaatacagaaaaaggccttcttgttgtacagccaaaagactggcagctgatatctatcttttcccctcaaggcttgagggttaacagctttacaaataaggtcagtcctgatcataaacccaactgagtttgcacaaaatagttgagtttccctatcccttcctgccttaaatcctggtgcttgcttctgttccttactaataaatatcctttgtggcatttttttccccaagaatacagcacttttgtctgcattaaaaacctgctcagacagatattctttctctttattgattttctcaatggcgcctggaaacttgtctgctgccttttggttgggagaaggtgcttttcctgttctcttgacattttaaaagccaaacctttttctaaaattcaaaccatcctttgctggcgttcaattcttcagctttataggtccatcatcttccttttgctttaagttgtcatataatgactttgctttttctggaatcatattagagtctataggaatgtctttctttttttttttctttctttcttttttttttgagactgagtcttgctctgtcgcccaggctggggtgcagtggtgcaatctcggctcgctacaacctccgcctcctgggttcaagtaattctcctgcctcagcctccccagtagctgggattacaggtgcccaccaccacacctggctaattttgtatttttagtagagacggggtttcaccatgttggccaggctggtctggaactcctgacctcaagtgatctgcccgcttcggcctcccgaagtgctgggattacaggcgtgagccaccacgcccagccaggaatgtctttattacatcaattttgcacccacatgaaggctgcattttcaataaaagataaaaaggcatttcacaagaagtgcaaagtctttgcacctgatggtgtagccgcagtgatgcaatgatggcctcataaatttccctctcctctcctctccactccactcctctcgtgtcgtgtcttgtccttttgtgtgtctccctgtccccttccccctacccttccctctccgtgtcttcgtccccctccttctgtccttttccttcctcctttcctctccttctcctctccttgtttttttcgtttctttcttttttttcaatggtccttactctggattcatttattttgaaatggtgggcaactgcaacggtagcttatgccagatcttaatctctggcacatatcaagcaattcagctttttcttgtaatatcatgtgttctctctgcttcttgggagcacttccagcatcactagtgacactttatatgggtcccatggtgttatttaaggtttacagtattacactaaacatcataaaaatatgtgagaactgtgagagatcactttttatggcaagatgcagtttactagagacaaactgctcctgcagagatgactagtgtcacaaggcattttaagcagatacttgtaactcttaagcttaccacaatagcaacaggaggtggctgtgaaattattacgtattatagtgtctcctacagtcagttttatgcagctatgatttaatactgcatcttcatgtctttttttttttacatttctctttactgtgaatggtgccatttatggtctgtaagtgtttgtgtgggtaagttttgataaattttaactttttataacttgtgtatactttatggtagtaaatgataaaacagactagtatctacatatattttatgcattcatgaaatacctaactttatcttaatttttttgatatttctaattcatctgtgagttttttcaaatcgtcacaaatctccaaaaatttttccaatatttttactgaaaaaaatccacatataagtggaccaatgcagttcaaacttatattgttcaagggtcaactatagttctttcttatgcttggttataattatttcaaactatatatttacccttttctctattctcagagttgggtatcagaaattaaaaaagaagaagataaaatgcactttcatgaaactgagacatttccagcaatgaaagataatttgcctccagttcgtggttcaaacagctgtcttcatgtaggcaaggtaggcttctttgatatctttgtgggtggtagcaggagaggattgctgctgtttattaaggggcaatctcagtttaattggagcagcctatgtgtgatgtcctctaggagaattggggagtttgttcagctggctgggaactatcggctgggaactatcacgttctttactgtctcattacttggaaatcaaaatgaaacagttttttcctttgaagtcctgcatcttgggcttatttactgcctttagtcttttttttctttttttatacaccctgtctcttccgtccagttttgatgagagcaaaaggtctgattcagtgtgtgaaaatttcagggaacaattgtatatatctagtagggctacagaggatatatcatgttacataatttaattatggatttaaaacagtaaacagatactttcagtacttataaatgtcattcctctgtttagtgcatgttttttcctcttattcccatttctctgtcgttggtccctattttgtcacatagacctctcctttttaatctgtgggctccacagagaaggggcctcttgaagttccaggcccattctatttaactttaggttgaaactggggttcctggcatccatctgaccttgtaatttctcagatgactccccaagccttttcattctaggttaactcattcttgttattctcgtcttttctttgaatcaattttattttaaaaacatccatggctcttcatcactctgctctctgataatttaccttcctggatctttttactcctcattaggaattatgcaggtaatggaggtgtacagtaatctggtgaggatgccactatctgcaatcagtgaaattgtatttattgaatagttggccaggcacggtggctcacgcctgtaatcccagcactttgggaggctgaggtggatggattgaggccaggagttcgagaccagcctggccaacatggtgaaaccccatctctactaaaaatacaaaaacattagccaggcatagtggcatgtgcctgtaatctcagcttcctgggaggctgaggcacgagaattgcttgaacccaggagatggaggttgcagcgagctgagattgtctcctctgtctcaaaaaaaaaaaaaaaaccacaaaaacaaacaaaaaaactctgggcatggtggctcacacctgtaatcccagcaccttggaaagccaaggagggtggatcacttgaggtcaggagttcaagaccagccgggccaacatggtgaaaccccatctgtactaaaaatacaaaaattagccagccatggtggtgggcccctgtaatcccagctatttggaaggctgaggcaggagaatcgtttgaacctgggaggcagaggttgcagtgagctgagatcacaccactttactccagcctgggggaaagagggagaatccatctcaaaaaataataataacaataataatagtcccggtgtactaagactgtgccttgaaaatataacaatgaacaagcattgctgaaggagcaatggggtggatggactagtggtacagtagttcttaaagtatggtttaggaagcccttgaagtcccagagattcttccagggggtccagaaagttagtgctattttgaaaataatactaatgctttgtccttgtcactgtgttggtatttgccctgaggataaagctggtattgctttaacatgaagcaaggcaggcaccacgttgtatatacagtaaaaacaaattccaattttacttaaaaatacctttgataaaataatagaatatttactttgttagatcttgaacttccaggacatgtcattttagtattttgtgacaaagtgagaagtatgcagaaagcacttccctgcatagtcaaatatgatggttatgatatgatgcatagccacgtcttcctggaatgctgtttttacttgaaataatggttgacaaactgtcattattcagacttaggattttggcaaaaattttgttggaagtgaatgaaggaggcctgtcgctttaagaaaaacaactcacagtatttgttgctagtaagaaaatctgacctttcaagtgcaaattaggtccaggcacaggcgggcagtggctcatgcctgtaattccagcactttgggaggccaaggcgggtggatcacttgagcccaggagttcgaggcctgggcaacatagcgagaccccatctctacaaaacatttttttttttattagtgtggtgtggtggcacatgcctatagttctagttctatctattcaggagactgaggtaagaggattgcttgagccctagtggtcaaggctgcagtgagccatgatgacaccactatactccagtctgggcaacagagcaagaccctgtctctaaaaacaaagtgcaaattagggcttgaggtattaaatatttagtataatataacaatatctaataatttagatattatgtgtttctcaaatatctgcttgtgacagaaaatagcccttaagggggatacttgtcaaaggacaaaattacaacaaatttcaagatctaattggcttctattaacaattcatgaatcaggatggcatctcctctaaaaatttagaaaatatgctccaatggccatggcagaacagctggtttttataaggtagcttgagcagggataaggcatacaaaaaatagactatttaataacaggttactttccttgtaagggttaaagcagaaatttggctattatctctgtctcttgatttctccagtcagataagcaacttagttttggtttggtgatatggaacttgagcactagtgactgtatttaagtctgttggggcctagtgcaggagcttagtccaaatcattgaccttctataaattttatttaacatacttgaaagtcttttttgatgatctccatgcagatattaacaaattgtgatttttaaaattgcataatgaaatctgtgaatatttggaaaatctgtataactccaatgaccaataattttgaggagtgcgagagtgtcatgatactgaaaagtttgagccccactaatgtagcatataatggattatgacagtaaatatgcagtgttatgagaatacatagaaggcacatgtcccagcctttcaaagtcagggagcattgccttcttaaaatatccaaatataatattacacattagaatttatcatgtatactgagtccatgtcttgagacttttattgctccacattctttttttatttattgaaaatcttcttcttctttattcagtcataattgataaaacttgcatgtatttatggtgtgcaatgtgacattttgatatatctacacattttgaaatgcttaccacagtcaagccaattcatgtccatttcttgatccctaaagggggatattttttgtcacaggtaggtatttgagagccacatatgaatattaaatacccctgattttgaatcaatgaccttttgaaactaagtgataccacttgtattagtttcctagggctgctgtaacaccacaggaagtggttggcataaaacaacagaaatgtattctttcacagttctaggggctagaagtacacaatcaaggtattggcagggcctttcttcctccaaaacctgtaagggaagatccttccttggctcttccagcttttggaagccccggccttccttggtttgtagcggcacaactctaagctctgttttcatttccacaccaccagcttccttctattggaacttcttctcctctttgtataaggacacagtcatactggattagggcccaccctaatgacttcatcttcatttgatgacattgcaaagaccctatttccaaataaggtctcattcacaggtaccggggttaggacttcatcatattgtttttgggagacacaattcaacccataacatcatcttagcattgagaacattgtctttatgagtaggaaatcgagttcaagcatcaaatgatactttttgagcctgtaaggactgcatagtactcatttatgtagtttatatagttcttagtattgctattagcaaacctgagcctaatgagaatgaagatatgtaatagtttaaaaacaaatcagtacctactttattattataaattctgctatacttacctttcttcagactatatagataaatattttaaagttaatattccttagtacttatctagcaaaaaattgtaccctctctgggagactgattatttgtgagcattatggctattgtttgcctttctctcattctgttctggtgcagaacctgccctctgtctttagcagtgggaatgtggctactttgggccactgttagtgcttggttaggatgggcccatgacccaagctagccaatcagtccttccttggaatttctctaactgaagatggagagaagagtcactctccttttcctctggtggagagagctgtgaggttataattccagaatgcttgtggtgatgtttcctgccacatggagaaagcaagtacccatcagggaaagtgaaatcagtaggtagagaggagcagaacctgggaggggcagggagagctggagaaagggcataggaatcccctcatccagcagcacccttgcccttccatcagtttagttatataagctgataatttcttcttttttaatgtaattattccaaatcagattactatcattgcaaacttctgactaatatagcaattattcttgtttctccaatgcctaggtttgaaaagaatgaatcagaatttagtacttttttattataagaaaatcagtaataatcatattcacacataagttttaaaattttatatgtatatacttaaaaacctatagattgtccccagaattaactataaatttaaaattctttcttttacatgctgtatattattatgttaataactgtaatactgaagttattataacttccagggtacctatttttcttatccattccatttgtatatctttattttatttttatttttttgagacagtttctctttgtcacccaggctggagtgtagttgctcgatctctgctcactgcaacctccacctcccaggttcaagcaattctcatgcttcaacctccaagtacctgggattaaaggtgtgcgccaccatgcccagctaatttttgtatttttagtagagacggggtttcaccatgttggccaggcgggtctggaactcctggcctcaagtgagctgtccacctcagcctcccaaagtgctgggattacaggcgtgagtccccgcacctggcttccatttgtatatcttaacccaatactttccattgcatttacagtaaaacctgataatcttatattaaatatgtctcataaaatatgattttattcttttaggaaaaatattctaaaagaccaactaaaaagaaaactccaagggattacgcggaatgggataagtatgttttacatgtctttatataaaatgtatcactaaaaaagttatctaccacaaaatactgcaataatttcttaaataattattataaaccttaacatgtcaagaataccaaattacttcaatagagtactgagaatatctggcctcagcacttttgatgtttttttcagtacataaaaaacttctacatcctatttttttataaagtcagccaaaaaaactaatgtattttttatacccatccaaactaaaaaggaacaaaaatttaaaattgagataagttagtcaaaattttaatttcaaagttctgaccagtttagatttgattaacgtttaagttctcactaaattgtatgttttcttaagaaggaactcagatgacttgaactattaacttactacatatttttgaatatgtatccaaaggcatacttgtacaaatataagaatatcaatgataaatttattttcttgcctgtattgtacttttttggtttttattgttctttcatttaagatttgacgtggagaaggaatgtttaaaaattgatgaagattacaaagaaaagacggtaatagacaagtcacacttgtctaaaattgagacaagaatagatacagcaggtaattggagaaaaaataataatttagtagtctttaaagtttttcaattataataaaaagtgtcaatctagaagacattgtctttgagtactgcacagattaccatgaaaagtttatggattttctcttacagttgaccactcaacaaattcacttctctcttttacccacttaatttttaaatgtagtaaggctttaaaatataaacctatttttcttactgtaattcatttgtttttaattccttttttccaatcctctttttcctccaaattcctaaaattgttttctttttgcttcaaaacaaaaagatggggcagtttattggactagcacctataaagtgaaacgaaatcaatcattaaaaaaattctgaatcctcaaaacttgtgaatgatttaaaaagaaaacatccctaagcttggggaaccttttattttcttttgtttattttatgatctttctgctttcttctgcttctgttaaaataagcattcttagatttaaacttgaaaaattctgttaaattatacatttacatatagcagataacatttatttctaggtctaactgagaaagaaaaggattttcttgccactcgtgaaaaggagaaaggaaatgaagctttcaactcaggagattatgaagaagcagtgatgtattataccaggtgagcagatgtttgttggggtttaaacttgccttttaaaaaatgataatgttttaattgttgaaacaatataaataagcgaaagtctatgtcagaatctctcaatgtattgtacttgtgatttatcatatattcacttgtgtttctcctattttttcaataatttttctcaaacctctaagctcccactccactcctacttttgacagaagacttaacttcctatcttgcagagaaaatagaaggcatctgacaggaattcaacagaaggcccatatgatatagaagtgaataacttgggttccattgtagactgcctggatttacttctagtactttggtgctccttcctaccacagggcctttgcacatgctgggtgcaccatcaaaaatgcttttcccatggctggtctgagtacagtggtgtttacaactaattgatcacaaccagttacagatttccttgttccttctccactcccactgtttcacttgactagcctttaaaagagaaaaggaaattaagaaaaaaaatgctcttccctcgttccattatctagttaattctgatttatccttcagatcttagtcttcaccttacttctttggagaagtcttacttcaccttccaaactaggttaaatctccatctcaccccacccacctcacctcccaatttataggctcttatagcagtcttacctctcctttgtagcacttgtcagaagtataatttaagcttgtgtgatttgataataactagaatgtaagatttgtaacagcagaacccatttgtcaaggatttttacaccattgtatccccaaggcccaacaaagtacctggttcatagtagatgttcaataaatatgtatatgaacttctgaagttcttaacagcctatgaaaagtagactgagtttttaaaatgttgttacagataaactgttcttatagaatcactaatgctaccttagcactaaactctgtacaatcttttttccacctttggaaataagatagatttttttcaatgttgttggtgtatctaaagaagttttctcagattgtttaaatgaagatacgaggtaaagaggatatatgatggatcattcattcagtacagcctcccctgttcaggcaggtggatgtcagccttgataactgttctttcttttcttgtaggtttataccagagattctcttgtctattacaggttacaaagctcttttcttcttttttgaggagtcatatagttgaagaattaaagcagcatagtatgatggttaagggaattcagactaccactttctgaccttgggcagattcttttttttttttttttttttttttgagacagggtctcactctgttatccaggcaagagtgcagtggtgtgatcatagctcgctgcagcctcaaactcctgggctccagggatcctcccacctcagcctcctgagaatactgggactacaggtgtgagtcaccatacctggataattttctcttgtgttttttgtagagacaggctctcatgatgttgcccaggctggtctcgaacctctggcctcaagccatgctgtcacctcggtctcccaaagtgctgacattacaggggtgagccaccatgcctggcttcaaaaaatgtgtttggtatttgatatttgatgttaacttacatcaacggttttttttaaagtgatctataggtatttatctttttctaccttcattttttattccagtaactaaagctcagattccagatctatcagtatttaaattcccataatgcctctaaagcctgagttaactttaaggctattaactggatatttaagcatctgtttaaatattgatttagtatgcttgtagaattgtattttattatttttgataatataggctgtatttgtttgctaaggttgccgtaacaaagtaccacagactgagcggcttaaacgagagaaatttcttttctcacacttctggaggctggaagtttgagatcaaggtgctagcagggttggttttttcaaggcctctctccttggcttgtaggtggccgtcttctcccagtgacttcacagtctgtccatacatgtatgtccaaatatcttcttcttataaggaaaccatttttatgggatctgggccccctctcatgacttcatttcaccttaattagctttttaaagaccctatctccaaatacagtcatgttctgagatactgtggggttaggacttcaacatacgaatgttgggggatacaattcagcccatagacaggttataattgttttatgtataactgaagctgaatttctctacattcttatgtttaccttaggcttgcttgttgccagtaactgtttcttttctaggagcatatcagcgcttcccactgtagttgcctataacaatcgagctcaagcagaaatcaaattacagaactggaatagtgcttttcaggattgtgaaaaggtcttggagttagaacctggaaacgtaaagggtaaaaaatattatagaattcttttacatttacagcaggatccattaataaagaccatttgtagatacttgtaatgtttacattaaaaatatttcagataaactcaaatttctgtatgtgaatcaccaacttcataaagttgcttttaaattgaacttgtaagttaagctcctgattatttgtactgaagtagctaataatcccagaggatttaataaaatacatatatattttaaagaagtatctcaataaacaaaaaaccaacaacaacaaaaataaaataaaagagaagtatcttggccaggcacagtggctcacacctataatcccaaaattttgggaggccgaggtgagacgattgcttgagtctaggagtttgagaccagcctgggcaacacagcaaaactctgtgtctcaaaaaaaaaactcaagcttgcatttgaacattctttttctccaaaaaaaattaagtataacttaatatagattttctggtatttataaatataataaaataataagcccacactggacctctagaaccttctcccagcttctttgtggatatttgcacctaggtggctatatataattttgtttgtttgtatgtttgtttttttgagactgagtctcattctgtcacccaggctggagtgcagtggcgtgatctcggctcactgcaacctctgcctcctggattcaagtggttctcctgcctcagcctcccaagtagctgggactataggcgtgcaccaccacgcctgactaattgttgtatttttagtagagagacggggtttcaccatgttggccaggctggtcttgaactcctgacctcaggtgatccacctgcttcagcctcctaaagtgctgggattacaggcgtgagctactgctcccagcctgtttttgtttttttgagatagggtctcactctgtcacccagcctggtgtgcagtggtgcaatcttggcttactgcaacctccacttcccagtctcaagtgatcctcccacctcagcctaccaagtagctgggactacaagcacgtgccaccacacccagctaattttgtttgtatttcttgtaaagatggggtttcactatgtcgcccaggctggtctcaaactcctgagctcaagtgatctgcccacctcgacctcccaaagtgctgggattacaggcatgagccaccaagcctggcctgctataaataatttaattttcattttaaattaataatttgaataacttaattctaaattaaatttgtccaaaactgactctttctgccaaaaacctgcactctattttgattccctgtccctctgactgaccaccttgtcatggttcaggcctgaaatatgcaaatcagactctattctccttttctgttatcaagaaggagtcattccaagagggagtgacatacattataatagacacattatatttctttaaatttttatggattcaaataaatataaacacttttttcacatggaatgtatccctttttgcctataaacatggtggaggtggcagaagccatgggagtgctaaggggaagcctggtgcatcacctgccactgtcattgccatggattgccctccatttaccaataaagtcctgttgggcctgtgttttacgcaagctggtctctgtcacagagtatggctgggctcccagctttaggcagcagcccactgaaggttttgccaaccccataccactgctctgccaggccccgtgccaagcactttacatgtattaactctgttaattttaacaaaactctcggccgggcttagtggttcatgtctgtaatcccagcactttgggaggccgaggtgggcagatcacctgaggttaggagttcgagaccagcctggcaaacatggcaaaactccatctctactaaaaattaaaaaaaaaaaaaaaatggaggggtgcagtggctcatgcttgtaatcccagcactttgggaggctgaggtgggtggatcacttgaggccaggagttcgagaccagcctggccaatgtggcgaaactccatctctactaaaaacacaaaaaattagctgggcatggtggcaggcacctgtaatcccaacaacttgggaggctgaggcaggagaatcactggaacccaggaggcagaggttgcagtgagctgagatcacgccactgcactccagcctgggcgacagaacgagaatccatctcaaaaaaaaccataataaattttaaaaaaaattactagacatggtggtgggcacctgtagtcccagctacttgggaggccgaggcaggagaattgcttgaacctgggaggcagaggttgtactgagctgagatcacgccactgcacttcagcctaggggacaaagaaagactctgtttcaaaaaaaataaataaatacagaatatgttagcattaggtaaagctgagttaagggacacaggaactcattgtactatctctgcaacttttctgtaaatctccaatgattccaaaataaaaagttttaaaaaaggataatcattatgtcatgaatatttcttcatagaaattcccttcagaaatctgtgtagcaatagcaatagctaaattatatttaaagtgcagtgctacaattttaattaaatttataacaaaatgatttctcatttagattttcatagctcattctaacactaaaattcaaattggtcaaatttataattatgttttaaaatagcatattaaaatatgtcagataaaatttctaacttttcaggcaggcgcggtggctcatgcctgtaatcccagcactttgggaggttggggcaggcggatcacgaggtcaggagatcgagaccatcctggctaacacggtgaaaccccgtctctactaaaaataccaaaaaaaattagctggatgtggtggcatgagcctgtagtcccagctacttgggaggctgaggcaggagaatcgcttgaacccgggaggcagaggttgcagtgagccgagattgtgccactgcactccagcatgggcaacagagcaagactctgtctcaaaaaaaaaaaaaaaaaaattctcacttttcagaattaccaaacttgattctttttcaaagtaatgacttattacacaaagttctccttatataatagttaatgatgagtactagagaggcattcattgtcagtattaaataattaccaaattatacattgaaacgtacccaaaaaatcaaatgcgaattatcaaagtgcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctaccatgccaagctaattttttttttgtatttttagtagagatgggattttgccatgttggccaggctggtcttgaactcctggcctcaagtgatctgcccacctcaggcccccaaattgttgggattacaggtgtgagccactgtgcctagccaatatactaaattttgataagggattttatgttttcaaaaagtggctaaataatactcgccataattataaaaaggaaaggattattatcagtgaaaatcattccgatattgcaatacaatgtgttgcctgtgaagggttgaggtatgaaatctcttagttcttggaaaagctggcggggcctggggctgccagagggccagagggttgttatagaggggacagctggctgatgtagcctcttttatgtacctcagtgtcatctcctatgtgtgtatcaacatgaaaaagggtgtagttgagctttgggtaattacatcctaaagtattctgtgctgctcatatcttccacttgccaaatatgttgtaaccataatgccacatattaaaaaacataacttttatattggtaaattttcagctcttctgcgtcgtgctactacatataaacatcaaaacaagctccgggaagctacagaagatttgagtaaagtactagatgttgagcctgataatgatttggccaaggtaagtatagaatgtgatttctcacctaattctgtagttggctgtttctgtatttattttaaagtggtatcaatcttgccaaacaaattatgttgaagatcaggtcacagctttaaaaggtaggtatattccagacaccccaaaacgttaacatctatttcaagtggaagaaagcagaatcttaaaattttttttcaaaactataaaccttcctctgaaagacaaatatcaatttttctttttcctatagtgttgtaggcaatgtttttctctgagccatgtggagtggtatagaaggtaccttcctaggtaggattaggggtgaactctgtggccattgaagagtgtttctctttgtaatgagcatggtagcatttgctacctgactgagcagactgactcagttatacacttaggggatctgtattcacgcctaaagagtagaggtaagtgtcaagaactgagattttcccctgcttacaaatgaacaaggtggcctaccagaggatacaagatatcctgagtcaaacacgaaaagactttgtcactccaagcagatgagcttcacgttcatgtcagttccccttgctcccaagtcccacaggggtgacacagagtggcccagatggatgttgcacactcaatggatttatgtgatggctgacaaatcaaaaatttaggaaaccagctgagtgcagtggctcacgtctgtaatcccagctctttgggaggctgaggcaggcaaatcacctgaggtcaggagttcaagaccagcctggccaacactgcactccaactggggcaacagagtgagactccatctcaaacaaacaaaaatttaggaaacctgcttcttttatgatgggatataagcaaacctgcccaatctctgctccatagggaagcatcacctttattacactggagggccaacacacctgccctctccgctgcagatgaatactatttctgtttgccaaggttgttctcagtacaaacatccttagagatgtccagaaagaaggtggtttagtgcctctgctggcagtatagtcagaaataagagaaacccatggaaaaattgttactaagtttccacatacacctattgggttacctatcccactgtctctgagtggcagctaatgttcctagaatatcagctgctttgtcaagtcaacattttaggtttaggtttagggcctggcttagtatttcctttttgtaatggttatgtttatttatttttgagacagggccttgctctgatgcctcagctgtagtgtggtgggaacatggctcactgcagcctccacctcctaggctcaagcaatcctgccatctcagcctcctgtgtagctgagaccacaggtgcacgccacctcccaaagtgctaggattacaggcatgagccattgtgcctggtttcaaatgcatttttatcttaaccatatgcaaagattaactcaaaatggatcatatactttttgatgtaagatataaaatataaaagttctagaagaaaacataggagaaaatctttatgaccttagacaaatatttcttatgtaagacatgaaaagtacaatccataaaagaaaaagttgatatattggacttcatcaaaatttaaaacatatacttttcaaagacactattagaagaataaaagacaagccacagctgggcacggtggctcacacctgtaatccaagcacttcaggaggctgaggcaggcagatcacttgatcccaggagtttaagaccagcctgggcaagacagctgaacttcatctccacaaaaaatttaaaaagttagccagacatggtggtgtgggcctgtagtcctagctactcgggaggcaggggtgggaggataatttgagcccgggaggtcaaggctgcagtgagctgtgattgcaccactgtactccagccggggcagcagagggaaaccctgtctcagaaacaacaacaccaccaacaacaaaacaaaacaaacaaaaaagccacagaccacagactgggagaaaatatttgaaaatcgtatatccaacaaaggatgatatatctatttttcatcagagtcagcataaaatatttcagaattttcagcattactctaaaacagtaatgtgggctgggtgtggtagctcacgcctgtaatcccagaacttcaggaggctgaggtgagaggattgcttgatcccacggtttgagactagactgggcaacatagtgagacctcatctctatattttaaataaacagcgtatgtagcatgatttcatttgtgtaaaactgtacatctctgtgggtatatatgcatagaaacatctagaaagatgattatcaaaatgttaatagtagtatctgaatggcaagattttaggtgattttttctttattttttatacttgttacaccgctttttgtgtgtgtgtgtgttttttttacagtggacatctatgattacaatcaaaggccaccaaaaaaaagccttgtcttagttgtattcatttttcaacatctttatgtttttaacctgaaagaatggttatatttattattagaggaaaatattttctttaatatggtaattatgttgcagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagagtaaaatattttttctatttaggttatgtaaaaagctgccttttaatatgatgagctggctcaatttttctattcgtacagaaattcgtaatctatcagtttttctagctttgccttgtaaattcacaagccagtttcgctcatctttttcttaatacagcttggtagaatctctcaaacccattttccttcttaacctgtcacctttttctagtgctcagtttaattcctggtcatcacctttaaatgtaaatggctgtgtttatttgacacagaccatttgccagttaactttaaatatctctctttgataattgttttgtatatatctacttgattgcaaacaaatgtgttggtttcaaaacaggtatgggtagccccatttatatgccaaaaatgaacgtattactagaaaattgctatgtgtgtttttcaaaaatattttaaatatgcaaaagaaataagtataatttaacacttgaaacaatattttaagagaatctagactagataaagggttatcttcataatataaaacatcgaaagttatgtcaactttgaggggaaagatttgcctcctcacatgacaagggacataaaaacttttccctccgtcagctgggcgcggtggctcacacctataatcccagcattttgggaggccgaggcgggtgcatcatgaggtcaggagttcaagaccagcctggccaacatggtgaaaccctgtctctactccaaatacaaaaattagctgggtgtgatggcatgcacctgtaaccccagttactcaggaggctgaggcaggagagtggcttaaacccgggaggcggaggttgtggtgagccaagatggtgccattgcactccagcctgggcaatagagcgagactccatctcaaaaaaaaaaaaaagaaaaagaaaaaaaggtttttccctccttcttgagaacacctgagcaactggcagtggcggggcagtggaggggggagatattatcaattttgaaaatcattcacaagtaaaaatcaacttgtaagtaatttgacagaatattctaattttgagagagatacaaaatgttcagttcattcaattttaaaaataaagaacgagttttaatttttttaagtgacaaaaaataatgcaatgtatacacttcagattaaaatacaatcagttaagactggataaagacaaaggaacagaaagggagggagcgagaaagaggaagacaatcagagaggtgagaaggaagagagaacataaaaaggattgaaaagggagaaattaaggtaaccagtttttcaaggattcaggcttgccttttagccagattgtaaatacgatctggcagcaaatcttcttagggtttatattgagcttttgcataattaaccatatgtcttacagttaaaggaaaccattttaaatcttatctgaagtgagatgaagtataaactatattacttcctattattttaaaattgttattttaaaattttatatatagtaaaaatgaaccttttgaatatacagttctaatacatgtacggtttcatgtaaccatcaccatagtcaggatacagaacagttctaccacccaaaaaggccttcttgctgtcctttcagtgaaacccttccctcaccccagctcttctctattcctatagctttaccttttccagaatgtcctataaatggaactggaaagtatgtcaccttttgagtctagcttccttcacttagcatgtcactgagattcattcatgtagctgcatgtatcattgtctcattcctttttactgctgagtagcattccattaatagttgtaccaaagtttatacattcggttattcaaggacattcaggttatttccagtattcactaatcatgagtaaaaactgctatacacactcatttgcaggtttttgtgtaaacatatgttttcatttcccctgagtaaatagctaagagtgggactgctgggtcatacggcaagtatatgtttaactttattggaagttgcctgactgttttccagagtggctataccattttgcattgccattagtaacatatgagagttctagatgcttctcgtccttgccagcatttggtattgatttttttcccctttttacccattctattaggtgtatagtggtttctcatcagttttaatttgcattttcctgatgagaatctttttatgtgctcatttaccatctctatattactttttgtgaagtgtctcttcaaattattccaccaattttcaaaaattgggttgttgttttcctactgttaagtcctgagaattctttttataatcttgatgcaaagtcttaaaatttttttgtctgtagcttttttcattcttttaacagtcttttacagagcaaaggtttttcattttgtagaagtacaatttatccagtttttttaatggactgtgcttttaatgttatatcgatgaacactttgcctaagtcaaagtcatgaagattttcttgtaagtttttctttttcagagatagggtcttgctctgttgttcgggctagagtgcagaggtgtgatcatggctcactacagctatgatcactctttattattttcttccttctgcttgtttttatgttcatttgcttctctttttcttttcttctttttgagatggagtctcgccatttcgcccaggctggattcaagctcctgggccaaagattctcccacctcaggctcccgagtaaatgggactataggcacaccaccgcactcagcttgctcctctttttctaagatagtttctcaagacagaagcttggaatatttatttgagaatttctcctccaaatataagcagtggatgctataagtttctttctgatagaaagaatataatttttaagccaggcacagtggcatgcactcatagtcccagggagctcaggaggctgagggttgcttaaggccagaagttcaatcccagcctgggcaacataacgagaccccatctttttttagaaaaataatataatagaaattttaagaccagtaagttcccttttatcagaaaagtcaattgagatgaagtagaataaatagccggaaactcagacataatcttttcatcttaaaatgaaatgaaatcaattgaactagtttacattcacctctagttacattgaactagttacattcaaacaagttacatatcaaacagtcattgtttgatagagtgtgaaaagaggtgctggagccttggacacaagagaagcaaccccagtcacttttaggaaaatcatgttaaagcccagaggaaagttatcaagttggaatctttacatgtggttctccatctcatcacattccgggaaagaattcccagtcattatggggtatgttccaggaccatggaaaaaggcagcaatttgtgttttttaaccttgtctggtaatgctgtccctttatgatctccactcgggttggccaggcccagttcatcccgactggggtataacataactgatgaatttaatttaacaactgacaattattgagcacctactctgtgtcaggtgctgagataagacaattgataggctttctttgcctctccttctaagggccagtattaacaaattgcctattggccaggatgattacacctggggatttgagttcatgggctttttcctggaagctccctatctgtttgccttctctagtagagatcatttagaaggaagaagtggccattaccatacagctgtagctgtcaaagagtttggtatttattccatctatctccttacagagacgcaatcagaggaaagtgagcatctaccctcccttgcagtgctgttggtgttgctacttaaaaatgaaagctaagaaaattaaagtcactcacaaacagaagaataaatatagatcagtatttctcttgtgctagaactggcaggatcaggagagtggaagtcagggatttccaggagttcaaacaatcaacaaaatcataaaggtgaataattttgattatgtgaaaatgaaaaacgtgtatgttaggcgccataaaaaaaactaaaagacaaatgacaaactaggaaagatggcaaagggttgataaccttataatatgaaaagtttctacaaaacaataagaaaaagatgaggtgctagtacaaaactgggcgaagcatacagacaaatcactaatgaagaaatagaaatgatcagtaatctttgtattactcataaaaatgaaaatcaaatattctttttctttcctatcaaattggctgagatagaaaaaatagtaccctttgttgtcaaaagtgaggtaagataagcattaaaaatattttaatataatgcatatatagtaaaatccatccttttcaaattcagtgaattttagtatattcatgaagttgtacaactatcaccacgatctaatttcagaacatttttatcatccccaaaagaaattctatacccattggcagttactgcccattttacccttcccctggcccctggcaaccactagtctacttttgtttgtatggatttgcctatcttgagtatttcatacaaatggaatcatagtatgtagacttttgtatctgtctttcacttaatgttttcaaggttcatctatgttgcatcttgcattagtacttcattcctttttatgtagaaataatattccattgtgtagataataccagattttctttattcaccagttgatggacctttgggttgtttccactttttggctattatgaataatgctgtcatgaacgctcatgtacagatttttgtttgaacagatgttttagattttcttgtgcattattttggagtggaattgctggatgatatactaactctgtgtttaactttgaggaaatgcagactgttttccaaagtagctatcccattttacattcccacctgcaataagggttccaatttctttacatatttgccagcacttgttattgtctgcctttttggctatagccatcttaatgggcatgtagtggtaactccttacggttttaatttgcattttcctaagaactaattatgttgactgtctcttcaatccctatgggctatttctatatcctctttggagaaatgtctattcaagttctttgccttttttttgttgttgttgttgagatggattttcactcttgttgcccaggctggagtgcaatggcatgatcttggctcactacaacctccgcctcccaggttcaagcaattctcctgcctcagcctcccgagtagctgggattacaggctcccaccaccatgcccagctaattttttgtatttttagtagagatggagtttcatcatgttggccaggctggtcttgaacccctgacctcaggtgatccacctgccttggcctcccaaagtgctgggattacagatgtgagccactgcgctcagcctctttgcccatttttaattgggttatttatctttttactgttgagttgtaagcattttttatatattctagatactagacccttattaaatatgatttgcaaatacttttcccattctgtgggctatcttttaagttttttgataatttcctttgatgcagaagttttttgttttttttttagggtgcagcaactcattttgacttttttttttattatactttaagttctagggtatatgtgcacaacgtgcaggtttgttacatatgtatacatgtgccatgttggtgtgctgcacccattaacttgtcatttacattaggtatatctcctaatgctatccctcccctcactccaaccccatgacaggccccggtgtgtgatgttcctcttcctgtgtccaagtgttctcattgttcaattcccacctatgagtgagaacatgcagtgtttggttttctgtccttgtgatagtttgctgagaatgatggtttccagcttcatccatgtccctacaaaggacatgaactcatccttttttatagctgcatagtattccatggggtatatgtgccacattttcttaatccagtctatcattgatggacatttgggttggttccaagtctttgctattgtgaatagtgccacaataaacatacgtgtgcatgtgtctttatagcagcatgatttataatcctttgagtatatccccagtaatgggatggctgggtcaaatggtatttctagttctagatccttgaggaatcgccacactgtcttccacaatggttgaactagtttacagtcccaccaacagtgtaaaagcgtttctatttctccacatcctctccagcacctgttgtttcctgactttttaatgattgccattctaactggtgtgagatggtatctcattgtggttttgatttgcatttctctgatggccagtgatgatgagcattttttcgtatgtctgttggctgcataaatgtcttcttttgaaaagtgtctgttcatatcctttgcccactttttgatggggttgtttttttcttgtaaatttgtttgagttctttgtagattctggatattagccccttgtcagatgagtagattgcaaaaattgtctcccattttgtaggttgcctgttcactctgttggtagtttcttttgctggatgcacaagttttaaatttttatatgaagtccaattttttttttcagagccccccttaagaaagatttttttcagattttttttcttttgttgcttgtacttttgatatcatatataagaatccattgtcaaatccaaggtttaaaaacttactcctgtgttttatttctttttccttccttccttccttccttcctttttttagacaaggtcttactctgttgcccagactgaaatgcagagtggcacaatcatagctcactgcagcctctaactcctgggctcaagtgatcctcctacctcagcctcccaggtagcctggactacaggcacatggcagcatccctgcctaattttttcatttttattttttgtagagacaggggtctcacttcgttactcagggtggtcttgaacccctgggctcaagacattctcccacctcagcctcccaaagtgctgggattacaggcatgagccactatgcctgggcaactcctgtgtttttctaagatttttatgattttagctcttgtatttaggttattgggttattgatccattttaattcttatatacagtgtgaggtaaatgtgtgtggtattacatatgtgtgtgtgtatatccatatatatatgttttttggtcatagttcctgatttatacaactcccatagcccttgttacagacttttgtcataatgctggctatctgaggcttcaggaaacaatctctccagatctcctttcaccttccccaaggcaggactctaatcttactctgcctttctgattgtgggtcagaagaccctccccagagagggtcctgccacatactctgagggaaggaatgctgacttcaaaaattttccttccgatagctgaacacagggaggttcctggaaggtgcctggccaccctaggcacctcttcctctgtaacccttgcagtatcctttgtaataagccattaaacatgttgtctggagttcagtgagctgctccagcaaattaattgaactcaaagagtgggggtcatgggaaccctaacttgaaacctgttggtgagaagttctggaggcccagacttgtaactggtgtctggagtaggagacagccttggggactaagccctcatcctgtggaatctgacactatctccaggtatatagcatcagaacttaactggaagatgctcagccagtatctgctgcttggtgcctggggataaaccctcacacatttggtcacagaagtcttctatgttgatgattattgtggtggtgtaagagtagaggaaaaacagtttgtgagagtttttccaaaagagcgtccaacttagttttgttttctgttttgtttttatttgtttttagtatgtggaaatccagttgtcacatcaccatttgtttaaaaaaaaaaacaaaaaacaaaacaaaaaaacctgttcttttcctactgaatagacttggcacccttgtcaagaatcaactggccaggccgggcgcggtggctcatgcctgtaatcccagcactttgggaggccgaggcgggcggatcacgaggtcaggagattgagaccatcctggctaacacggtgaaaccccgtctctactaaaaatacaaaaaattagccgggcgtggtagcgggcgcctgtagccccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaatcaactggccatagatgtatgggtttacttatcaactctcagttcctttccactggtctatgtgtctttccttatgccaataccacactgttttgattactctagcttttagtaagttttgaaatccagaagagtgagactgggtgcagtggctcatgcctgtaatactagcactttgggaggctgaggccagaagttcaaggctatattgagcctaccactgcactccagccttggcgtttgtgctggttaatactgagtgttaacttgattggattgaaggatacaaagtattgatcctgggtgtgtctgtgagggtattgctgaaagagattaacattaagtctggtgggcacaatctaatcagctgccagcaaatataagcaggcagaaaaacatgaaaggagagactggcctagcctcccagcagcctacatctttctcccgtgctgggtgcttcctgccctcgaacattagactccaatttcttcagtttcgagacttggactagctctccttgctcctcaagcttgcagacagcctattgtgggaccttgtgattgtgaaagttaatactgaataagcttgtatatatatatatctcctattagttctgtccctctagagaaacctgactagtatagattttagtacccggagtggttccagaggaacagactattaaggatgcagttctttcgttggttttggggtttctggagttggctacttaatatgattagacccaaaaatgctaaggactctacttctaatagtatggagaatactgatagtccttggtgtgaactgtttagagagttatgcaaaataaatgcatttgacacttctgattcatcactcatgagaggcaaggagtttagtaactctatacatagtacctttgaccatatgtggagaaccaaggaacataatgaagctggttggttgctcctaagttcagtggacaaagtagtgaaagaaaatgaactcagggattctgtctctcagcttcagaagcagatactgagcctcaaatctgccaagattgccctgagtgagagtcttatctcctgtagagaaagagctgaaattgtggaaaaacagacacaagctctcatcatgcgagtggctgacctgcaacaaaaggtgcgtgcacagccttgccaggtgtctaccgttaaaataagggcattgattagaaaagaatgggaccctacaacttggaatggggatgtgtaggaggaccttgatgaaactggggacactgaatttgtaaactctgatgaacctttcttttgccagaaggaacagattccccatacccagtagtggcaacatcccctccctgatccatgctgccatcagcctttccacctttgtctgaggagataaatcctgcactgcctgacgcaacagtgatggcctcccgagacagttgccaggcaagataatgttgattctcctcagaagccacccccaacaaccttgtttgcttctagacctataactagactaaagtcctgccagggacctctggccagcccctagaggtgaggttgagagtgtgacccataaggaggtgcgctacactcaaaaataactgtttgagttctctaatttatataaacagaaatctggagaacaggcatgggaatggatattaagggtgtgggataatggtggaaagaacatagagttggatcaggctgaatttattgatttgggcccatgaagtagggactctgcttttaatgttgcagcttggagagttaaaaaaaaaaaggttataatagattatttgcttggttagctgaattatggattaaaagatggcccactgtgagccagctggaaatgcctgatctcctttgggttaatatagaggaagggatccaaaggcttagggagattgggatggtgaactggattagtcactttagactgactcatcccagctgggagggtccagaagatatacccttgatgaatgccttgtaaaatagatttgtgaggggagcacctgcatctttgaagagccgtgtaattgctcttctctgtatgtcagacctaacagtggcaactgcagtcactcacctacaaaatttaaatacaatgggaataattggatcctgaggtggcaggagccaagtggtggcactcaaccatcaaaagcaaggtggacgtagctaccataatggacagtagaggcaaagcagcaatcagaatagtctgactcatgtagagctctggcattggctaattaatcacgatgttcctagaagtgaaattgataggaagcctactgcattcctacttaatttatacaagcagaaaacttctaggtcaaatggacaaaagactaatttgaattataaaaacagagaatcatggcttttcaattaatttccagacttgagccagtttgcagacccagaaccccttgaatgaagtggagtctgggtccccttgaggaaggaccccactacagtaccaacaatttatgcagtgaatctttctcccatccttccccaaggagacctctggccttttaccagggtaacttgcactggggaaagggaaatgacatttcagggactactggacactgcctctgagctgatactgattccaggagacccaaaacatcattgcggtcctccaggtaaagtatggacttagggagttcaggtaattaatggagttttagctcaggacttacagcgggttcagtgggtccccggactcatcctgtggtcatttccccagtgccagaatgcataattggcatagacatacttagcagctggcagaacccccacattagctccctgactggtagggtgaaggctgttatggtgggaaaggccaaatggaagccactagagctgcctctacctagaaaaatattaaatcataaataatatcgcatccctggagggactgcagagattagtgccaccatcaaggacttaaaagatgtagggatagggctggctgggcatggtggttcacgcctgtaatcccagcactttgggaggccgaggcgggcagatcacgaggtcaagagatcgagaccatcctgggcaacatggtgaaaccccgtctctactaaaaatacaaaaaaaaattagctggacatggtggtgcatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtggggcatgcctgtagtcccagctactcaggaggttgaggcaggaaaactgctttaacctgggaggcaaaggttgcagtgagccgagatcatgccactgcactccagcctggcgacagagtgagactctgtctcaaaaaagtgagaaaaaatctcaaaaaaaaaaaaaaaaagaaagatgcaggggtggtgagtcccatcacattcccattcaacttccccatttggcctgtgcagaagaccgatggatcttggagcataacagtggattattgtaagcttaaccaagtggtgactccaattgcagctgctgtaccagatatggtttcattgcttgagcaaattaacacatctcctggtacctggtatgcagccactgacttggcaaatgtctttttctccattcctgtccataaggcccaccagaagcaatctgccgtcagctggcaaggttaccaatatacctttactgtcctacctcaggggtatatcaactctgcggctttgtgtcatagtcttattcggaaagaccttgattgctttttgctttggcaagatatcacactggtacattatattgatgacgttatgctgactggacctagcgagcaagaagtagcaaacacactggacttattggtgagacatttgcatgcaagaggatgggaaataaatccaactaaaattcagggaccttctacctcagtaaaatttcctgggttccggtggtatggggcctgtcgagatattccttctaaggtgaagcaagatattccttctaaggtgaaggaagatattccttctaaggtgaaggggcctttggcccctcctacaaccaagaaagagacacaatgcctggtgtcacaaggcctatttggattttcgaggcaacacattcttcatttgggtgtgttactccagcccatttatcgagtgacctgaaaggcggctgattttgagcagggtccagaacaggagaaggctctgccacaggtccaagctgctgtgcaagctgctctgccacttgggccatatgacctagcagatccaatggtgcttgaggtgtcagtggcagatagggatgccgtttggagcctttggcaggcccccatagatgaatcacagtggaggcctctaggattttggagcaaggccctgccatcttctgcagataactgctttcctcttgagacagctcttggcctgttactgggctttggtggaaactgaacatttgactatgggtcatcaagtcaccatgcaacctgaactgcctatcatgaactgagtgctttctgacccatctagccataaggtaggttgtgcacagcagccttccatcatcaaatggaagtggtctatatgtgatcaggctcaagcaggttctgaaggcacaaataagttacatgaggaggtggctcaaatgcccatggtctccactcctgccaccttgccttctctcccccagcctgcaccgatggcctcctggggagtttcctgtgatcagttgacagactaagagaagactagggcctggttcactgatggttctacacgatatgcaggcatcacccaaaagtggacagctacagcactacagcccctttccaggacatccctgaaggacagcagtgaagggaaatcttcccagtgggcagaacttcaagcagtgcacctggtggtacactttgcatagaaggagaaatggccagatgtgtgattatacactgattcatgggttgtagccaatggtttggctggatggtcagggacttggaagaagcacccaatgcttctgccaggactaccatccatggactcatggaatgccttatccgccatcatgttattccacacggcattgcctttgaccaaggcactcactttatggctaaagaagtgtggcagtgggctcatactcatggaattcactggtcttaccatattctccatcatcctgaagcagctgaattgatagaatggtagaatggccttttgaagtcacaattacaaaatcaactaggtgacaatactttgcagggctggggcaaagttctccagaaggccgtgtatactctgaatcagtgtccaatatatggtactcttccccccatagccaggattcatgggtccaggaatcaaggggtggaagtggaagtggtaccactcaccatcacccctagcaatccactagcaaaattattgcttcctgttcttgtgacattacgttctgctggcctagaggtcttagttccagagggaggaatgctgccacaaggagacacaacaatgatcctgttaaactggaagttaagattgccacctggacactttgtgctcctcctacctttaagtcaactggctaagaatggagtcacagtgttggctgggtgattgacccggactctcaagacaaaatcagtctactccacaatggaggtaagtaagagtatgcatggaatgcaggagatccatgagggcgtgttttagtattaccatgccctctgattaaggtcaatgggaaattacaatagcccaacccagccaggactacaaatggcccagacccttcaggaatgaaagtttggatcactccatcaggaaaaaaaaccacgacctgccgaggtgcttgctgaaggcaaagggaatatagaatgggtagtagaagaaggtagtcatcaataccagctatgaccacgtgaccagctgcagaaacggggactgtaattgtcatgagtattttctccttttgttaaaaacatgtttgtgcatgtatacatttgtactaagaaatgtcttcattttatttcctttttcctttatcatgtgacataagatttattgacttcatatcagcatttaagtattaactttatattatagtatttgggttggggattggtgcatttctggttgtacaaaggatagttgtattatgttaggtgtaattatgaccttattattgtctttatttgaagattatgtataatctcaggaaatgtatatgggttcaaattgacaaggggtggttgaaatggttaatactgagtgtcaacttcattggattgaaggatacaaagtattgatcctgggtgtgtctgtcagggtgttgccaaaggagattaacatttgagtcagtgggctggggaaggcagatccacccttaatctggtgggcacactctaatcagctgccagcgaatataaagcagacagaaaaacatgaaaaggagagactggcctagcctcccagcctacatctttctcctgtgctgggtgattcctgcccttgaacatcacactccaagttcttcattgttgagacttggactggctctccttgcacctcaagcttgtagacagcctattgtgggaccttgtgatcatgtaagttaatactgaataaactcccctttatatacatatatatatatatattcctactatatatataatcctactaatatatatattatatatcctattaattctgtccctctagagagaaccctgactaatatatcattagagtgagaccctgtctcaaaaaaaaaaaaagaagaagaaaagagagtcctttgattttgctctattttttcaggatctttttggctattctgaactccttacaatattgtatgaatttaaggattgtcttttccatttctgcaaaaagttttgataggattgtgttgcatctgtagattgctttgagtagtattaacattttaaccttaataacaatgtctccctatgattacaggatatatttccatttattcaagtcttttaaaaaatttcttaaagcaatacttttatctccttggttaaatttattcctaggtattttattcttttggatgctattataaatataattgtttccttgatttcctttttgctctgttcattgctagtgtatagaaacactgattttggcttgttgatcttataccctacaacttagctaaatttgtttattgctctagttttttttggtgggggtggtgaagggggtggattctttttttttaatataaataggatcatataattatgaatagagatacttttactttctttccaatttggatgccttttatttcattttagtgcctaattgatcagtctacaacttttagtacagtgttgaatagccgtggtgaaaatgggcatccttgtcttgttgctgatgtttaagggaaagctttcattacttttatctttgaatatgatgttggctctgggtttttcataaatatactttattatgttgaggaatttcacttctattcctagttttctgagttttttttttttttaaatcatgaaagcatgttggattttgtcatgccttttcagcatcaattgtgggatcatgtatgcaattctttactttttctgttaatgaggtgtgttggcattgattgattttctaatgctgaactacctttgtattcctgggataaatcccacttggccatggtgtataatccattcagtatgctgttgaatctgttcgctagtattttgctgaggatttttggtctatcaactactcacactaccctacttgaggctacactgttggccattcattcctttgatagttgttattgttgactcctttcttcccaaactactcttggtgtttctgaggcagtatgcgctcctgtttttttctctcatttctaggcatttctgtgcctacactgtagatttttcctctcttcatcctttaagtgttagtatatctcagggatccttatgagcctttgagtgatcccatccacatccaaacttttatttttattttttgtagagatggagtcttgctatgttgcccaggcttgcttcaaactagtggcctcaagcaatcctcctgcctcagcctgccagagtgctaggattataggggtgagccaccttgccagttccacacccaaacttttttttttttttgagatggagttttgccctgttgcccagggtggagtgcaatggtgtgatcttggctcactgcaacctccacctcccggggtccaaatgattctcctgcctcagccttttgagtagctgggattacaggcacctgataccatgcccagctaatttttgtatttttagtagagacagggttcaccatgttggccagggtggtctcgaactcctgaccttgtgatctgcctgcctcagcttcctaaagtgctgggattacaggcatgagccaccgtgcccggccccaaacttttatatattagtaactcccaagtcactgtctctggataaggccacttctctgatctacatgtagacgccaccctctgaacagctccattgcattgtcccacgggtatcccaacacccaacagaactcacaagtctttcatgtttgggcctctgtttacctgtccagagactatcaaagttgttcagagccatttcaatcttaaggtaagaatagctttgcattcagttcaaatctgggttatggctgggcacagtggctcatgcctgcaatcccaggactttggaaggccaaggagagaggactgcttgagaccaggactttgagaccatcctggacaacatagcaaggcctcatctgtataaaaaattttaaacattagccaggcatggtggctggctctcacctgtagtcccagctgctctggaagctaaggggaggattgcctgccccagaggttgaggctgcagtgagctatgatggcaccattgcactccaccctgggcaatagagcaagaccctgtgtcaaaataaatacaaacaaataataaaaataaaaacaagtccgagttatgctggcttctagctctgtgtactagagcgcattccttagcttcttgtttctctgttgcctcatttgtaaagtgggaatgataatacttggtattaggattaatgtgatccatatcaagttctaaatgaactgcagctctttagtgatagcattggtcagacccgaggggatactgtgcaaaggggtggaaagtaataccaagctgaccattgtttctgccgaccctgacttttgtgctttcacccagtttctggtggagaacctgattgacagaaaccagattaaaactggagccttactctaataaccctactgggtttaatctgcagatttatctttatagcaaaatctttttattgttttaataattaagatccctttggctggtgatccaaattggatgttattctgctgtatagaaaacagtatttattaatgtgtttttatacttgatgcttgtcttaaggtgatcatccactgattttcacttaaataattgtgcttttctattccctctgtctctgtgcttaaaatcttggctttaccattcatgaaaaagaatggaaaatatatccattaagaatcagataagaattcgttaaaagagaaagcttggaaatctctatatttaagtactttttaacggtgctgtgaaatgattaattgctttgttttaaatattgctaagacaccataaattaaatatttacacatcctttttatatttaaaaacagattcaacaattattaaagctattaatacctgaactcctaatcaaaatcaaagaaatttttagtttgaataaggcaatgggatggaaaatttgctgtgtttttaaggctccctttaagtttaaaaactaggtgcctaatttgtgacttttttgctaaattcacttttaaaatgacttaaaaatcacttacgctttatttttctttcaaatctttttctcctaatcttttaaaataaggaaaggtgcctccgtgttgggtattataattgtattcaagtttttgcaactccattcaaaaaagtacgtattttgtaagctcacctggacaggtggacttgatgaaggggatggctctgagatgccggttttcagccacaggcccttcagcgcttaaacagttagagacagggtacgtttctggccgaaacccgggagccgagtcctcaggaagccgcagggggcctcgagggagcggactgggccgactggctctagaggtccggcagcacaggctccgcccgcaggggcggtgcccgagccggcttccctagagcccgccctccgcgtcctgcacccccgcggcctccgcggcctccgcggcaactgctcccggtgatgcaaaccctcacttcccgcatccacttcctcacagagcccgcggagccggcgggagccgcgcgcgccgcccagccgtgcgtcatgggcaacatccagaagaagctgactggcaaagccgaaggcggcaagcggccggcaaggggcgcgccgcagcggggccagaccccggaggccggcgcggacaagcggagcccacggcgggcctctgcggcggcggcggcgggcggcggcgccaccgggcatccgggcggcgggcagggcgcggagaaccctgccggcctgaagagccagggcaacgagctgttccgaagcgggcagttcgccgaggcggccggcaagtactcggcggcaatcgcgctcctggagccagcaggtaggtgcgccgcgccccgccgcttcctgggcccctcgcgctgcggttcacccgacctccggggcccccgtgggagaggcgctgccgcctcctgaatgacaggcgccggcatcgctgcattcctcccaggtgactaagagcgccgtgccacctgacctcagtgagcagcacctgggaatgccggcatgttcccggccaggcacgtttgcctccgtccccgccgggttttcccttggtggctgttgcgggtagcagctccgtggagttctgcatgatcagtctgcaggactgcagtgccaccccaccggagacctcggccgtcttgtaattctggtgaactgtgatcttgctaatggattttaactgtatttaattaaatgtgatttttaggaagtgaaattgcagatgatctaagtatcttatattcaaatagagcagcatgttacctaaaagaaggaaactgcagtggctgcattcaagattgtaacaggtaaactgcacgttttcaggtttgtcaagagattgttataatttcattatggtgaatgcaatatccaagatcctaaattttctgcctaaggatctaatttcttaagagctttatggtatgttaattgattgatgcataaaaatcataaattatcttacgtatatgaagagagttatagaagattgtgcaaacttttttcatttccactgctaccgccctaattcgtgctcttttcatatcactcctagactactggagaagcctgataactaattccaatccactgcggcatcagagtaactttcctgaaacattattttgttcagattgtttccaacaggcctttaatggctcagtattggcttcgaaataactgtaaacttctctgtcactacactgcctccaagcaagtttctccttccgtttggtctactggaccacttgcttactctcgcccaccttgttctctgagcccttgcccatgttgcccctaatggtggtaatgccctttgcacatcttatcttctgaagttcttgctcagctgccccttctctctaccttcttgggtgccctagacttcctggtcatctgcaggcctgtaacacctacactgacactcggtcacacctctaagtcctgttatccactgaagggggtttaaacacatcgaggttaggaaccatgtcttttcttttttaatagacaaataatcactgtacatatttatggggtaccgagtgatgcttcgatatatatgatgtggccaggcacagtggctcatggccaggcacagtggctcacgcctgtaatcccagcattttggcaggccaaggtgggtggattgcttgaggtcagtttgagaccgtcctggccaacatgatgaaagctagtctctactaaaaatacaaaaattagctgggcctggtggcatacccttgtagtctcagctactcgggaggctgaagcaggaaaattgcttgaacctgggaggcagatgtttcagtgagcagagatgccacccctgcagtccagcgtgggcaacagacaagagactctgtaaacttttctcatatatatatatatatatatatatatatatatatatatatatatatatatatatatatatatgaaactatgtatcattgttaactatagtcatcctacagtgctatagaacactagaacatgtgcctcctatctagctgtaattttatatcctttaacaaatctgtgcctgtccccctcttccccctaccctttccatcctctggtgtgctctgaggaaccctgtcttatacagcttcgtacccctcgaagcataatagtcacccgtggtactcaataagttacctgcctggatggtaaatagctacataaataaaacattgttttccaccatgaagtaataagaagccctttggcaagaagctactattagtacatctaaaaaagaagaagtcatgtcctagtttgactaacacagctctggcttactcctgttgtctcatataacactctcagaaactctagtttgaacagtaaattatgtggacactgtttataaggtgagtaatgtattattgttttcattggctgtatcagtttattttgtttttttgttttgttttgtttttgagacagagtctcgctctgttgcccaggcgccatctcggctcactgcaagctccgcctcctgggttcaccccattctcctgcctcagcctggagagtagctgggactgcaggcgcccgccaccatgcccggctaattttttgtatttttagtagagacggggtttcacagtgttagccagaatggccttgatctcctgacctcgtgatccacccgcctcggcctcccaaagtgctgggattacaggcgtgagccaccgcgcccggcccagtttattgatatgggtaaagcttgctagtatctgtgcctaagtttaaaaagaaggccttgaggcacttgaatttttttgccagttttacatatttaaatttgaagtgaataatacttatattctctttggcctgacatcagaccgcatcctcagttgtgctggctcacactcgctaatcattacatttttcaggattttgtgagctggttgatgtcaagttgatattttgaaatctgccatggtgggataccatttaataccatgaaatgagcaaatgccacaaatctgggcttcccacccctccttttttctttacccagagagccagttgttaagggcttttaccagtgctcctaacagaccagaccatgtgaatttgttggataccaagcccgtggtgatttgcagccaacatcctttcagctcaagtgtctgtttctaatccattacccttcagacttgttttaggcctttccacagtgagggaggtcaggacactttagttaaaacttgagacccctaacattagagctgctgcaaaagagtggatttgtgttgtccttatctgagatcctctaaggtgattaacatttactggctaaaattggctgtgtttcagtgtagacagaggagaaagtcaagtatgggactccagccatggtgtccagggtggctagagtaggggcttgtccaaggggagggcaggagatggctcaccagagagggaagtgggcgtcggtttaggtaggttgtgctaaccttaagagctgttttctaggcaaggaacctggccttgctggttggtgctgacctccgtagagaccgacctactcagatgttttctttgatagctggcctaccagtcccagtgtaagagaaatggagatgaggcccagcagggggtgattttacactaaagcagtgattctcaatcttgttttaatgccagagaagccactctgtgcttttgtgaacatcttttcagctcaagtgactatattcaaacagattgcatacatgttaaagggagtttttgtgttttcattttgttttgttttagtttttcagttaattatctttgctctttggagagttccatgagttcttttttttttttttttttttttggagactgagtcttgctctgtccccgaggctggagtgcagtggcgcaatctcagctcattgcaacctctgcctcccaggttcaagtgattctcctgcctcagcctcccgagttgctgggattacaggcactcaccaccgcacctggctaatttttcatattttttgtagagaaggggtttcaccatgctgcaggccaggctggtcttgaattcctgacctcaagtgatccacctggtttggcctcccaaagtgctgggattacagggatgagccactgtgcctggcccaaaagttcttatcaccagataagtggtatcaggagtcaaacactgagaaagaaaaacaggcaaaatttaaaataagaggagaaaattttacctatgaaaataatttttagatgtattttgggaaaaactaccatttgattttaaatgtcttacctctgaggagcattggttgttttccaggggtgtgtttggagagtggccatttggagtgcagagttggggttgggggggtgttgaagatcttgaaggtctctaagcctggcctctcccctcaccacagcatctccatgactcttttagacctccaggtgaaacatgaaaaggggttatgatgcttcagtttgaaagccatcattttacaacttttaaaatactcataattgtttataagctaaaatacttcacttttctcatctatcagaacctttttggtttatctaaaccacaccaaaaatcttttggtgactttccattgaggacatttcaacagactaaatacaaatgaatgttgcctagtaattctctcctttttcgtttttcttttcttttctttttttttgagacagagtctcactctatcacccaggttggagtgcaatggcatgatctctgctcactgcagcctctgcctcctgggttcaagcgattcttgtacctcagcctcccaagtagctgggattacaggtgtgcaccacctaacccagctaatttttgtattttttttttagtagaaacagggttttgccatgttggccaggctagtcttgaactcctggcctcaagtggtctgccagccttggcctcccaaagttctgggattacatacaggcttgagccaccgtgcctggccagttctctgctttttcttatctttgctactctcacagtcttgaaattggaagattttttagggtcttaactgtgttaccttgaatagatagcctcttttgtaagctctgcttcaaaagttctctgtgcttatttttatacatgggtggtttttttccttaatggaatttccattcataagttcatattcattttcaggattgtggttaaagaaaaaaatttactgggcagaaagtgctaaaaattaatacagcatctcatcagttttagatcccaagcttggcttaaggccatcttgaatagataaatggcaccttggtcattggaagtcttctgtgaagtgaaggtagtcacatggttgtgactctgctcatagagttaatattacctaaacattaaactaagctaaatttaaggcagtggtacaggtgacagatcctgatgcccacagatctattttctagtgttgaaatatgtttacttgattttaattttatattttaaataacatttactgttttaaaaaaccacttacctattatagaaaacttaagaaaaaactagcacagcacaaagactatcattaaaatcactcacaatcctaacacctaggcagagtgaaattggttattttttcagagaagtgaagcagattaggtttaacagcatttctagagtaacttctatgatatgccagaagggctcccacaagtgcagctgagtatctgtatgatgtggtctgagtggcaaatgactcaagagttccttcatttgcagtgtttgtatgtgtactgcggtaggcagagtgtaggcttttgagggctcacagagaagtttgctgagtgcctctcatgacccaggtgatctaggactgggaatatagtggtgctcaggacaggcaatgccaattgccttcctgaagctcacattagaaagaactgacctgtgggcatgtcactcctcatgtttctgtttcttcacccacataatgaacatattaatatttacctgacaggtttgttgtgagattagatggggaagtctacagtgactagcacatagcagatactctgtcaatgtttcctcattgctgaatcattgtagacaggaatagacagcagatttctaagagtatcggaaaaacagcaagttaaagaaagcagcccttgctcatgctttcctggaaagttaaatacttgatatattaactgtttatagcatgagttgaaagaataaatccaccatcttcaatgtggacagtctggtgcagatgttagttaggttatatagaaaggaggctcttcataggatctctgcatggaggacttctttgcagcttctgttgattttgttaaaaccaagagtactatagttttcattcataaatacagatttgtgattccttaaccaaaggctctgcgctgccttttgacttaacatattttcagtttaccatgggattattgggacataaccatattgtaaatcgaggattatatgtacagtttttttattgttttacttcagaatataatgaagtacgttaaatgctgaagtagctttaaacacttcaaacaaaaccaaaaaacacaaccatgagatacatctttagtgatattggaaacacttcatagactaaaacgtgcaagatgaaaattcataacttagaagaaatcattgtaggtttagttccttgattcccctttggtctgtttttgaagcccttttgcagcaagtgaatcataatgaactaataagttttagagtgccgattttcaaaatgtgatgcaacttttatggttctgtactttattattaaatacataggtgcaaataagaattttcattttaatctgtcaacgacaatctgttgaaaccctgctgtgtgccttgtgccatgctgctctgttaggggactggggaggccaggacatgctgccagggagctcccggctcagtgggaaagagtaaatgcagagtgctttgctactggtttaaaagaaaggaacacaaatatgattgctttcttactctgggtttgcctttctggcatgttgcctggttcccaagacgaagtctcggatgtgtacatatttgagagttcagtactgcagtatctattcagtgaagtataaacgaaagagcatttttcaaaacaaatggtatgtaatatttttgtcttctttagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggtaattaatctgaggcagctacctaaaatctagttgttttatactgtttttcccttcccctccttcaagaacatgtcaaaatatagatgtgttatcagttacttttatcacctgaatgattgccttcttttattccattacatcaaatggttctctcccttaacttaatttctgactctcccttaattaattctgacttgtcctctaatgcctttgtatttgttttctgatccatttattactgttcaatcagtatttttttttggtcttagtaacacaggatataactcatatgtgctgcttaaatatatgtggtgataagagggtatttacatagatatcataaaatcagtactagtagctgggtgcggtggctgatgcctgtaatcctagcactttgggaggccaaggcgggtggatcacttgaggtcaggagttcgagaccagcctggccaacatggcgaaaccccatctcaactaaaaatacaaaaattagccaggtgtggtggcgggcgcctgtaatcccagctactcaggaggctgaggcaggagaattgtttgaacccaggctgcggagattgcggtgagctgagatcataccactgcactccagcctggacaacggagcaagattccaactccaaaaaaaaaaattaaaataaaataaataaatcagtactagctatagaataagatccaaaaatgtggtgaaaactgctatgttgaatcctctcctcccacaggatttgcaggtgttcattggcaccatatctgtcagtggaaacatatctcttgtttctcctgaggagaatggatgtcttcatgagcctgccagatatttctgttatatgcccttgtaaatagacacttatctaggatgaatagtaatttataatggcgaaatagcaaagaatttggatctaatttatgttatgacctatttacccccagcgtgagaatgggaaggtaaaaacttccagacttcatcaattgctttccggtgaaatttgaaaattaactagttggataacatttctagttatgtatgacattttctgatcccatttgcttaaagtgtaacttctgaaatatttatatgttacactgtaccccatgctagtctagtggaccaggccttgatcctctcaaaaaagaaaaaaaggggaaaaaatgacatggtctccgtctttaaacatactagaatatagttgggtagaaacagtgtacagcagtttatctccaggctcggggaaggggatcacagagaggccaggccacctgtgtctgtatgggctgaacttgttgcagagagagcacttgaagggggctttgaaggatgctgagagaacatgaagagaccttaaacaaaattgtagaaaatgagaatggtaattcaaggtaagttttaaaatcagaccttaccttcccatgtggtcccagccctgctggaaagatacataggcagaagtgacaaccgttctcttggtagtcacagggaacctgtctgatcccagcctgcctagaagaaagggacatacatccataatctgtgatggggtgagatgagacgtcttgaacctctggcacccacagcctccttgaccttgagcttccttggccttgaccaggcggtctcacctggcgctgcacagccaccccacggtgcgccatctgctgcctccttttatgtgcctgcaggccctttctcctttttgtctttgaattccttctcatctatcaggagaggacttgcctcctctaggaaactacttgccctgatccactgtctccctaccccataggtgcaccttaggttccctttctcagtgcccccataacactgggccctcttttattacccagcttctatattgttttcacgtttgctgtctccctgtgtaaaattcttttcctgtagctgtagccggtgttccctgaggtcagaaattgtgttttttcatctttgtcgctgcactgcctcctgtgtctgcctccagtagacgtcctcaataaaaatgagtgcattttcaaacagagaacacagagttcactcctgtgctttggggcattgtttgttgcttttaattcgccccatcctcggcttagtagttttcaaggtagagctggagaaagtaagatcttctcacagtgttagaggttatcatgaaatggaaagtggggagacaccggaagtatctggcagagaggagggcctgatgaaaaggtattttaggaagtctaattaatagtaggctgaatggttgaagggagaaatgggtctgagagaacatgattactgacatttctgaccttttgcattatagtttttctaaaaaattgaggtagaattcatgtacataaaattaactaagatgtgcaatgcagtggcattttgtacacttaccatcttgggcagtcatcacttctttctagttccaaaacatttccaccaccccaaaaggaagccctgtacccagtaagcagccactccccattttcctttccccccagcccctggcaaccacaatctgtgttctgtctctacgggtttatctgttctgatgttttatctaaatggaatcatatatggccttttgtgttgggcttctttcacttagcataatgtcttcagggttcatccacggcatagcatggatcagtacttcattgctttttatggctaacattccattatatgcatgtatatatcatatcacatcttgtttatccattcaccagttgatgaacatttgggtcattttcaccttttggctattgtgaacagtgctgctgtgaccattcatggacaaatttttgtttgcatacttgctttcagttccttttcgtatatgcctaggagtagaattgctgggtaattctatgtttaactttttgaagattgtattatatttgttatatgtactcaggaaggttcatttaaagtaattgacttttaagactgagtcattttttttaattgaatggttcttgttgatattttgttgatgaggaggctttggttttgccatatatatttttatatacaatatctgtttaaaatttttcactatttcttatttgtgaatcccacatttatgcttgcttttccatctattccaattcattatggaaaattaaacagcagaagctttttttttttttaaatttaaacatctgtatttattttgtttctgtcttccattaaccatatgcctctcttcctctccaggaatcttatatgttaaatttccctgcatatacttatttattccctggcaacacatcatctcttttcagctgcttcttccttcctctctgctggtaatataagttttgcttgaaaattcttttttctgaaacttctttttcttctgcaattctgggtggttatacattaatttaaatttttttttacattaaagcataagattcaattattataaccaaagatcactatggaaatttaagtttaagaaactgtagggaaattatgtgcattacatttgtctatatataaatataaaagtttttcacacaaaaagttgcgactagatttaactaacttgaatttattctgctaattgccagtaaaccaattcagtcttaggaagcagttctttttaaccagatttgttcaaaagacgtaatttttaattttatttttaaatctaattatgacattctgtatgtttaaaataatgaaaaagtgatcactgaggatattaatctaaattttatgatggccatcagtaaatgccattaataaaaaagcccttgtagtagaatctagtatcttgtattttcatctttattcatatgaaaagagaataaatggggctgggtgcggtgggtcacgcctgtaatctcagcactttggtaggctgagatcacctgaggtcaggagtttgagaccagaccggccaacatggcaaaaccccgtctctactaaaaatactaaaattagctgggcgtggtggcgcgtgcctgtaatcccagctacttggggggctgaggtaggagaactgcctgaacccgggaggcagaggttgcagtgaaccgaggtcgcatcactgcactccagcctgggcgacagagtgagactccatctcaaaaacaaaacaaacaaacacacaaaagaataaactgataattatagagatgaaaaaaatacagagcaagaaagagtatcttaaacacatgtaagtgttttgagaaaaagcattattcacatgacagcgagcccttaccagtgttggcagccagtcttgtacacctgttgtcaaccacagtagttggtaatgtggttatcataatgtacagtttgggcacagaaattctaaaatacttctgatcattctcaagagtaatacattatcaatttagtaatgattttaaatattacaggagacatttcttctaggcctcctaaattttagttttattaatatatttaactttctcaaaaaatacaattttattatgtatatgttaaaattttttaacaaattaaaaatgtcttttttgttttgattaaaaaatagtctaagttgcatcatttatgacaacttgtaaatatctttttgaaaacagtttatacggacagaaaatgctcaggattgcatgttttctacaaggaagtacacatttgcatagcatttgcaaattttattcttaatctgaccttcagtaatataaaaagcaaactaaatgatcaacagagaaaattcactttctctttaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacaggtgggggatgcctgcactcatttcttctcaaggttaccttgagttgtgtgtgtactttcacagtaaagcagagagataagagcattaattctagaatcagacctaggtttaagtgaagtccctgttctccctattttattattattttgagacagggtcttgctctgttgcccaggctggagtgcagtggtgcgatcttggctctgcttcctgggttcaagcaattctcctgcctcagcctcctgagtagctgggattacaggcatgtaccaccacacctggctaattttagtgggtttttttttgtttgtctttagtagagacagggtttcaccatgttggccaggctggtctcaaactcctgacctcaaatgatctgcctgctttggcctcccaaagtgctggaattatgttctccctctttaaaactacatggtcttaagaagttgctacatacctcctgtgtcctactagtatacatgtaaaagcgttttttgttttgttttgttttgagacaggggcttgctctgtcacccagggtggagtccagtgtcgcaatcacggttcactgcagtctcgacctcctaagctcaagcaatactcctgcctcagcctactgagtagctggaaccacaggtgcacaccaccatgccagctagttttttttttttttttttggtggagtctcactttgatgtccaggctagagtgcagtggtgtgacctcggctcactgcaacctccacctcccaggttcaagcgattctcctgcctcagcctcccgagtagctgagattacaggtgcctgccaccacgcacggctaatttttgtatttttagtagagacggagtctccctatgttgcccatgctggtctcaaattccagggctaaagtgattctcctggctcagcctcccaaagtgctgggattataggcatgagccaccatgcgtggtttaaggcaggggaatgtattaataaatgtctcacaaggaggttgtcagaaataaatggagatgtgtatataaaatagtatattctgactttgtaaacctgtagtaacctcttaaacattgttaactaagaaggccaggtgcagtgggtcactcctgtaatcccagcactttgggaggcaagtggatcacttgagcccaggagttcaagaccagccggggcaatatggcgaaaccctatctctacaaaaaaatagaagaattagccaagcgtggtggtgcatgcctatagtcccagctacttgggaggctgaggtgggaggatcccgagcccaggaaggttgaggctgcagtgagctgtgatggtgtcactgcactccagcctgggtgacagaataagatgctgtctcaaaaaaaaaaaatttaaataacatgtagctctacagtagaccctgtatgtgatgaggctaaaggaataagactgatatgtttaaaataataaagtaaagccccacaacataaatataatcatgtgctcataatggtatttcaatcaacaatggagcacatatatgacagtgatcccataagattatatactgtaactttactgtgtttttactgtaaaggtactatactcttactgtaccttttctgtgtttagatacacaaataccattgtgttacagttgcccacagtattcagtacagtaacatgctgttacaggtttgtagcctaggagcattagcttacaccatacagcctggatatatggtaggctataccatctaggtttgtgtaaccacactctatgatgtttgcacaatagcgaaattgcccaacgacaaatttcgcagaatgtatccattgttgagtgatgcatggctgtgtaatgcaggtgcttccttctgtctttattgtagttgttaaaaaatttgtattcccttagtgcctacattattactttgagtgtagtaagtaagcatttaataaatgtgacttcacccttgctttctgctttaaagccagctgaggccccatttctcccacaaagcttagaaactccatatgtgtccccaggctgtgcttcatcttgcagatgccctgaggttcctgacccatgatgtccagatggctagtgttggaccctcattttctttattgccaagaaagagcagacagggaatatctgccaagtagatgatctagcagtcctagggaaattatggagatctgtagttttctagagtccattattaatagggcctgacacaaagcatttgttcagtaaataagagctacttcttattaacaaaatgcatatatagctgtgagttagcaaaccatagcacaagtataatcagctgtgtttgaatttttctgtccatatttgtttactgattgatagtgagaatggataccaaaggtttaaagacactggaggataaaagcttgaggaaaatttttcagcaaaatcttccctaatattctatttcagggtttatataccaggattgggaaagtaccatttgaccctattgtgtcagatttttttttttttttttttttttttgagacaggatcttgctctgttgcgcaggctggggtgcagtggtgcaattttggctcactgctgcctcgacctcctgggttcaggcagtcttcccacctcagtcctgagtagctgggactacaggtgtgtgccaccgtgtctggctaattttgtattttttatagagacaggatctcattatgttgcccaggctggtctcgaattcctgggctcaagtaatccttctgcctcaacctctgaaagttctgggctaacaggtgtgagtagcctaggctatgtgagatcttttgaaacatgaaacatgggcagaaatattctgtgatttgaaatagaagatgaaaagtaaactagcattttatacaatttgtgcagagggacaaataagattattgtttacattctgagtttatattataaatttagggggctgggcatggtggctcttggcagtaatcccagtagtttgggaggccatggcaggaggatcacttgaggccaagagtccaagaccagcctgtgaaacaaagcaagacccccatctctaccaaaaaaaaaaaaaaaaaaaattggctgggtgcggtggctcacacctgtaatcccagcacttttggaggctgaggtgggcagatcgccagagctcaggagtttgagaccagactaggcaacatggcaaaaccctgtctctactaaaaatacaaaaattagctgagcatggtagcatgcccctgtagtcccagctgcttgggaggctgaggtgaaaggatggcttgagtccagaaggcagaggttgtggtgagccgagattgcaccactgcactctagcctgggcgacagagccagaccccatctcaaaaaagaataataataataaaataataaatttatctatcagaagattttaagattacaaaatttaaaggtatattttaaattttaatttatggatttttattatatatcaaattattccataggataaacttattacctaggtttaaaactttaaattttaatattttgtgtatgtttgaaaacttggttgtaagtaacagaaaatctgttgacttaaagtgtaagggatggtcttggcttgtgtcactgaaagggcccagacaggctgtaaatcaggctcaactcattaagacttaggctgtagcaggaaacaatagaactgtagcagttttaggctttacatctgcacatatcagtgtccaaagagagagagaaaccattgattttgatggcattaagaatgaggaagtaggccgggcgtggtggctcacgcctgtaatcacagcactttgggaggccgaggcagcactttgggatcctcgaggatcacgaggtcaggagatggagaccatcctggctaacacagtgaaaccccatctctactaaaatacaaaaattagccgggcgtggtggtgggtgcctatagtcccagctacatgggaggctgaggcaggagaatggcgtgaacccggcaggtggagcttgcagtgagctgagattgcgccacccaccgcactccagcccgggcgacagagcgagactccgtctcaaaaaacaaaacaaaacaaaacaaaaaaaaacaaaagaatgaggaagtacatttccccaaggcccaggctttttaatctgttattctgttcatctgaattgggccatgtgcccatccctgagccagtctcttttatgaggaaacaccccacgcactgaatggcttagacctggggttttgatcagtgaggtcagcctcccctgaacacgtggtctgaataggagaggggtgatagctgaatgaatattgaggtcctggaaacagattctgagcagggtatcagccatgttcactgcaagataatagggatagtgtgtaattctggtaatgagcagttcagactctgattgtagataacagaaagcccaacttataatgcctcaagtaagcaaaaagctgtttatgggcacttactatagacatatccacaggtggagtggctgcagggatggctggattcaggactcagagactccagctctccatcttggcctcttccttgctctgatggccccattttcacatcatccctttttatcacaagatggaaaaatagctcctcctttgagccttaaatcccacaggaaagaaaaagatttattttacaagaaccttgcaaaacattttatcagctcttatagactcatccctgaacaattggattactatggccataggaccatgatgtgctgattaataaaatgattatcccaaaggttagggctggagtgaggtttgcttcacttaaaccaaaggagcacagaatgaaagagatatgatttcccaaggaaatttggggtgccggatagatgtccacttcaggctttaagaggagtgttcactattcacaaaataattgccaagcaaaacactgtggatatttgtatcccatttcattgactggttctgtcgtatccaagcttaaccagaggtctgaagtgctcgtgtaccactgtaaaagcgctgtgtgaggcagcatagatggagatgacagaaaacactgtgagggttgctagttcacatgtgcagccttattggagactctgcctcttgtcatatagtcacctgagccctgttagcattgtttgcttaattctctccatctgtaaggtggttctggcctctgttactgtctttagaatcccagtagagaaaagatggcatgtcaagatggataacatgacagaattattacttgtatcttattttatttttttgagatggggtttcgctcttgttgcccaggctagagtgcaacggcatgatcttggctcaccacaacctctgcctcccaggttcaagcacttctcctgcctcagcctcccgagtagctaggattacaggcatgtgccactacgcccagctaattttatatttttagttaagatggagtttccatgttggtcaaggtggtcttgaactcctgacctcaggtgatccgcccgcctcggcctcccaaagtgctgagattacaggtgtgagccactgcacccggcacttgtatcttattttctaattagaaaataatagtatcataattatataattatttttacttatagcctatttgtcattttaatttgtctacaaagttttgttctagttagattttcaccctgcatgctgtgtggtcaagttaatttgcaatagaagatttacttatagttgtacttaagattttatagaggtgcttgtacagatacttcctcttctttgtttttttgtcccatagatgaaaaaacatttaaagcccttaaggaagaaggaaatcaatgtgtaaatgacaaaaactataaagacgccctcagtaaatacagcgaatgcttaaagattaacaataaggaatgtgccatatatacaaacaggcaagttctttgtaactttatatatttcttatgttaatagttttgattattaaaaatattttaagttattttattaacacaattaagtaattgccaaagttttttgtgatggttctaagaatttctatagcaagctgtcctaaccaagtgtgtctgaaagaggtgaggccgtgggagttctacagagactggaagcctgaggtgtgggcgggatgggaggtctgacatagtttgtgccaccaggttcccaaaagcgaccatggctgctttggcttgtgcaactctgattcggcatttcctggcttgccggcctcgttgcagctagctgggcctgggcattgtccagtgtgggaggagcaggaatcaatggcctttcaaaatagtgtcttggctgggcacggtggctcacgcccataatcccagcactttgggaggccgaggcgggtggatcacgaggtcaggagatcgagaccatcctggctaacacggtgaaaccccgtctctactaaaaatacaaaaaaaaattagccaggcgcagcggcaggcacctgtagtcccagctactccggaggctgaggcaggagaatggcgtgaacccgggaggcagagcttgcagtgagccgagatagcaccactgcagtctggcctgggtgaaagagcaagactctgtctcaaaaaaaaaaaaaaatactgtcttatggagaatgcccttttccttctgaagtgctgcgggaaggcaccagcgtcatttatagcgtgcagcaggaatgggcagattgttgctcaggtaccgtctttaccacgtagtaaaagatacctatatagaatatggtgatagaatattggacaaaagatgtcactaaatccaacagatgtttttctgcccttctgttcagcctctgtaggatcgggcattattggtcactcagttttctgtgaagactcctcctcctcttggctgcggaggaggaggctggcagctcattgcctggttctcgtcctctccctctccttctgtaggcttttctttccctagaattctcatagttctgagggtctagatcctttttcctttctacgtactctagaggccattccatcctctccccaggtccactcaccaccttacaatgatgtcttccaaatctctgtcttctgagctccagactgaagcgctccccatctcttctgcactcagggctggatatcatcccctacctccctcttccagtcagcaagctcagatgctcctaccttctaaatcccaaatccatcttcagtgtgaccctttctgtctccttgccaccatccccctgtcattcccttgctctgggccactgtcctctcctcctaaatgtctgcagcacccttatggtgtccttgcacagctttgttccatcatctcattctccaagctgtagccagagggactgtctaaaacatggcaaatgtgtcagcccctattaaaaacccttcatcggacttccattaagctcagtttataaagctcaacttccttccatgacttacagtgcccttcgtgatctggcctgcctgctcttccagcctcatccctgcattccagccatatggaactcttcttaattcttcaggaacaccatattctcttccactgtaggtgcaggtctgtgcactcgctgtgtccttggcctccactccccgctacctccatctgaactttctcaacccagtgcatttgcattggataattcttaacttcatactctggatttcaacttaaatgtcacttcttccaggaagtcttccctgcctgctctgcgccttgtctcagccccactgaatctgatgtagttctcagctgtgtgctcccagagtactttgcacagattttattgtgtttgcttgttttaatggtctgtctcttccacttgattgcatcctccttgagggctgtgactgtattttgtttgcggttgtatgcccagtgccataattgaatcaaatgttaagtttcaatggaaaccgcagtggtatagcaacagacatattgagctattttctgatttttcttagctgtctaaaacttacagatagccaatctttacctttcataatactgagttccattgcattatgccagagctctctgttacttgaagctgtgccagtttgaagaagcaaagcaggactgtgatcaggcacttcagctagctgatgggaacgtgaaagccttctatagacgagctctggctcataaaggactcaaggtgaggaaatcttcattttaatgcataaacttcagctctgaacaaatcaagtggttttcacaagcataaatctccagatcttgggatgggattgaggttattcttggatttaatcctagaactgtactaaccagttctaaaaccttgatagaggcctcagatttcacccctaaccataatgtgaaactagattgcttctaagattccttccagctccaaaataatgatttattctctagttttctgaggaatattgttagttatagtaggttcattttaagatagaggaaggtttggtactgaattaccgaaactagcagtaatgctgctggttcctccggcaaggattgctgttggaggttgggtggggaaggcatcagaatagaagatgggtgacccagcggaagttgggagagacacatcggagacttgaaagcttatagtgatctgggccttaagccagctgatggtcagtgtaaatctgtaaaatgccattcttctctaagaaaaccatgccattagtttagaagaaagtggatattgtatcattccacttttcttcacacagattcttctgcatggaaatcctgaggaatgaatgttcatatttatagaaaataacatcacaaggaaaaaccagaacatattggaaaatagtacttcctgaaataattttttaagctcaattttattaaggtgtaatacaatgaagttcatacattgtaattgtgcaggtcattgacttttggtatgtgcatatcctcttgtagccaatatcccaatcgagataaagaacattttcttctgaaggtggtgtgtgctaaaaaaaaataacattttcatctttctagaaagttctctgtgcccctgtacaataaatcttcctccctccacccctaccctcaggcagccattcatctgatttctatcactatagattagttttgattgttttggacattaccataaatcatatagaatggactctactgtttggcttctttcagcataacctgagatttgtttatattgtgtgggtatcaggaactgttcctttttatcaccgtgttgtatgaatatatcacaatttgtgtatatattcaccagttgatgacacttaggttgtttccagtttggggctgttaggaataaggctgctgtgacattcttgtgtacatttttaatggatggacttgtttacaaactgtacagctggaggccagatgtgactaggagtggggatagagggagatggtcagatcctgaggggcttggtaggccatgctgaggaggctggacttaattctgaaggtgatggagcctccagagcagggtaaatggtggtgtaatggatcagatttggggacctcatggaaggttgataagaggggcccaggatgaggaggaaggtaagtgagagatcaccaaggtgagaagcaggtacctgaaggaaagtaatgtccaaggaaagggagaagtatgttagctgctgtggctgctataacaaagcgccatagactgggtggcctgaacaacagaaatctattctggaggtgggaagtctcagcttgcggtgttaataggggtggtctcttcagaggcctatgtctctggcttacagttgctgtcctctccctgggtctccatgtggccttccctctgtgtgtgtgtgcccaaatcttctctttttataaagacacagtcatcttggactaggtagggcctactgattttaacttgattacctctttaaaggccctgtctccaaatatggttacattttgaggtactggaggttagaacttcaacacaggactttctgtggggacgtagttcagcccataacagaagggaaggggccaattcaagggtttatggtaaagttgacatagcagtcaaatgtctaggggaagtgatggaggggatgcctcccaggttctggctgggtggctgagggtagtggtgtgataatggggagcattcaggagcggggcagtttgggagtggggagaggattgttttgactgattgagtctgagatagttgttttaattccgtgcccatgactgaaagggaactatctaggttctgcagggagaagagcagtcatgttgcataatatagcaaatgaggaccacccaggtgcactgaatggccaccttttccagattgtagatccactctggctgcagtgcagtcagcgtgcatgtcccgccaggaccctcgtgctgccctgtgacccccgccccatgctgagggagccacacagtgtccatgtgaccctaacacatgcctccccgccggccctctttttttttggttagcaacacactcacttgtaaaaaaaattcctagatggtgtatggcaccacaaattaaaagagactcctttgaaatttactcacctctttgagcttagtagatttggtaaatgaggatctgtatggctcatgagtttacagatggccaaactcttggagcacatttacctcttactggctgcctgactttctgaacctggtgagctgactaaaggtcagaagctgcaccctaatgaaagactggactttagtttgtgtgggtatcatcattaatacttcattggacttttctatttccttggaatgaattccagaaattatattatgatgcagaaaaataatcccaaatttgagtaatcctatcccactagattatgaggctggtagcttatagcttgatttgttgtccagtaatttgaggtatgtgccaggtgaatttaatttcagaattttaaaaaatgtttaagagagacagggtctcactatgttggccaggattggtgttaaacccctggcctcaagcaatcctcccactttggcctctcaaaatgctaggattacagatgtgtgccaccatgcttggcctaatttcaggatcttcaaaggctacaactgcttatagaatgtgtcagaactcacgcccaggcctgtttgcccagggtgactgcaatgaggaagtggcacaggggctcacggtggcaggtgtcctgcctttagctcccagctcaactctatgttttcctcagatcttctgtttgttttctgactttgttatttttaatggtgccagctttgaaaaatatgagctttctttaatgtacagctgttctttgtaagaaaagatcactgaacattttgcttttatttacaatttatttctcttattgagtgccaattatgtgctaggtgttaggagtatagaggtgaataaagacatggtgcctacttagggaatttacacccaatagagggtgctgcaagatccacccaaaagaggatgctgtagaggatgatacatacaattgttatgtatcaatacaaatatcaaaaagaatatcataaaataactattgcttttatggtttcagcaaaactattaatggtaaatatcacaaacacgtgattataatacatccctttttaaaggcctaatgaggttagcaacttttaatgccttctttcttgtcaaagctacattttctggtttgttgttgttattgtttgttatttgtttatttttgagacagagtcttgctctgtcactcaggctggggtgcagtggcgtgatcttggctcactgcaacctccacctccagagttcaagcaattctcctgcttcagcctcccgagtagctgggactacagatgtgcaccaccacatctggctaatttttgtatgtttagtagagacggggtttagctgtgttggtcaggctggtctcgaactcttggcctcaggtgatccacccaccttggcctcccaaagtgctgggacacactttctatgagctctgctcttccctctacactgcatggctgggttctcttcaggtcttgacttctctgacacctgtaactgtagaaaaaggaggctctcttgttagtatccatctcaacctttagttttctccatgacatcaatgacagtctgtaattatctattcatttgtttacatgtttttaattgcttcccctcataggacgtaagcttccataaatgtaaaacttaagtctgtctttctttgtcttttccgtggtcctcttagctcctggcacatggacgtgctcagagaccatctgtgaagtgaatgagcctcgccccctcttagctgcctccttgcccaattctgtctatgcccttgctgccattctgccctcttcatgcttgtctgcagtgctaacacttgtcaacatgcatttcttgttttcttatgtctcttccaaccagtcaggctgctctttaggcagagactttccggattcatgaaaatgatcctattgactcctagggtgctgagcttccatttccaaggctgtggctcacaggtctctatttccagtcctttcccttgagctccatgccatgtaatcatccaccttctggtcattgctgttgtgaccatcccattcttcatttttaaaatgggaacaatagaagttaatatttgtagggctgttgtgagggtaaagtaataattgtaaaatgcttagaatggtaagaatcagcctttattacttcctcaacttgccctcctgctccactcccttgcctttcaggtatggctccctgcctagaacgcttaggatataaatacagtgtcatttttcccccggtaaggttccagtgctggtctaggacagtggtatctggagatttgttatactttgtaaataatttacttttataaactagagcagatttaaggttatccctttaaatatgtccctcttgctctggtgtgttgctgtaggggaggggaaaggcatgtgggattacagctaggcccccgggaatgtcacataatcactagctcagcttatctgtgctcagcctcttgtgcatgctgttactgatgtgtcatgaatacttgaagaggttacacatccttgcaattctttgcctcttcacagtttggtttattcaaaacatgggtctagtctgtagtttagaacatagcttgtcacagcagactgactttggggcatctgtctttgctgctagattcagtggtcatgtcttgttaggtgccctttctttccctcaacttcttcagtgtattgtgtgactcatggaagattaaatgttgactctagccaatttgaagagtaaacaacctggaaggattttatggaacaaaagtattataataactaccatttgcatagtcctttataggtttaagccacttatttgttcatttatttcttggtacagccttgtgaaaatttgaatagagcttttgttccccttatgttaaagatgagaagactgaagcccagaaaggttaagtaggatcttaagtttcattgctagtaggtgctaatacaaggatgagttcattctttcatttattcattcagcaagcaacaagtgcttatcatgtgttagggactgggaaggttgtggtgatacagaatttaacttgcgttttctaactccagatcctgtgctttttcttctatagtcgatgttcactgtatcatgggttatactatttcagctgcatattcaccccacaggctcactttgtaagagtggtattaatgtggaccctgcacacatactgcacagctcactacatccaccccactcccactcaggttactctaggctccttctatttatgaaagttattttctctgtcttcctacttacagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtatttgtatttgattatctttgaaagtactcctttggggaccttagactggattctaaggtcatattcctgtgagttctaaaacatttttaattttgtgtttttattctgatgatcagtgacaaaattttaaccagcaacaaaatgtctcctttgcaatgataattagccattgtatttcccaacgtgggtccatggatggtactgggagtctctgcattactgcagttcttcctttctttggcctccatctgtactgctcccactccagagtacactgggaaccagcggccactgactttgctccagggtagacctggagaatcctgacgggactgattttgttacaggggccctgaaagcctcacctcatagagattatccagattgattcagacctttttagcactctgaaatatgactgcctcatcagagatctcgaactacctcaggatcaaactgcttttgtgattcagataactaaaatgtttttctctgcctaatattagggaagaatgttaggctgtgaatccctgtacattcatgaatgctaataccccatttatagtctcacatttccactaagagtaagaggctaatatgtaagagaagctaggaaggttttttttcctctttaaggagggaagaaaaaactgttttaggagaatcgagcaatgtaagttcatttctctgttaaaatttattgtgaaaaggagataaaattgacataggcatttatacaacaattgtataaagtctaaaaattaaattttgttgtcatagtttcaatgtcaaataattttttaaaacttttatgaattggatcttataccctaaaacttctcttcctaaaaaaaattattacaaagttttcacttggaactggactacagtacagtctacttgtagttttcaattctcattctgacagacgtacttaggatgtatgtggtgattgtggttcagtgtcacaatgcatttttcttttcttcatgaaggtgaatgaaggcaaggaggagcctggaagacctgcaggggaggtctccacgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaaggtaagtggctaagtattttattagtagaaattggttttattagggtttctgtaacttaaaaatgttacttatgctaacatagttggttttttgtttttttttttttttgcttcttttagatgatgttgacactaattagcaagggccaaaaggagctaattgaacagctgtttgaggacctttcagacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctccatcagtgtactgtcatttatttctgcggtctgtagtgcgttccccctttctggagcattttcttattcacttagaagtgaagatgaaagttagtatcatgtttactatttccatattcattattattttatctaatcttttatagttacagaatattttaactcatcttgggtaaatatctttcaaactgtgccatttttctttgaaactgctttctttgttcataagtgaaaaatctgtaatgggactttagtcttcaaacaaaatttctcctttttaatgttattgaatttttataaaagtaaatggtggattgttagaaatgtatcctatgtatggagtttacttacagaaatgggaccactcttttcctatacatagcaacttgaaattaactttagagacaaaagggaactttctcttttggtgcctgacacagtgacattaataactgtaggtgattttgttgagctttgtgataggcactgtgtgtcatttatcacacattgtctaatttaatcttcataactctgctacagatgaggaaacaatggaacagaaggttgtataaattaatgaggatttacaaatgttgcaagtggtctctccagtatccaaacctgggcagtctatcttttgagttcatatactctgtgctgtgtaatggaaaatattaaatatgtgaatggactaatggttcaggtgcctattccttaacagtcacagatgagtaaaagattagtgaatgtaaattggcaattttggtatttatagtgaaaacacagagcaagaggaatgcccaggcctgcctgagagagggttaggaaaggtttctcatggggcacagttctgccacagcttgagtatgtcataggcagaggaaacgagatgcaagggcatcaacgtgcatattgaaggtgcaggttgaatgaaagtgtgaagtcacttggcatgttcagagaactgcgtgaatcttaatattactggaacatgtggcttaagagatagctggatagaacagaaaattgcatgctgcatataaaatggcagaaaatatcagaattttaattatactctggcattactcttaactaagacctggttttcttccccttctggg

SEQ ID NO: 17150 - DNA, 88950 bp, Human
tagtggattttaaaaaaacaacttttattgttcaaaactattgaattgtgggcacagtggctcatacctgtaatcccaacactttgggaggccgaggtgggaggatctcttgagctcaggagtttgaggccagcctgggcaacatagcaggacttcatctctacagaaaaatgttaagaatttagctgggcatggtggcgcgtgcctgtagtctcagctacgtgggaggctgaggtgggaggattacttgagcccgggaggtccatgctgcagtgagccgtggactgccccactgcactccagcctgagcgacagagcaagactgtgtctcaaacaaacaaaaacaagtgaattgtttttgagcctcaccatatggcaggcactgcagtaggcgtttcatcacgtttatctcatttaaataaagtgagtggcaaatcttactgcaggaagggtgctgaattcctcctattaggagtggctgcttgaaggcaaaataaaacccatcctttcattttgttgagtcccagcagtagcagcaacaggtactgtcgagcgtttatcacaagccaggaactcttctaagtatattactattatcctggtgcaaaagtaatcgcggtttttgccattccttttaatggcaaaaagtaatgccacgatcatggctgctaatatgatctcatggaaccctgtgagggaggggctgttatccccattttacagataaagaaactgacccttagagaggataaataatttgctgtgatagctgtcttagttcaggtcaagcttgatttaaataacacacgtttctgaggctgacgcttaaaataaaaaatccccctgtgaatggcaaagatgccttgctttgggaagtaaatagccctaccccacagtcggttcggttccccaggctctgtttcctcaaatctcggtatttcagagcttggtgtttcagaaagggactttagctattaacaggacaacttcttcatgctgaagattaggggactcaggcccaaagaggtaagagaactgtcccaggtcacacagtctgacggccgcagagctgaggctcaaattcccgtgctccgactttcaggcctgggccgccgagttattaagggactctggccagggaaaggaagggaggaaccctgaagtttccattccctcacctgcgaaatggggtcaatcacgggccctctttggggttacgtgggtgtggcccagcccaggggcggccactctgcactaggaatgtgacaatggacggttcagggagggctggaacgtcggcagtcctcaagggaggtggtggtagggtgtgacggagccagggcggagcctcgggagccagaggcgtggattcgcgaattcggggcggggcttggggtttaaacgttgagatggggtagtgggcggggcttgagatgctaggaatagggttgcggtccttgggcggggcttctggaagacggggcggggctttgtgaggccgctgggcgagttctgaagcagtgggaggggagccgggcttagggaagcaggaggctggtttaaggactcggataggcagtgcgcggggctcagaggagctaatgttcctgtattgaggggctctgggggaatctttgaggagccaggggacgtggccttgcagagcctagcgggtcagtgggcggggctctaagaaccccgctccggggtctaaggagcagtgggcgttgctcggaggcgcctgtgggcgtggccctctaccactcagatgactggagagcggggcgtgcgcttgggcaccgcctgcatccctcggtgcgaccagagggggcgtagcgaggcgtggaacgtggggtgggaagcgggcttcccctccggaagtgggcgtggcgcacagcggcccggcagccctggttgggtcccgcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccgggtgagcggctcgcgcccggcgggggcagcctgagagcgagtcgggcgggcggacctgtcctctgagcatgtgcctgcgccgcctgacaggagccggcggggcgaggggcagggctaggtggaggggacagtgctgggtgggcgcgcggggcgcgggttcacgggctgggttgcaaggggttagggccgggggctgctgtcgggggctcggggaaagggagttggggaccgaaccaggtggcgtggggagcgtgaagcagggtccctgtggggaggaggctttcgaggtccggaacgctcctggccgggtgcggagccgcgggccgaggtgggacgaggctgcccagggaaggcttttaggggtcagggatcgcctgcttgggcgaggtgctgggagggaagggctgcttcgggcgaggcgtagagcccgggggctccaggcctggggactgggtttgggccgccccagggaacgagtgggtgggggcgggtaggggccgggctcacgtggggccggggcgagctgggccctgcgtcgggaggggcgagggcggccgcctggcctgcgggtttcctggctttgggtgcgagaccagctctgggccctgcagatctcggttgggggtcaggcggggcggggcagagctggagctggagtaatgtgggtgggggcggcttgggaagaggctgagcccggccaagggagcagagggctgggactggctgggggttgggaggggaggaacgaagcaggaaggctgtcggatcgggggcccagggtgtccgagtgaactgggtgattcagaggtgtgtttccctaatagcggggcagctggcgagggacgcagtaaaaaggagcgaggtgcaggtggggccccgctgcgccgaaatgactgaggatgaggtcagacgtggagggtgggaatgcagaaaccgagctctcccgcctgtccccaccggcgcacgctccccagctctccgtctctcaaatgatttgaatgtgttgggggaagtggcaggctgcggtgagagctgagaagaaaggggcttcctcttggagggaggcgctggccctggcatccttttttgggagtgttcaaaggattttgaacgctggaaaaggaatcgtaggctttactgcatcacgatttagaaacacatcctatatttggccgtaatgtaggctgcccttgttttgtggtgtctaaagtgcttgctctacatgttgcaaacgtgggattcagagtgcgaagcaaattgcaagttgttcatttcccccggcatggtaagatacaaaggcttttccctcctataagacatttgaaaagaattgaatgtagtgcgcgtttaataaactggtcctgggtggcgaatatatttacttttggaaatagttaccacaaaatattaggccctcttaccgcagcctttctgcctgggattacattctaaaacagtacttgtagggctcttagtcactctatataataatgcatctcattgtccttatctggcagaacgttctcctgacaccagggcctgctggaatagacagaaacatgattaagtataagcagttgctttgtaccgtctgttcagttgtgaaggcaaatagatacctgtttaatattaattcactttctgcattccctgtaaaactgaagaaatgtgcaaaatctattttggacttggttctatacatttcagatgatttaaggaaactagtatttttggtttggaggtatgtttcacagtcataatgtttggctatgaagcataatagtaaacattggatctgagaaatcgcataaataagtagggaaaaaagtgaaataaaactgagaattgtgttgtaccttaggtcttgaagtgcagtgtttcgtggtggaggttagtcgtgtgtactgaggattggacaaagatttggtataaacgtcaggagcacacatttttgacaaatatagaacctatcttgtccatatttattttgattacttgtggaaggtacattaaagcctgatgaattttaatagatacataccgatgaaacataactgcacacaatattgactttttcatgatcctttgttactttgcctgcagattgtgctaatcagcatttatacttatttatatatagtctaggattagattcggtgtcagtgaatagcatttttttaaacaccgttggattttttgataaaagttttatgtttaacttatctgtcacttctgggatccactccaaccatgaggaagagagtcactctaacgactatgagatggaatgttcaaaaggatgaatatcaattcttagttatataagtgggtatgtcgacgagtctcttctttatgatggcaaaattttaatttctcatattttgatttgtcacaaactggtactttagaaacatattattaattggtctgttttacctttgacctcttttccaggggtggggcaataataaatttgagagctacttgcattttcaaggtacaaatccatgtgataaaacctcttaagcttgttttccatttatgacttctctgtgttactgtctccttgaattatgaaaactcttttctgacacttgtatgtctttttaaacttaagataccttttctgtattaaaacagaattcttcatgaatatttcagtatgacctagtacctagaatgttaagtaatagaatctctctgggttttctttgccctagttcagatcctttaaagtgagtgaacaagattctgtactcctttctgagtactttgtatttctagagtgcagaatggaactttttttgttttataacagcttcattgagacatactgtacagttcacccgtttaaagtgtacagttctgtggtttttggtatattcacagagttgtgcagctgtcaccacagtcaattttagaacattttcatcccccccaaaaagaaaccccataccccttagaagtcctcccgtttcatgtaaatggaatcatacactatgtggtcttttgtgtcttgcccttatttagcatattttcaaggtttatatgtgtggtagtattgtatagtacttcattttttttttttaatggtcaaataatattccattgtttggatatgccgtattttgtttatccattcatcagttgatgaacatttgggtgtttttcctttttggctattatgaataatgctgtgaacatacgttttcatttctcctgagtatttacctaggaatgtaatcgatgggttgtatggtaactctatatttaactattggaggaatggccagacttctccaaagcagctgcaccattttacggtattcaccaagagtatatgaaggttctaaattctccacattcttgccaacacttgttactctctgactttttgattctagtcatctgtgtttccctaatggctaatgatgttgagcatcttttcatgtggttggtgaacatttgtatgtgtaatctttggagaaatgtccattcaaatgctctgcccgttttttaatgggttgtctttttattggtgttataaaagttgttcatgtattctagattcaagtgccttatcagctgtatgatttgcaaaaattttcttggattctgacatgtcctttcattttcttgatggtgcccctttttaggaacaaagattttaaattttgatgatttccaatttatgaatagtggggtcttactagttagaaattagaccttaaaccacaccctcctcaatattttggttatataagttgaaacccaaatgtgagaggactggggaaaggtttgaattaatatattttaaggtatgctatagatgaaaaaggattcatcagggaacatgccattcacctgttcaaatcctctggtgacctcacctttacccacaaaataaagttcagactccttaatgaggtgtggagtaaggtgggctctgatttcagcctgctttatttctcactattccccttccaatgtcttcatctctagtgccactccctgaaacatcccagctttcaaatcttgtgatgaatttattacttcatcgcctttctacttctagaatcccacttgtcctttgggacatgggtcatgaggtttttcctccatgaaaacttcctcatctcacaggcagacatttgtccctgccctcatgtattgtacattcatcaggactgtttgctacaaagaactggacctgaatttgagctaatagtctgaaaggtgcctttccatacaaggcagaatgcaatagagcaattcacatggaaggcagactgagattctcttgttcatggcttggtcattagtgcctactggatattcgctgaatgaatgattgtttattgaagttaactggaaagatcctgaggtcagtgggtttctctgattatcatgaatgtctttattgcctatgttaaaataacatgaatggggtaactcccttttgcccttctggcatccaagtccagctcttaccaaaaagtgctcaaatgtaaaactgagtgtttaaaacatttccccaatggcagaacattctcgtccaggttctttcccccgatgaacagtaatgactggcgcacagtctcctcagtagggtagatggccagcgaacacgatttagtcacaccaaatgcatacaggccgaccctgatagtatttggtcagttagtactggaactacccctgtcacactcatgagaatggttgtaaattggattttaagggtgtgtactttcttttcattctttttttttttttttaatgttttgtagagatggggtctcactatgttgtataggctggtcttgaactcctgggctcaagcaagtctcctaccttagcctccgaaagtgctaggattataggcgtgatgcaccatgcccagcctcttcattcttttgttcatgctctcctctcttggggtgtctgactcaaattagtattctttagttatattttgtgttcttatgttcattttttttttttttgagacagagtctcactctgtcgcccaggctagagtgctggagtgcagtggcacgatctcagctcactgcaagctctgcctcccaggttcacgccgttctcccgcctcagcctcccaagtagctgggactacaggcgcccgccactacacccggctaattttttggtattttttagtagagatgggatttcactgtgttagccaggatgatctcgatctcctgacctcataatccgcccgcctcggcctcccagattatgtttatttttaaaatactttaattaaaaatatttcatgccgggcgtggtggctcacacctgtaatcccagcactttgggaagctgaggcgggcagatcacgaggtcaggggtttgagaccagcctggccaacacggccaacctgtctctgctaaaaatacaaaaattagccgggtgtggtggcacgcgcctgtagtcccagctactcaggaggctgaagcaggggaattgcttgaaacctgggaggcagaggctgcagggagcctagactgcgccatcacactccagcctgggcgacagagttgcactccagcctgggcggcagagaaagaatccgtctcaaaaaaataaataaataaataaataaattcacttagcacctttctgagaattaggagaaaccagttggccatttcgggataccttttctttgtgtgttcgttaaagcttggattgtggcaaggtagtacagaagagaaagaaaaatgtcaacttttttgtctagttagggacagtgagctatgggtaccttctgtagttctcgttctaagagagttttgtatttaggggaactgaggccgtgagggtgcaggcctttagggccagatagagctgggcttcactcttggctccgcttcttgctagctgtgactttgccagctccctcacctccctgagcttcactttcctcctctgtagtgtggagatgcaaaaggcttaccttgcagggtcattggcaagattaagcaaggaaaattatatgaagtgcctaatacagagtaggtactgaatacattcctgttccctctcttctctcttaaatgtctgttaatgaatggaactgcagagaagcaaatagagtaagtttaatacattttacatctgacattaagctattaagggtatggattcctactcccacctgaggattttagactttgaatcaaagttgagtcactgaagagggcaaaaaatgtctaattttaggatgggaaggcggtcttaaaaacacctccagtgtttttgcatctgtctgaattggaaatgtctattcagacagtcttctctattcaggtctgtgtattcagtctctctgtctgtgtgtctgtctgtccattttaaggaaagttcctggcaaaagatggatttttttaggatttgaaggagattgcactgcagtgcttgagataactcttctggttacagtgtgataaagtgtaacatcctgtgtgggaaaagagcctctatagttttatggtatgttaaattaggcctgtcatttggatcttacattaataacaaaaatacagttcctcccgtttgctgcagtaatgagtaattaatataatgcaaaggtcagagtgagagagactataaatgggagtaggaaggcctatacattgtatgtggaaggcagttatattttttcccctttggtcaggcaatgatctacatttcttcttaaaaatttatgaataatggattatatttggcaccagtatctcaccatcttttaaaggatatattattttgggagatttgggagattattgctcaggtacagaggtcctcattcttgactgccttgtgatgatcatctgtggacctatatgaatccagctgcctgggtgtgagttccctggtgactctgaatcacagccagaacaggaagcactgtgggctggtctattcctcattttacagatgaggagactttggtggcaggagcttgacagatttacccaagatcaggaacttaactgccccttcctttgtgtggtatgaattaatttttatagttagttgtgtgaatttatagtatagtgtggattttttatttaacaatgtgaacctgacatggctttccctttgtagtctttgacccagtgcagcagttccatttgcttagcctttcgtcatgctcttttgccagatctgcaaaccaagcctattcacggagttttcttcagttaatcaccacagttggtagcatgtacctatgttgttgttgttgttgctttttcccacatattcaggttgtgcatgtattaaactgtgaagtttggtccaggtttttaggaggatttttagatgcatttttaggaaacttgaaaatacatgatatctcttggataaacctttggtaaacttgatttctatttttaatgtaaagctccttgacagtattttattgatccttttaaatttcctcagtcttataatctgagcactagtaagcagtggttttaaagatttgtcttgtatttggaagaccgattattattgcaaaggtgcccttgcattgcatcttgccagaaaaattggcattagtaggccgtctgtatttgaaaacaccaagtttagacaggaacaacacaggcccagtactgaactattaatatatagattgtaacagacataatgaaaaccacttaggattagcaaaggttgattattgtttcacaatgtggttgttctgtctttgggaaaccaagacagactgcaagtctggtcacatggtggtttggtgtaagagactttcttgctccattgtggaactgggtgtgggtccccatgtctcaacaactgctgaggccttcattctggatgaacaaagctgtagatttttcatgagagaccatagtagacacacatgggaaaggaagtgttaggagagtgaagccgtcaggctgtattttctacttttgatatcataggggtgcatgacaaaattcacaagcatcccttccttatgacaaatgtttaatcaccattatttgcttacttcacaggaaagatacttaaattccttttcgtaatggtcaagcattctttcctagttaaagattctaattcctttcattcttaggaacttaaagaattgactgatttattaacataaaaactcaaatgtggctggagtggggactgaggaacacacgtgaaagtgcgctgtcatctctgttaagcagagggatttattaggaaactagtcactttggaagctagatggtgaattaattttgtggttagtagtatctttagcttaacaatgtcatcctagtttttcttggcaagcaagagagaggctggagccaatgagggctggccacagttctttgggggtgatatttaataagatgcacgttgtctgttttagaaatagagtaactgtcctttaggctctctcttctgtgggccactgttgctttacagtgctactgtaggaaaagataagttggaagtcttcttttttctccctaagactgctagtttgatctttttatgcattatgacagtgtcttgagtgcagtggactgaattacttttatcaagtagaacaaataacatatcataccttcaaaggatggttatgaactgtgtgtttctctgaaagtgaatgagcaagagcccagatgaaatttctgttttggaggcaggcagtgtgtacatttggtccccaactcaagactgggttgtgttccagagtctaactcagttatttggaactcagatctactagtagtaatttctatctattgtgttgattcagcattgtaagtggtgggtacgttcccagcctagactgaaggaatctgtttaattcacagcagtttttgaaattgtttatggtgatagtggaattctggatcttgggagctggtagtcatgtgaaagagaagtaaggactcatgccccatgccccaggagcctccctgtgcaggctgtgtggcgtccaggggtctcatgccactgcagccctccaggtctgtgctggccctccttgttcttcatcctccttcatctctctcttaatttgaagcttctacttccctggttaagctcactttctttaaatcatggtagcaaagcacatggttcaaattcatttccctgctagactaccgctgttattcagggttgggatgactacaggctttattcatgtcatttcactcatgttctttaacccttttagaggtgtacaatgttaatatttttaaagaggaggttccttactgataaacagattgtctctttgaaatgtttgcattcagtcattacagcaaggtttcaaggggaaagttgagcagaggcatgtgaagtcaggcagaccccacgtaaggaggctagtcctgatacctggaatcaggaagaaaccatgcctgctttagaaaggttcttcctgtcactccaaaacagtgactctgctaaatttttttcaaaatactttctgatcttttttttttcttttccatttgggaacttcacagcttgaaagggtcttaggttttggcgaagtggcttggtttctgtgacctttggaaagttgatcagggcatggtagtgattgtaaattggggcatcttataatggccagagctgggcactcgtcctgtctatttttctattcttttataaacttatcaaaaagtcacttttttcatcaaacagtgggaaattattgacctctccattctgttagtgcctctgtgaagggtttgaactactggtttcaaagaactcttttcattcaaacattttatgatgcaaaatatattagggacttgatttttctggtatcatttaaaaaattcgtattcacaaagtcttatggcaagcttaatgttttgatttacttttaaattatgtaaaagtttaaaaaatacattacaagcctcctccagccctcaagcacatgactctttgatggtgaattctgcagtatagactgtgagctctgtgggaattcaggagacaggcgttggagagtcagtgtttgtgggacactgggagtgagatcctgcctgagggtgtgcctaatagtactgggctgactcagaactggtgtaattagggaagagtagtgtaagatgggtagatgagatggccctgattatggaaagtgatgataataggttatgcatttatacaatatgttagagtaaaatgtaaatatagtttggttatggagttataaaggtaggtgaaagtgtaatttgtgggtgtcactagtgttagtgatttctatgctaatactaattacatctgggattaaatgactagagattgagtacagaattattttacagtttgtgaaagtgaacaccttataatactgctatattccatgttccttaaaggtagaggatatcttacattttttggtgcctccatttcctagcatattgcctggtgcatagtagctgttcaataaatgttaattgagtaattgaatttcaactttgcatgatacacttgtgatattgtcagtctttccattttcctagaagatgaaaggaataaagatgttttctatggcctaggactactaattgtaaatatttgccgggtgcggtggctcatgcctgtaatcccagcactttaggaggctgaggcgggtggatcacgaggtcaggatgtcgagaccatcctggctaacatggtgaaaccccatctctactaaaaatacaaaaaattagccgggcgtggtggcgggcgcctgtagtcccagctactcaggaggctgagggcaggaaaatggcatgaactcggagacagagcttgcagtgaactgagatcgcaccactgcactccagcctgggcaacaaagagagactccatctcaaataaaaaaaaaaaattcttattatgttattataaactaacttcgtaatttttattgtaaataaatatgttagcaagatgtttatatgtgtaaatttacacacacagatatacatacacattcctttattgaaacatgctttatttgtaaagcaaattttggggttttgattatttaaagcatatgttctgataaaaagcaggataacacaacattttggtactcatcacaaatttacttaattgatttcttgaataaattaaaactattggcagcatgggtttcttatggctgtattttatagctctggttagcaagtttgtgtgtgcgtgtgtgtgtgtctgtatgagtgtttgagacagggtcttgctctgtcacccaggctggagtgcagtggtgtgattgaggctcaatgcagcgtcgccctcccaggctcaagtgatcctcccacctcagcctctcgagtagctgggattacaggcatacgccactatgcctggctaatgttttaatatttttgtagagacggggtctcactgtgttgctcaggctggtttccaactcttgggctcaagtgatcctctcgcctcagcctcccaaagtgctgggattataggcgtgagccactgtgcctggcctggttagcaagtttgactttagagtcaatgaagtaacatcccaatggaagcatgctttcatttaacaatgaagatagatatggcaagaaccataatttctgtcaaggggatttaaagttaaggtagccattgaaaaagctgttttccttcactatctttctctttttgagtttctcatcctttaatgcgctattgtcattaaatagccttatgttctccctgaaggaggaggtgaaggtggaggtttgtctgcagtggacctctaggtgtgccctgcccagcaccagagaaatcatagggcaggccttagggcatttgagtgactcctggagccccaaggatttaatgtatttgagaattcgtttgacttgagaatttgacaaggaccgagtaagttaagatagggtgaattgtgcaccactacaactgttaaaatgatctaatcgcttaggagttcatttatacatactaaagtctgaaaaactgtagactttggtttatattgtattcacgataagtggtcacaaaaaatgaattattttgtaattgcatttgtgtgtatacgtgtgtgtgttatttctggtagttttttgagggtaccataaaccataaatgtagttgtttaaaaaagtattagggataggaagcccctggatctttttgctggccttctacttaaaattatttgtcctactttcataaggaatagataatttctctttagttactattgtgatgtccaattaatttagcatagagaattaaagattataattttcaagtcttgatacagtttggaaggaaaatggatttgggagagttagggctacagttttaccagctacagctgataaaagctttttgtagtagagtatttgctcttagaatatttagcccaaatgtttccttctgaaagtgggccgtgtttatttgtcttcacttccctagagatattttcattttattggtgaaattgaatgtgtgctgttttcttcctgaagagcctgagaccttcttctaaaggtattgaatggtggtaaagtatttggtagtaactacattatctccagtgagttaaattcttagtttcttgtactctattatagatactgatattgagtgttttgttttgttttttccttcgctttagaagatgcatatgctgataaggaaatatttttaattttaccaaaagggatcaggcagacaaaattatttttcctaaggtgcagtaagattgtaagcgctatactttcctatttctataggatgtctgaaaattccagaaacatagggagatttttattttaaacagtgttagttttcattttcttttcttttctttctttctttttgtttttgaggtggagtcttgctctgttgcccaggctggagtacagtggcatgatctctgctcactgcaacctctgcctcccgggttcaagtgattctcctgcctcagcctcctgagtagctgggattacaggcatgtgccaccacaccccactaatttttgtatttttttttttttttcgagacggagtctcactcttgtcgcccaggctggagtgcagtagtgcgatttcagctcactgcaagctccgcctcccaggttcatgcctcctgggttcatgccattctcctgcctcagcctcccgagtagctgggactacaggcacccactgccacgcctggctaattttttatatttttagtagagatggggttttaacgtgttagccagggtggtctcaatctcctgaccttgtgatctgcccgccttggcctcccaaagtactgggattacaggcgtgagccaccaggcctgacctaatttttgtatttttaatagagatggggtttcacaatattggccagactggtcttgaactccttacctcaggtgatccacccgccttggcctcccaaagtgctgggattacaggtgtgagccattgtgcccggcctagttttcattttcaaatagcatgctcaatacgtttttcttcaagctccagacacttttgcgagcaaaagtacataattttaaagccatggatccaattattaatgtggaaaggtaattatgttttaaaaaataaattttaaagtatttttcccatggttttactcttttcagataccttacttgtcaacagaaggctctttgaagctactactaagaggtagtaagtaagtctccacaccaaagagaaggtgggaaggcacccccaaccatctggttgcatgagtcaaattaggcatcactgttgatgcacccttcatatctaaaacagttttaaattcagttgacttcaagtcttttggctccatcatctctgtttctactgggactgtgacttgtggcctggacaacaagtgccgtgacttcctaactagcttccctgaatcctttcagatgctcccacgtgcagatccattctccagcttcattcagcgtgagcttttaaaatgcaaatctaattatgtcacatactcatacttaaaaaatttcctatggctcccaagactgcaagtacagataaaatccttaacatggcctagaaagccctctgtgatccgggttctgctgacctcgcagcctcttctacccttgctctctgggctccagcctctgtgggctaagtagtccagattctgacaagtgcttgcttttgatacagacttttgatattttgttgttcctcccagctgggactcacttttcttctcttattgcccagttgacttctcattctttgatttcagcttaagtgtcgcttctctgactgcttctgttccccgattattgactcagttaccttgtgttcttctgcattccagcacttgccacagcggcatgctaatgtttgcacgaatatctgattgtgttgtgtctcctgcagtggactgtaagctccatgagagcaggggccaggtctgcttgctcacagttgtgtctctcatgtctagcatggtgctaggcgcatggtcaaagccgagtgaatagttgttgaacaaaagaatgactgggattaaggacctattcaacattcatagttgagtatatatgtaatacgtataaccctgtggatgttagtaagtaatgtggtttgcagtgagttgtgtctgttttactgggggggatgtggactgtatcccagtgaaagaaggatttcctgtagactctgataggaccctagaaatcatttattttagttcttccattttatagatgaagaaacaaacaaccagaggaccaaaatgatctagctgggtaggtaattatgtcaagataaatttgtgtctgacatccaagccagagattttcctactcttccttaatgttcctttgaaacactgtcaggagtacatgttcatttaatccatttaatctccgcttgcccaaggtatgggttaaaaagggaaggctgaaattcttcaggtgaaggtgattattttgttttttgacactgctagttttgcctgtgactagccttatgaagttattaataaaaatatcccccatccctttttaagatatgagcatccagtaatttcatttcctggtataacagtattgccaaataattaataaaattttattgtctactccatatgactaagtagtgaaaaacagacttaacaagtttgaactgtcatacacagtgtgttttttaccagttgttgataagaaaagtaggtcatcaatatagaaagaatgtttagaaacatattcaaggattttttttttttttttttttttttttttttgcgacagagtctcgttctattgccaagctggagtgcagtggcgatcttggctcactgcaacctccgacttccgggttcaagcgattctcctgcctcagcctcccgagtagctgggattacaggcgcgtgccaccacgcctggccaatttttgcatttttagtagagacggggtttcaccgtgttagccaggatggtctcatttcctgaccttgtgatccacccgcctcggcctcccaaagtgctgggattacaggtgtgagccaccccgcccggcctcaaggattaatttttaagtgagattgctaggtcactcatgtctataaaagttttgcggttggtgtgagacctcttgggattaatttggctctttgagttgtgttctgctctttgaagagagacacagaattaagcttctgagtctggtctcctgtggtgcactttagggagatggctgctgccagtgttgtgagtatgcgggggggagggggggagggaggaggcgggtcaggtagcgcctgcctttgtcttcccaagggacgtttcttcagcaatgctttttcaaagctccagggaccaaaagaggtggttgtgtttataaagatgctggtgataagcagaaaattgggagatgtggagggttgtaaacatgtcatccttgcacattatctctgtaatagaaatatatatttctgtcattgaagagctagagatgatttcgaagtccttatatattctcacattttagtaactgcaaaatttctgtagtgtcatttctattatattttaagtgagttacaggcctcattatggcatcttttagttcataaaagggtctctctttaataagatgtgagggaattacagttttgttttgttttgttttgtttttttaagagacacagtttcgctttgtcttttggtatcaagttcagtggtgcaataatagctcagtgcagcctcagactcctgggctcaagggatcttcctgcttcagcctcccaaagtgctgggattactggtatgaaccaccacacccagcccagttttaggaattttatcttttgtcttcaggttcattatgtgttactgttttgctgctcattttacttcttgtcagacttgattttcggcagtcattttcatagcgtcacattacgctctgcaatgcgctcactgctttctgcttcacattgccagtgagtgcttaggtttgactttaggtggtccccaaccaagtctctttgtaagaagttcctaaaatgagtatagattataaaatgtaaatatacgagtgctcttctttgaaaactttaaaaagtatgatacctctttattatacctcaccttttatttttatttttattttttttgggtatcactgtgtcccccaggctggagtgcagtgtcgtgatcttggcttactgcaacctctgcctcctgggctcaagcaatcctcctgccctcagcctcctgagtagctgggaccacaggcatgcgccatcatgcccggctaattttttgtatttttggtagagatggagttttgccatgttgcccaggctggtctccaactcctgagctcagcctcccaaagtgctgggaatacaggtgtgaaccaccgcacctgtaatgtctcaccttttagatactatccttggggtgtgtgtgtgtgtttctagtgttttatgcatgctctttcaggttgttcctcttttttttttttttttttgagactgactctcgctctgttgccaggctgcaggctggaggagtgcagtggcgcgatcttggctcactgcaacatctgcctcccgggttcaagcaattctcctgcctcagcctcccgagtagctgggactacagttgtgcgccaccacgccctgctaatttttgtatttttagtagagatggggtttcactatgttggccaggatggtttcaatcccttgacttcgtgatccgcccacctcggcctcccaaagtgctgggattataggtgtgagccactgtgcccggcccaggttgttcttttcttggacaactgagcacatagtcctctggctaagctaaggattttcagtgagaagtaagatttgcttccttggtcataacagataccctcttgtttgtctcagtacatttgaatgcctacagctggtttctgtattttgatttttccatttttactcatatttataaagtgtaggcaaagtgcagtttcacatttaaagtgttacacaaactggccaactggactgggggctgtcaaagcagcacccacaggacagagctctaagtgccattgttggctgatgtggagaaactgaattgtatatatgattcgggattgattgttggaaaagtatgacagttcatgggctgaaaagttggaactgctccgtactttgtagttcaaggtcactgcatctttctcagaagttctttatctttggaggagttatacgtcttcaggctgaaacgtgacgggcctggaattgatgagctttggaactctctccaggcctagctctgtgaggcccgagcctggaggcttcttggtagatcttatttgcattttctctttattcttagaaactttaaaaactaaatgatattgagttattgaattgaaacaaaatgcatttttactggtatgcctcattcttggcatcttacctgttacctggattaataatgatgggatgaaactatttggaaggctatgtaatacatgtgaatttttttcccttaatttttaccattcctggtgttataatcaattgaaccaacatcaaggctattcatacttgcagtcagtcggccatgctaagtggtcaatagtttttctagaaaaaacatttttttcaacaagtccatatcagcagtggaatacaaatctctttcagccaaaactgctgtgtatgaggagatctgttgtgtatctgacattttgctgtgctttatagcaaatgttgcatgtggtcttttttcttcctcttttaaaaacagcttctattaaaataggtaaggcatgtttttttttcttggaatgtctcatgtatgaatctgttaaagagttgcatgcagtagaaatatgcaattcgttaggtaaattctttctttgagtgtcactgctggatttaatttagaaaatttgaaaaagctcagctatctcatattcggaaatgatgatttttttttttttttttttttaaagagacatgatcttgctagagtgcagtggcatgatcatagcatactgcagcctcaaactcctgggctcaagcagtcttcctgcatcagccttcttagagacagtgcctcattatgttatccaggctggtcttgaacccctggccttaagctatcttcccacctcagcctcccaaaatgctgagattgcaggcgtgagccaacgtgcccggccaaatttttatatttaatcagagtacctcctatatttgctttgggtgtctgctctctcgtgaatgtgtattctatgtaggcttatatattattacatttcccacttccttttttttttttttttttttttgagacagtttcgcttgttgttcaggctggggtgtagtggcacaatcctggctcactgcaacctccacctcctgggttcaagcaattctcgtgcctcagcctcctgagtagctgggattacaggcacctgcaaccacgcccacctgattttttgtattttactagagatggagtttcaccatgttggccaggctggtctcgaattcctgagttcgggcaatccacctgtctcagttgcctaaagtgctaggatttacaggtgtgagccgccctgcccggcctccatcttcttaaaaggaattttttactgttggcattgtcatttaaataactgagtttaggatatttgtctcctcatctgctgtcttacctgcctttttctattgaataacacatcggatctcttctacattaaagtacctgccatacaggtaacagtggcttggaggaaacatggtctttcctctaatgggacattttagagtcttgtggttgccactggctgagggagcattctctgcccactgaacgcttgagtaatcgacgccctggaatggtctcagcaaatgggctgagcaggattttgctactagtaggggttttcctgtatgtgttcctagcaggatgtgtttcctttcatatgaaccatagaagtacatctgctggaatctttaaacagatagcttttcaataaacaggaaaaatgtcaaaattgtcattttttatgagatggaagtagaatagagaaaatgtaacatttactcaggtgttttgagtgtattttatttggtgctgttgcaatataaataccctgtcttgtctgcattttttcctcctaacaccctacatgtttcctatgtagcttataagataagtttttttttttttttttgagacggagttttgctctgtcactcaagctggagtgcagtgacgcgatctcggttcactgcaacctctgcctcccgagttcaagcaattctcctaccttagcctcccgaatagctgggattacaggcatgtaccaccaagcccagctaatttttgtatttttagtagacatggggttttgccatgttggccagtctggtctcgaactcctgacctcaggcgatccacttgtcttggcctcccaaagtgctgggattacaggcgtgagccaccatgcccggcccttttctttcttttgtattttgtgttttgagacatggtcttgctctgatacccaggctggagtgcagtggcatgatcatggcccactgcagccttgatttcctgggttcaagcagtcctcccacctcagctccccgagtagctgggaccgcaggggtatactacaacatcacacccagctaatttttttttattttttgtagatatggggtctcgctatgttgcctgggctggtctcgaactcctggactctagtcatcctcctgccttgtcctcccagaatgctgggagtacaactatgaaccactgtgcctggcatgtaaattttgtacatttaacttcacatggtagtattataagaagcatgcctttacactctcctagaggttgaggattatcacctgactaataagatgaaggttttattgcaagagtacaaattttctctgacacataaagcctttaaaccatagaggtagaccttatttttacttgttcttggttaaaatattcacccaacatgtaagaaaaattttaggccaggcgcggtggctcacacctgtaatcccagcattttggaaggctgaggcaggcggatcatgaggtgaagagatcgagaccatcttggccaacatggcgaaaccccatctctactaaaaatacaaaaattagcagggtgtggtggcacacacctgttgtcccagctactcgggaggctgaggcaggagaatcgttgaacctgggaggtggaggttgcagtgagccgagattgtgccactgcactccagcctggtgacagagcgagactctgtctcaaaaaaaaagaaaaaaaaaaagaaaaattttaacttttttgtttccttagatgttaagtattatgaatattagttatcagcttttacattttatttgaagataaaaagaggagtgtgttatctccttattaaaaatttattatgacagttgctggatagtcaaaacctgtcccgtaatccattttttttctttttaaagtgaaaacaagtttattaagaaagtaaaggaataaaagaatgattactccataggcagagcagcccgtaatcctcctttttggccttcagtatcacctggaaaacttggtgagggagacaactgtccatgtttctaagatagaggtttcaaccaacgcccagagagagcatctcatagttgagcctgtgttctcaacctattcctgcattgtctcaaaggtgtatcaatttttattataataaaaaccattctagaatagttgctgttgtattggaaaataggaggagagtgataaattacatcttaaaaagacaagtaaggtttgtatttcccatgttttgtagaggttaaaaactctgttgcattatctcccattgaaagtaagtttattttgaaacttgtaaatattcctttgatttgcttagtgaataacttactgctacatcgtcttcctctttattactgagatgatcttactgttgcaagcaagggaaagcctatgcagttttaagaacttgtacttgaaagacctaatgagcaagcagtttttccaaagttgaaccactctctgacaggacatttaaaatcatacctagtatttccttggaatttgtgcctattgtgttagttcaggattttttcatttactctttttttttcttttttgagaaaattagatccctttataaaatgctttagttttagggggacattttagtcatctaatttatgatttgatcagtttgggacaatatagctgataacagaactcctaagtttggtgatatgccatcttaatttaaaggttaaaactgaacagtttttaaagtggtaaaacactaataccatttgacaatgcagacagctctcttaagaagaggaagtttttgtgtttgggatagttcccaatttttcctttgtttgcagagaaattaaactgcagaaataccgtgctgaaatgggagaacataaaattctgtaaagagtccttgataagtggtgccggttcttttatatgaaaattctacttttagcccataatcagtagggacttgcttaggttttctccctggatagggaaaagctattactgggctcttaaataataattgccaacatttgttagacagtatgtactatgcttcagattctatgctgagtactttatagtttttttaaaaaaacagtttggagatataattcacatactagacaattcactcatttaaagtgtacagttcagcggtttatagtatatatatataatcaaataatctgcaaccatcaacacagtcaattttagaacattttcattaccttaaaagaaacacaccaggcatggtggctaatgcctataatccaagcagtttggaaggctgagatggaaatattccttaaagccagcaattagttagagaccagcctgggcaacatggttagacccccatctctaccaaaaaaaaaattagcctggtgtggtggcgtacgcttgtggtcccagctacttgggaggctgaggtgggaggattgctcgagctcaggagtttcaggctgcaatgagctatgattgaaccactacactgagtgcagagtgagactctgtctctaaaaaaataataaatagaccgagcacggtggctcacgcccgtaatcccagcactttgggaggccaaggtgggcagatcacctgaggtcaggagtttgagaccagcttgaccaacatggtgaaaccctgtctctactaaaaatacagaaattagctgggcgtggtggcaggcgcctgtaatcccagctacttgggaggctgaggcaggagaattgcttgaacctgggaggcagaggttgcagtgagccgagtttgagccattgcactccagcctgggcaacagagcaagactccatctcagaaaaaaaaaaaaaaactctaagcaaccatgaatctactttctgtctctctagatttgcctattctggactttcatataaattagtatgtcgatttttgtgactggtttctttcatttataatgtttttaagattcatccaagttgtagcatgtattagtacttcattcctttttattgctgaataatattctgttgtacaggtaatatcacattttgtttatccattggatacaatggatagtctgtatttgggttgcttctaccctttggctcttgtaaataatgcttccatgaagactcatgtacaagtatttgtttgactacctgttttcagttcttatgagtgtatacctaggagtggattgctgggtcttatgataatgctttgtttaattgtttgaggaactttcagacttttccacatcagctgcaacattttgcattcccaccaggagtgtatgagggttctgatttgtctatattctcatcaacccttgttactctcagaattttttattttagccatcctagtgggtatggaatagtctctcattgtggttttgattttcatttctccattgattaatgatgtccagcaacttttcatgtgtattggacatttgtacatcttctttggaaaatgtctattcaagtccctttgattcatttttaaattggactatgtttttattattgaattgtaggagttctttttatactctagatacaagtgtcttatcagatataaagtttgcaaaagttttctcccattctatgagttgtcttcgatttcttgatagtgtcctttgaggcataaagtttataaattttgatggaatccagtttttctaatttttcttttgttgcttgtgcttttggtgtcatatcttagaatcctttgcccagtccaaggctgtgaagatttactcctatgttttcttctcagagttttatagttttagctcttatgtctaggtctttgatctattttgagttagctattttacgtattgtcccagtaccatctgttgagaagagtttttccactgaattgtcttggcactcttgttgaaaatcagttgaccaaagatgtatgagtttacttctggactttaattatattccattgatataaatgtctgtccttattccagtaccacacagtcttgattactgttgctttgtagtgaggtaagttttgaaatcaggaaataggagtcttcctaactttttctcttttttctccccagggtcatttgggtatttttggatcccttgcagttccaatcaatcccttcatccatttctacaaagaattcttctgggagtctgatagggattgcattaaatctatatcttagtttggggaatattgccatctcaatgctaagtcttctgatttttgaatgtggaatttcttttcattcatttgtgtctttaatttctttcaacagtattttgagttttcagagtatgagtctttcatctccttgattaagtttatttctaagtattttatttctgatgtattgtgagtggaattgttttcttaatttcacttttggattgtttgttatgattttataaaaatacggctaggcatggtagctcacacctgtaatcccagcactttgtgaggccaagacaggaggatcacctgcggtcaagagttcgagaccagtctgaccaacatagtgaaaccctgtctctgctaaaaatacaaaaattagctgggtgcagtgtagtcccggctactcgggaggctgagacaggagaatcgcttgaaccccggaggcggaggttgcagtgagccaagattgcaccactgcgctccaccctgggtgacagagcaagactccatcttaaaaaaaaaaatgatttttatatattaatcttgtatcctgcaaccttactgaacttactggttcttttagtggattcctcgggattttctgtatataagatcatgtcttcagcacacagaaatagttttacttctttctttccaatctgaatgtctcttactcctttttcttgcctaattgccttggctagaacctgtactacaatcctgaatagaagtggcaagggtggacaagctcatcttattcttgatctcagggagaaggcatctttcgccattgaatattgagttagctgtggtattttcatggatgcccattatcaggttgaggaaattcccttctattcctagtttcttgagtgttttatcatgaaagagtatttaattttgtcaaatgctttttttttgttttttttgtttttttttgattcagagtctcactctgttgcccagactggagtgcagtggcactgtctcggcttactgcaactgctatctcccgggttcaagcaattctcctgcctctgcctcccgagtagctgggattacaggtgcccaccaccatgcctggctaacttctgtatttttagtagagatggggtttcaccatgttgtgcaagctggtcttgaactcctgacctcaagtgatccccctgcctcagcctcccaaagtgttgggattacaggcatgagccaccatgcccagcctcaaatgctttttctgtgtctgagataattgtgtgatttttttttcttctattgatataatgtgttacgttaattgattttcagatgttgacccaacctcgcattcctaggataaatcccacttgattgtggtgtataattctaattctttttctgtgttgcttgatttcgtttgctggtattgttgaggattttttgcatctgtattcataagagatattggtctgtaattttcttgagatgtctttgtttggttttggtatcaggataatactggcctcatacaattagtttgaaagtgttcccttcttctctatctttggaaaattttgtgagtacttggtattttttaaatgtttgatagactttagcagtgaagtcatctgggtctgggctttcttgtctgtggttggtttacattctttttttttttttttttttttttgagacagggtcttgctctgtcacctaggctggagtgcagtggcgtgatctcggctcactgcgacctctgcctcccaggttcaagcaattcttatgcctcagcctccctagtagctgggactcctggctaagttttgtatttttagtagagactgggtttcaccatgttgcctaagctggtctcgaactcctgacttcaagtgatctgccttcctcggcctcccaaagtgtggggattacaggcgtgagccaccatgcccggcctacattcttattacaggtatcattcccttcattttgtgaatgggaaactgaggctcagagaggttaagtaatttgctaatatgttgcagagctcagatttgaatccaaattatcttatgtcagttactaggatgacaatagtagctagtatttattgagtgattaattttgtgtatttaaccatacaaggtactattatagcataagaatctcctgccaccatcccatcaccaattgatcatttaatgatcacttcaactttatatgcattgtacccatttttggatagagaattttacacttaatggagacttagtgacttgctgtactgtaccacggccaggaagtaaatagtacagctgtgcttctcacttacgaggctgtctgactctggagtttgctctcttaattgctatactctattgtgtgcctggagggcctgagacattctgtgcaagaaaagcggctatgccacatgtacacaggtgagcccagatcagatttgaccttggaagtgaatgggctcacactgcccttcaagctccgcttagagatgcctgactcagcacagcactgcggaagcactggcttttcttactgtctctgccctgtagctaacattctactctgtgattgtagcaaaagaacttctatatcattctatccacatgtatttaggatgaaaataagtatgcataatatggaaataacttttttttttttttgagatggaatcttgctatgtcgcccaggctggagtgcagtggtgcgatcttggctcactgaagcctccgcctaccaggttcaagcaattctcttccctcagcctcccgagtagctgggattacagatgcctgccgccacacccggctaatttttgtatttttagtagagatggggtttcaccatgttggccaggatgatcttgatcgcctgacctcgtgatccgtctcagcttcccaaagtgctgggattacaggtgtgagccactgcgcctggtggaaatcactttttaaggtagtttagtatgtatgtcagccagaagatttgtatagtatctttcaatgaagacaaagcattttacatatttatattaatcttcctatttttatgaggttagatggtatctggcctatttgagtgaagaggaaaaatcgtctctctttttcaagtgagaggccttcctcaaatatccattcacatttaaaagtgaggttctaaaagctgaccttatgcctgtgtgagtggaggggcacattgaatggtggacctcactgagggcagtgatgtctgatctcttgtggggtaaggcaggtggtatcttgggagccaggaggaacaaggggctggaggccccactgtatagaaccaggctgtcagtgaggcatctgttcacacctgtgctgggtgtcatccaggcccatagtcaggcctctcctggcttctgctggggagagggcaggccagtaccctggttgtgcagccctgggatctgggtgtccagctgctcctaattcaggctttcagtcattttctctgtagtccctctcccacatccctgtctttggagacacacagtttctccttggagtgttctggggattcacagtgggccttgatgtcctttttgtgcgctcctcctgagactcagctgagtagaggacactcacacttcagtcagttacacgtgcatgacagctttccatcttcgaaagtttattgtcacatttgctctcttgtagcctcttttccagtcctcttgtcctttcatgtttttacctgcttttattttttgctttcattttattaggattttaggaaggagtggagataagtgctgtttgtgtttcttttgtaaattcttcatatcctttgtctaattttctgttgggttttaattgtatgaatttgtaagaacgttttatttatgaaggatgttaactctgacatggtgcaatccttttttcttctacattagcttacttttgaaacacttgcttgaagatgctggtagggattgcagcttctataacttgtacagatggttgcagatggttgtgtggggaagtggagcccaagaccagctggctgtacgttggcttttgtatagatgtgctttccttttgcttttcaccacctcatggaagctgtcttatctaactcacgcttgagaagtattcatattgattccaaaatgaaggaccctggccacgaatcatttgccatctcctctaccaaagactcaaaatgtatggccctggtagtcagctgggaaagtctggcaataacagctgggctaaggaacgtggatgctcaattgcctgccaagggtctcttacttcagcccggctacatgcccccagcattggagagaggccactttcacacatgcgttggaagggtaagagactctggcaaaaataaattcgtctctctgcatttagcagtgggctcagggccatgaggaagggaattagaggaaaggaattagcaacagcccaccatgtgtctcgtctggcatgagtggacaggtgttagctctcctctgtatatgaggatctgattttcagctgagttgtcgatgttgaaccatgttccatttccacttagatttttatccaggctccttctatctaaccaacatgaacagaatgtcctgcagtagcacataggaaaattacattgggtgcagtctaggaaatcttaatcagggagggcctggtgatctgaaagcacaaagctttcagtgtctatcagatgatttagtcgaatttggagtctgaaatgacacataagacagcctaggaacctagctctgtgtcacctcccctccccttcagagtccctggtttactagggaagtggctgtggtggatgatcagctcagtgaaaacccagcctggttttgtttccccccgacaatagcccctgcatttttcctttcctaggtcccaactgttactgctgtatcactccaggccttcctcaagtctggtttactgtcaaatagcttcctagcccagtatctggctttgagcttgttcctgtgtaagctgtccagtgtgctcctgccacatttactgtcatcctaaacatcactttgatcacattgctttccatttaaatacttttgctctgcttttcccagacctggctcttacccgttaggctgctttaggctgacttttcctgtttctcactgtgtaccacttagcactaggcggtttggtagtgagttgctctgattattacgtctgtgttagaaggagattagaaggcttttgaagtcaagggtgatggctgtgtcttttgaattcctcccatagctattcttgttgaaacactctggggaatagacacaattctcagacagcagagtgttgatgtctagggaaaatgtttacaatctgaaaaattaccttggcaggctgaggacaaagccacaaaatcgtaacttgtttttcggctttcttcagcctcacctctaccagagaatttcactttggagttttcttatctgtaaaaggggaagggttgaagtacattatctgtcagctcccacccaaccctgaaaggctaattttctttaattctttcccttaatctttccattgaaattaaaactgatgagctgtttctggatcttgaattaggaatttttcatttctttgtaattctttccctgacgcattttgcagttgtctccgggtatgtgctgctaaaagaaatttggattgcaatttggctactttttaggagagcagacaaaatgccataccattctgtttttcctacttggagcatttcatttgtaaaagtaaagctttcagtttggtgcataattctaacataattctcactcttcctttgcagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaaggtaggtaatttgatcttccattctggtagacaccctctgatagtctccatactttttccttaatagattgacagttcactaagaattgtatttgtgaaaccattagactctgatgtaattgaagttaagttccacacgccttactaaccacatcagtttttctctaacagagaatcattaaatagaatagtgacctctgttctggggatgccctctatggatgaaaaaattattataacgatgttgtgagcatgggcaggcataggaattttaagatttcattcttaatcatctgcttttcacaaaaatttttcttttagagtgcagttttaaaaactggcttttactccaaagtaaagttttaaaaacagttacattttcaaatgggcagaaatttgtaagataatattctctttttttgtgaagtcataaggatgagccctttttcttttcttaatttcctttttttttttgagttggaaatggaacaagaactcaagaaaatgtcctcaatatagatttcaattctggacaatagtaagtttcagcgtaggatttaaacagtgttaacaagtggtagaaataaaagatctttactgagaatggttctatgttttcttcaacttcagtagggttccaagccctcctccttcctttatcctcccagaaagcctgctccaaggtgggagattagataggaattttgtgcatttgctgaccaatcatgaatactgcagatcaaaatctatagttactttatcagcaaatcccagaactgcaaataatgaagaaaaaaaagctgtgaagagggcctagaaacagttgttttctagttagcttttaggaggaaaatgagtttggtgagtcctgagctccagtgataagggctgggtgctggtgaggatgcagatgttgggtcgtatgacagctgtttccactctgctgaaaacagcgggggaagtggatccccgctgtttctgagccccttatattcagggtacatctcatcacaatggatcatgtgattctgagagtggttacaataaagtgaatttctgtcagagggttgtttcccattgtatgttgatgttttttccttgggaaaactctcattgggaaaatgtccaattctcttggacttttgtttcagagatgctggtgactaacttgttttattataacatctgatttttacttcagtggccagatagataacacagtagaaccatctcctaaccgaagaagggagatgggtgcctttggggaacaaatttgatacgtgttttcaaatgtaccttcttattggcgaagatgaatcttttcattaagttgaaaatttattttttatttagatacttttatttctgttcaaaaaattgtcgttcagtggcagataagtacactacactgttataagtgttcttcatctggttttggagtggggatttgaactcaaggccagttgcatttggtctccacattgttttagcttattccttcaccaagagcaaggggcatttggaaacttgacattttactggtaggctttatggcagccaactgagaagacagccatagcttgttagctaaggtcagacactggagcaccatgatttgttttggagttacgagtttttatttccccttttatagactgagggataaatgtaagactttttttttccttcaaagaaatggaacaagccaattaagaagcacaaaatagacataatgaatggctaatcttcctctgaattcagacatttcctttcaactttcacatccacaaaggttctgtgagttcatctttgcttttacagaccatgagaaactgagtttcacttatcccatttgagggagacctgtgtgcagtgccccagctaactgatcttatgatttggtttttccttgcattcagtgacctacacttaatgaatgtgtccttgtatttcattctttaaccagcattatgggaactaggatagaataagttgctttacaaattgtcatgtttagatgaggtgttgctttttagaggagcatcgagggtctttcccaggctataatactgtctgtctagctttgctccttaaatatgagtttgttttagaggaggtgacattggtataagctaagccctgtgacagccattggaaataagatcaatacttgggtttctatagtcgataggttcatgagtactatgtgagatttttgtgtattaaagtgtgtgtatttagctcttagcgtcaatgtggcatagagggaagatcacaaatctgggaattgatgagctgtggagttcagtcctggctcagtcactgacttgtagtgggacgtggatgtgtctctttatccttccgctcctctgtttctctctctgtaacataagcagctgtgtataaaagttattttctggccgggcacagtggcccatgcctgtaatcccagcactttgggaggctgaggcgggcggatcacctgaggtcaggagttcgagaccagcctggacaacgtggtgaaacctcgtctctactaaaaatacaaaaattagccgggcatggtggtgcacacctgtagtcccagctactcaggaggctgaggcaggagaatcacttgaacccgggaggcggagttgcagtgagctgagatcgtgccactgcactccagcctggacgacagagtgagactccgtctcaaaaagaaaaaaaagttattttctgccttggaaattctagatcatgtcagaaatgcttctcaccttccatggttctcagctatgaagtgatttccagtgcagttggtgtgtactcaaaattcagcaaagaaaacagttttgttccatttttgtccccctaattcaatgtataactttggcaagtagatgcctttttactcctggctgctttttcactaaggcaaagctgagcccagcaaagaggagtggtcctgtggtccctcatgacagtcatgtgcctaggtagttctcagtaggatctgctatggcagggcttggcccgtgagccctggagtgtcaggtgacacttgccttttttttcttctaagttgctgttcctacctgagatgctggctggttaccaggcatcagtagctggtagaaaatagaatgatcttccatgttatcagaaaacctacatttctctatggggctgactgccttcttgatgtctaccttataattttggtatagtcatgaatatttgaataatggttatacattttacagttgatatttgattgtttacacaatatgagtgagtcttcatatacgattagttggtttgattgtctgtaagcagagtacctgctgtgtgccagcatctgtgccctccaggagcacttgtgtctaagaaagcatcctggcagattgctggtactgaggtgtttgtctcctcattagaagtacagcctcgaagaagaaatatgatggggactccaactacatggtgaacccattaatcccttttcagtacagggctttgtaatactagggctctttaccctggaaaagagactcctacaactttagtgtcttggcaactatgaaatagttttatcatgaggtgttgctttggtttaaaggcaaagaaaaactaaattcccaattataatatgaagttatgtttgaaatcaagatagcaagaaatgatgtttagatgtgtgttaggctccaatacatgttgatagcagcctggcatgattttaaacacgaaccttaaaagatgggtatggcttttaataattatctcatgggcttctgagaatgttttcccttttttgtttctggttatagacaggcaggttagttttggtgatgcgtttgggactctgtacataataatactgaatatgtacacgttggaattaaggtggattatgaccctttcagaaaggctcccatttgaaaacatggttttccatgaatttcttttgaaagctatttagtgtcagcagtaaataaggcttcttattgcaacctcatgaggcttgtggttagattctgggagaatgtaaaataagttagacatggtttctgtcttccaggacttaaaatctgaagtgaaaagagtaatagggataaatacatcaaagcacatgcatatacaaagacacacacatatgcagcaagcagcacacttaagaatgaatgtatgcttattttaagcatatggtttatgaggtgtttgttaggaaggttttattagggaaagtgggatttttgaagaggtcactgccggaggaatatagaaagtcctcagtcctgaggtgggttgatttagattagcacacgtgattcccactctcttttgtaatgcttccatcaagctgtggcttgccactctgccatgacttttcaaggtgtggcttagtgcatttacttattctttagtccttcagaggatgaataatagcagtcttgctgaacataagttggctttgtggttttggctatgaggaatacttttttttcttgccacaactgcacaagctgccttgtctcaagagcacacaggttttcagccctctgtgtaatctaccacgttggcatgaataagcctttcctttgtggagtagccacactcgtgacgtagatagaactgagacattccctccctattgtgaaccatggagggctcatacacaccagtgtttctggatagatacacatacaacccccccgtcccctccctccccccgacacacttcatatcacaacaagcctgtaaatcctgccttaaacaagtaagagggggaggaatcggtaagaattatatgctcttgatctcttgacattctcttggctggaggatgcgaactagatggctcctgtcttcccaagttgctttctttctcccttccttccttgagtattgtgaaatactgtgaagcaactttggtgaattggaatgatagctgatttcaccctcacagaaactacctgggacaagaatgctgctctggccaggataggatgggtatggccaggtctctgttagctttttgggtcatgatctcttcttctctcccatgggctcctttgttgtagctgtgtggtactttcttatacacaactgtgtttctcccatttattttaggagctgtgtgtgggaatatttgggatcttgctttatttatgtctgtgaacaatttttcaactcattttgcagtttttcatgtagggttttatgaaagaatttagctctacagaaaatcatttgaaagactgttttttttttttttttttttttttagttctcccaagggtgatacatagccagtcttctagatgcataggattaagagctcattgcctataatagcatatattagagcattaggactttaatttcttatagaacctaggttgatgaaggcagctttggaatgtttctgtcatgttggttgaggaagagatcttgattcatttcagtcagtattccactaatgatgatacttggtggtcttttcttcctgttcattatccagctcagatgttgcctttgattatttactgaaacagaggaactcatccattgggttctcttagttgcttcttcataccactggtaccacagcctgcgttatcacattattaaaattattattcacttaacggagggaatggttagaattatatgctcttgatctcttgactcacttggatagaggatgcaaactgggtggctatgtatatggtagccttttgtgcaggttctccaaaaacttgccttactatattgtggtaggtggcctccaacactgaatagggctagcctgtgtaaccatagggtatggtggaattgatggagtgtgaattctgagactaggtcataaaagcccactggctgctactttgtctcttttggagctgccatgttgtgaggatactccagcagctctgtggcaaggtccataggacctcctgatgactgccagcaccagctcaaccagccatgtgatgagccatcttgaaagtagatcctgcagccctagtaaagccatcaggtgactgcagccctggctgacactatctcgtgaaaaaccctgggccagagccacccagataagctgtttttgaattcctgatccttagcaactgtgtgagtaataaatgtttattgttttaatcagctgaattttaggataacttgttaatcagcagttgataactaatacatatattcttagactgtattacgtgactcataatgttagttcacacaattcatatatgagtaattcagagtgacttaaaaggctttctggtagttttgaacactatatttccacctagcctttaagaaaaaatctacgtagaaatataatatctatatacatataaacattcttaagtcctaagtgaataattgagggattcctttcaatagcaagagaaagctatatggcaagattttgttatcctgtattccatggtaccttcatataacctaaaaaatgtgttataagatcatagtcattatctcgtacttaacttcaattgtgttattagtttttaggaaataatgtgcaatgttaacattgatgggactaaaagtgatgttttattttcttctttataattacctgcacttaaaaatatttttttacaatgaacttattacatattgagattttgaaaaatattatcagtaatattaccagagtacatataaagagctaactattgcttaaatgtttgtgaaatttaacacagtactttagaaaaatcacattcattcattcacatattcattccttagtgcctgcatgtgcagcgacctgtggtgggttcttgctttttttttttttttttttttttttgagacagtcttgctctgttccccaggctagagtgcagtggtgcgatcttgactcactgcagcctccacctcccaggttcaagcacttctcctgcctcagcctcgtgagtagctgggactacgggtgtgtaccatcatgcccggctaatttttatatttttagtagagacagagtttcactgtgttggccaggctggtctcgaactcctgatcctcttgccttgccctcccaaagtgggattacaggcgtgagccaccacacccggctaggttcttgcttttaagaagcttcaacaactgtgcttgatctctccaggggggtgctttgtgcatgaagtgctttagcactggggtgtgagagatagtttcaccctaggcttagaaggtaaggaagacatcacagagaaggttcggtttgaattcaggtttttttttttcctctgcgtaggagctaaagatgaaacagaagaggagccaacccaacttttaaactgttaagttagtagaggggctctgtccctaggagggcaaagaagtaggtggtaggcacattcctccttcagactccaggatgtctagtttaggtggatttttgtagtattgcagaaatagaatgtttgattggaagataaacaaatcatttatgcatagtgtgaactaacattatgagtcaaaagaagctgaaggatagctttttggtagaaaatcctacatttcttgaccctttctttcactttcagtgtgaatttggcaaaattggtattttccttgattgttatggggaaaagaactagaataagcactgttttatattttagaatcattgttttaactagatcaacatggcgtctttcgtttgtatcatctttaggaaaaagcagtgacttctgtcacgttgatggaaatgagactgcagaatgtcagcagatcgtacgtggatagtccccttcatgaacagtgtctctgttttttcacttggtagggtgggatcattcctctgttctacagttgtagaaattgaaaccaaattgagtggttgtccaagaccgtgaggttgtttgtgaattagaacttaggttgctgagtccttatttgatttgtacatgtatatttttattaattttttttctactgagtgtgaacgaatttttctttaggggggaggatatagaatctgtggtttagccgggcgcggtggctcaagcttgtaattccagcgctttgggaggccgaggcaggtggatcacctgaggtcagcagtttgagaccagcctggccaacatggtgaaaccctgtctctactaaaaatacaaaaattagctgggcatggtggcacacgcctgttatcgcagctaatcgggaggctgagacaggagaatggcttgaacacaggaggcagaggttgcagtgagctgagatagcaccattgcactccagcctgggcgacagagcaagactctgtctcaaaaaaaaaaaaaaaaaaaaaagctgtggtctaatggacactgaatcctttgcattctttctctgggattagagagtttaataacaaaaacagtaacttgacagggctttcattctgtcagctcagagaattgtcttaggtttggaaagtacttggtctataccatgccttgtgaggacacagtgacagtgatgaaatcgcagcagttcacatttgttgagggcttcctttaagtgccaggcgccgtgctgataagtgccttctttcatgggctacttgagagggaatggcagtctcctgacagtgcttttctgtgtgatccacagtctttgccagcacctgctggatttgcattggctgcatgtctgccttactgtgcattgctgacaggcaatttccatttctacacattgtggtactctgttttagacaacagtggcagtgccggtagccctttgtacagatgtggacatttggcacttggtagctttggtgttaggggcagaggattttgttcagagccagccagtgtcctgacatgtcgtgggatgcccattcactgcctcctgaaatagattgtctgatgcctggagcaccttcaactgccaagtgtatgggccgtgaaaagctgggggacaggactgggaggggtggaggatgcagggggagggcaccaggtgcagaacaatgacttccaaattatgtcacgagctgccagccacacgagcacggcctggcctcattaccacatgaagtgccacagaagggccttttcattttctcctagtgactgtgttttccacagttttgctgggaggggtggggtgggcaccctgctcacccccagttaacaatggagcacaaagtcctggcagaaggaacttcccaatgtaccccggggctatttttgatgacagtgagtggctgtgactcactgaatgtgtgccctggcagatgatggtttccaccccaccccctcccctggagatgagcaggcagcctttgtgcgtttccttggccagcttctcctgctgctgcagttcactgatatgtccacagcagccggcccgcaggcctgacagggctctgacagtggtttttaccatatatggccatcagagcgctgtggctgtcagccggccaggataatttccttcctttgctttgattggctgcacgggtggctcagagaatggtgggatctgggagtgtgtggtgaagagaagccactgagtcaagtgcaaagaacgtttaactctttactgggtttgtggagcgtgccagtctgtgctaagcaggctgacaattgctgccagcagaagccctcagtgtgtaaacatggtaaccccagtctgggaaagctgctgtatctccggtaaagaaaggtatctgaacacacattactctgaaataaactcaaggtgtcatgaacacatttctggagtcacggttttgcccagaagccaccttataaccacatgtagcaaatcatctgctcctgccaagttgaatatcttcgcccattaggggtgggacctgagttgagtctggggaagaatgagctgagagggcatgtgatgggacacatgtctgctttcttggaggaacggtgacttgggtttcatttctggctgactgaattgagtctatactgcagtcctcttgcttgtgtggaactgactcagccatggagcccaaggcattagcccctcccaccccccaaaaaaagttgtaatatttttctatttatcatctccaccatccaaggagggtggattttcattctgagacctgtggattaaaccaatgcagagctgcaatgggaagggttagccctggagctcttcagcgttcacagagggtttcagtagatcaatctccaatgtcatttgcttactacgagggcttagacaaccagtttctctattttctgatttgatattgaatgctttaattttccatattgcatttacatctgtagttcttctgcttttcagcttttgctttctagctcaattttattttaactagattctacctcatcttgggttccaagtttttatttgttctcagcccagaagcatcatatggaattacttgtctgcaataatgagcagaaagcattaggttttcactttataaattctttaagtcaggaagttaggaaatacagctactctggttgctatcgcatatttgggcaaggttgagtaaggaaatgttaacttttccgtgtttttgctttctgataataaaatgtttgtagttttacaataacttccctcaagttcttaattgattttaaaatatggtctattcagtattaaacccagtttttagagaggatctgtgatgcaaaaattatttgcttggcattttcacttctgtccaaaaagactgctgttttttactcacaggcaggtgaagtctctgtaggcccatactccctctccccagcagcttttgtttctagcttaccttaccttacagggtaactcaatctgtagggtttattccagagcacctccttttacctcaaggatggtatttctggttcccttaaagtaaagcctcctcagaatgttttattcctgggccatgagctgtcactctcagggaccagcctgtgcacaagtcatatattgtgtgcacccgtctttttggtctgctgctgagtctctgttttccatgccgctgtccccttgtcccatgaccacaatcactctagctcctccccgtggagcagcaggggcttaagaaattcaaacaaaacatgtatccacataaataatactgtcataagaaaaaggaagttgaaaaaaatggaaaacccacttcaatagatacgcttttgactcctttgaactctgcacagtgtgaatggagcccttatgcttgggctgaaaacttttcctctacttctgagcacatgtgtgacttaacattctccttgctgagttgaagaattctcagtatgtatcacccaaagccaaaaataagttatgattgaaatttgggcacataaagtgattttgatactcattttttcctaaaatgaaaacttagatgaatattaggtaggggtttgaacaatgtggaaatcttttaactgttctttgagtcaggtcatgtaaagtatctttgtttgccttccccaggatggggtgggggctcttaggcccttacatcttcgggtggtgtaaccagtctggataataggcatagaggactgcagatcaggagatggaaaagtactggaagtgagacagctgcctgagttggattagataagggaaaccgtgtagaaagcagtctgaatccagcaccctaggaaggtgtgggtttatatgatacactccagaatgcaaacttgaaagaaattgtgtgtgggataccttgagcttcttaaaggggaatatttgatttgacttatcactcgaatgaatgtgtcactttttatcaccatgggaatttattactttgtgaaaacatacattagttatgagaaagagtaggcctgctgggtaaagcgttgtgcgactttaacataatgttacatttcctttcttgcaggaaccagtgattatcagattgatccatctttttttgttttttcagagatggagtctcgctctgttgcccaggctggagtgcagtggtgcgatctcagctcactgcaacctccgccttccgggttcaagtgattctcccacctcagcctcccaagtagctgggattacaggtgcccaacaccatgcccggctaattttttttttttttttttctgagacagagtctcattctgtcgcccaggctggagtgtagtggtacgctctcagctcactgcaacctccgtctcccaggctcaagcaattctcctgcctcagccctcccgagtagccgggattacaggcatgtgccaccacaacgggctaatttttgtatttttagtagagacgagatttcaccattttggccaggctggtctcgaactcctgacctatctgcctgccttggtttcccaaagtgctgggattacaagtgtgagccaccgtgcccggcctgtatttttagtagagatgaagtttcaccgtgttggccaggctggtcttgaactcctgacctcagatgatccacctgcctcggcctctcaaagtgctgggattacaggtgtgagccaccgtgcccagcttagattgatccattttaacaccaattggtagtgtcttcaaccacaaaccaatatgtgggtcagaaataattatgtgaggaatcattcttacatgaagaaacagtcattctgaatgatcttttgtaatatgtaggacatattggaagcaaaattcccaatgttgaatttcgagagtttgggaaggtgaacatggctgcggtacatgtgtaatacaccactagctgctttaaaaacacaccccagcacagaactttattgagacgtgtctgtcagaaattttctgtacatgtttgtgtacattaacagttttttttattgtactcagtactgccctcaatatataggatgagtctacttcttaaatgtggattcctttttagaaggagatgtgagatcgataaataagatatactgggctgggcaccgggtggctcacacctgtaatctcagcactttgggaggctgaggtgggcagatcacctgaggtcaggagtttgagaccagcctggtcaacatagtgaaaaaaaatacaaaaattagctggacgtggtggcgtgtgcctgtaatcccagctactccaggcaggctgaggcgggagaatcgcctgtacctgggaggtggaggttgcatgcagtgagctgagattgcaccactgcactccagcctgggtgacagagtgagactccgtctcaaaaaaaaaaaaagggtcacaggggatacattgttaataagtggaagctgttgtgattttccagtaagattgataggaagtgcccttacagctaagcaatatcatttcttcttttttctttttttaattttaattaaattgttattattattattgagacagagtctcgctgtcacccaggctggagtacactggcgcgatcttggctcactgaaacctctgcctcccaggttcaagcgattctcgtgcctcagcctcctgagtagctgggactataggcacacaccatcaagcgcactaatttttgtaattttcgtaaagatggagtttcatcatgttggccaggctggtctcgaactcctgacctcaagtgatccgcccgcctcagcctcccaaagtgctgagattacaggcgtgagccactgcacctggccttattattatttttttgaaacagggtcttactctgtcacccaggctggagtgcagtggcgcgatcatagttcactgcagccttgacctcctgggctcaggtgatcctcccacctcagcctcccaagtagctgggactacaggtgcgcaccactacacctgactaatttttatatttgtagggacagggtttcgccggatttcttaagatttatgttgaatttagtgtgcctaaagaggaatgttttttgctaagtcatttaagttattgaactttccttttatagcaatttgataaagttatatttttactgatgcttacattttgattttcattcactttctccccgcaaaatgcccattggaggaaatgttgcctaactctgtgggtttagttgaagtatcagtctccaggaactcggctgtgttgtagctacttcaagatttttaagtgttttccccaaagcaaatgatagtgcttgtatctgggacggtttctgccacggtgaaggttgctggctggaacatgctcataagacatcacccttagctctggccagccacgtggaaattgtgccattacacctctcccttgtgccagctgtatacatgctttggaagctgaattttcctttcggctcatgttgcttggctctgggcaggctgtactggatctttcagataataatgtctgtaggccagtgtcctgacctatttcaccaatgtcccacgagtttatgaactggctctggagcagagcctttgggaaacttggtgctggccatttttgccacctgttgggttgacatgctagtaatcccaatcatttggagttttagctagaaaggtataacaaaagctatcctatggcatgtgattgggactagtaagtaatcaatgaatcaaaatttatttaaagcaaggagtctaatggctattacattttcagctaaactacttcaatttcatgccagaaaagtagtaatattctagattaagcaacagaggtgatttatccctagtgaaatagtggactgatctgttagtaaagtgaagtttttctatctctaagctttagaagattggtgggagtttcttaaataattcattttttagtttaaaaagatatctaaaagctggctttaattcttgtacatcttcctttcagcctctgcattcatttaaatttgctgcttagaggttcaggtaaactgtgttgtcaccatgacatgtggtggatgtctttctgagtggcccctcacaatctagctaattatacatggattctttggtttgttcactacatgataaatcagtatgtgtcgtgcagacgaatgagaattgtgttcttattagatcctagtgcaaaatgtctttcagaatgatgtttcctcatctttaccatataaggccgttattagtatggtttcctttaatctccatgaactggagccctcagcagtttgtaagtgcccagctttgtatttttaataacgtatgctgatttggtgaaatatgttgttgtgcttttgttttgatttcattatgagtaagaagatacttagaggtgtaagcccttgaaagcaggatagctgatacttgactgtgtgtttgtgaacatccagcatgccaaataatcagtgtacctttaaaatgccatctacccccatactgtcttcacatttttgttcttttatcactgtcagatatttagtcaattgcttttctcttgtgctacagtagaatactactttctctgttttatttaaggatttatgatgacatcacaaccagaggaagcagctgcttgtagaatatcattttttattaactgtgtttctgatggccaattgccaataatttttaacattacttgtgtgccttttttttacaacccatggcatagtggaaattttctttccctatccaaatctagtatggttggtcagtgatattttagatctttgcttcttgactttctctgtgcctcagtttctttatttggaaaatagggtgataagattcccacatcttaaaggttgtcatgaggacaaagttatcaaggtcttcagacagttcctagcttgtaatttaagtacttaaaaagtgttagccattgttattatttgttttgatagaaaggacagaaatagctggcagttgctctttcagtgacattcaggttccagagaaaatgttgagctctagtactttcaggctgtggatttattggggctgagctgggaatggcagtaatgcttattattattctcagatatcttgactgaagaatactggtgaatagctattaacttttagccagggttatttaattttaacttcaaaaaagaagtcatttagtaagaagcttcttagtatgtaattaagaacaactagtgctagtacttccagattcccctcaaaattgctttgtgtttgaataaaagcgcttcttagcccagattggaaaaaatcatttggtgttcttggaagttcagagctcagtactatagttggccatcaaggatgccaaatgtggtttcctgggcagagcctaggaatgcaaagaccctgatgtaaaacaaaacaattcaggtagaaaagcttttttccttgggagtaaaaaaaaattttaatgcaaatttaataataatgcattggtgtatttcttaactttattatattttaaattctttttttcaaaataagatgtatcaaaataataggacacacatgtactcacaagattaaacagatgttaatattttgccatatttgtttcatatctcccctttttgaaaaaagtaataaagcataacagatacaggtagaataccattcttatttattttctccttccccagaggtaatcttttcttcaaatatgtatcatatttttattacatatatgtttatctgtaacatgtacttttatttcgcgtgccttaaacttttatgtaaatatgtattcccatactgaaggacagtgaaattgcttctgcttttgccactatttccaacaatgcggcaataaatattcctcttgtacaaaatatgggagcatctctctcacccagaccacctagaagtggcattgctgggctggacttcctcacctctacctgttaccaaattgctcttgaaaggaattgtaacaaggtgttctgtaagcagtttatgagttcctctttcctgacatccttgtcagcacttatatttatacttttacattttcaccagttttgatgagtataaaatgtgaccatgttgttttaatttgcagttctctaattatcagtgagattgaagtatcttttcacacatctattgcgtcttcagattttcttcgctgtgagttctctgcttgtgtaatttgcccatcgttctgtttggttgttgattttgttaggtatgtatgttgcatacctcttcttgcactttgtaacttgtctgttcatttacatttttaaagaacaactcacactgctgaatttggtttgcttttgttgctgtttgtgaggagctttgcatcagtatttataagtcatataggcttcaatttttctcccttatactgtcctttgtatcaaggtgttacattccttatatgatgaattcagtggcacttttcttttttctgttctctggaaagctttgtttgaaatgatctcttccttgaatatttggtgacactcacctgtaaaaccatctgggcctagtgttttttggtatttgctgattgattgattgattgggaggtggtgatgggtagagttatactactgatcttttatggttatggatctaatttacatttatttattcttgaaaatcttttgatgttacttttacttctgtgagattgtgtatttcatctagattattcaattttatatatattgtcaaatgttattcctagtgttttcatactctgtaaatttctactttatttgtaagttatgtcccttttaaaattattggtattcatttgtgccttatctcttttcctgatctatccagtttagttgattttgttatttattttttttccactgacttctttttttcctctttttttttttttttgagacagagtcttgcactgttgcccggactggagtgcaatggtgcgatctcagctcactgcaacctctgcctctcaggttcaagcacttctcctgcctcagcctcctgagtagctggaattacaggcacccaccaccatgcctggctaagtttttgtatttttagcagagacggggtttcactatgttggccaggctggtcccgaactcctaacctcatgatctgcctgccttggcctcccaaaatgctgggattacaggcatgagccactgtacctggcatcttttctaataattttacattctttggatgtactctgttcattttctaacttctcaaggtagcaactcaatgcattaattttcagtcttttctactatatgcatttaagactgtccatttttcactaagatctgttttagttgtatgttgcacatttggatatgttgtgtattgctcagttttaactttcattctgttatccattatgatttttaaaaaacaattatttagtaaattaaaatattttcaaatgtactggagatttttggtttatttttctattaatttttaattgtattgcattatactcagaagatgctctacctgctattgactccttggtattttttgagatttgctttgtggtctcctaattgataatttaaaacaaattaatgtttaatgtatgtttgaaaaaagtgtatttttaaatgttaggtacaaggttatatatattcattagatcaaagttgttaatttttataaaatcttctgtattcatattaattttgtctgtttaatttcttaaatctttgttgacatctcttacgattatgactttgtcattttcttcaagttctgtcaacgtttgccttaattattttgaaattatatggttagatgaattacagtttatagtggcaatataactttccagtgaattgtttctttagatgtcagatagtgacattaatcgctaatagtgcatttcaccttaaagtctgtttgttctggtattaactaccaggtatactttttaatatgccgccctcctttatttgccttttggtgccattatttttttaaaatatgtgtagctggatataatctaatctgagaggccttgtcttatctagtgagcttaatcttgcatttactacaaatcatgatttatagttggttttatttccaccatctttgtgctttctagttttcatgcttttttttcttaaaaaatttgtctctgcttttcatgagttgcattcatactttctttggtcctttttttctttttattttctctttctattggattgagccagtttttaaattctagctattgtagtacacctccacccccacccacccccagaaattatacattctctctctttccttttagtatttactctgcatttggatatctttatttaaagtctaaaattagtcaatttttaagtctgatcatatgccttttaccttaaatggtattgttgtctaatgttttgtttctgtctttttaaaatctgtactccaagttggtattattagtactgttttacatagtacctgtttgtatttgctttatttatttatttgctcactgttgttttgctatacctttctactttactttcttttcctgaaatgagtccttaaacttaattcttcaaaattaatatagcaattctttgagacaaatctaagaatttaattttttgaacaagggtttacccatggtaaattctgtctctttttgtctgcagtgccttttgtttgcttttttcttgtcatcattcttgaatgatagtttttctgggtatggaatacaagggtggtggtttttcttagcatttccaagatgttttccatttttttgtttctctgattgcttctgagaaatctgctcacaatcagtctaattactctgtcagtaggtaatctgtcctttctctgttgttgcttctgggatcttctctttgttttaggtgttctaaattgcactaggatatgaatagataagaatttgttttcacttatactgccggaggtgggatttgtgcatcttaaatctaaagacttatgcatttaactgaacctgaaaaattctcagacattatctctttaatttttgcctctgttccattcttttaattctctccttttggtttgtctatttaaatgtgtgtcaaacttcattctggccttccagccttaggatgttttaagttatgaaatatcacacattcaagccacgcatggtggcacacacctatagttccagctatgtaggaggctgaggcaggaggatctcttgaggccaggagtgagctatgattgtgcctgtgaatggccacagcattccagcctaggcaacgtgagacaagaacaagagagagagagaaagaaaggaaggagaaagagagcacacattcaaaagagttactgtatctatagtttaataattatgtaaaataggatgaatgcctgtgatcccagtaccatcagcttaagcaacaatattacctggggtagtaactcaaggatgcaagtgaaatctccatcttacctgcatgatttttgtgagaatgcaataagataagcaaaaccacgtggcttagacctagtagctggtcgttctttaaggagagacaccatcagaaatgtggtagattccagcatttgttaaatttcgggtaatgtttattgagtacttcaagtgctggggcagaaccaagttctttaccttgattgtctcatttagtcctcacatcagctcttaaggaataaactgttaaacattctagttttatagatgaggaaccgaggttgagggatggagtaatttggctaggacttcacagctagaagatggcagaaccatgactacactctgggcagtctggttctcaaccatttatacttcgctgcctgtaaatgaactgtgtggctccttcctgtgacacccagattctatatgatatggtgttcattggaatttccttttttgaagtccttttttggtgatgcgttttggaagatccaaactgggttgcaagggaaagtggaggaatgtgaagaaacctaggccttaggtctgtaaacagggccatattcaggcctcaacttagaacttacctttcccagaagaaaacctctccagagactgtgaccccacaaacctgcttgaatgtcttccttctctgttcctatgtggcaccataattggctgtttaaatgtctctctcctctcactgggctccacatttagccaggacaggactgccttgttcacgtctgtatctccagcactcagcacaatgtctggtccataaaagttcacaacacatatttgttaattcttaatgatggagtaaattattgtactagaagaactaataatgtgacagcttttattggatattttattccagatactgtggttaatttttttacttattttacagataattgtaatactgaattgtgatttatctaaaagtgttctctcatttaatccttacggtaattgtgggagttaataagtatcattgttaactattttacagatgacgaatgaggtgaagcttagagagattacatgacttgtctaaagtcacctgtttaatcagtagagcctggatttgaacccttacctgtcttattccagagcctgtggtctttacacgttaacgttctgctttcctggagatttgcacagtcaagtcaaattggagaaatcatagaaatttctgttcttgaaaaattgctaagaagcctgctccagtgttgggatgatttgccatataagagcaaaaacaacaaaaaatagattaagccatacattgcagtggttcctttctgtgcacctgctcttaaagcatacacagcttcagcgtggactggcattaagctattttaaaaaggaaaccactttcatatacccattgttaacaatagcagttgtcttagttgacacaaaattggtctgataaccctggttggtttgctagattcaaatgtgtgacatgagcaaattgtggtagctatttatgaccaacattaagcattttattcttaatcagatgtggaactggctaatgggtgaggtctaagttggtgttaactagattgtctggctggcatttctgttgattgaggatagcagagagactgagacattacaatgtagtaggctctttaggccctaatgatagctaaagcttttctttttttttttttttttaactttttaaatttctttttttttttcttttttcttgtttcttttttttttttttttttttgagacagagtctctctctgtcgccaggctggagtgtagtggcacgatctcggctcactgcaacctctgcctaccgggttcaagcgatactcctgcctcagcctcccaagtagctgggactacaggcgcacaccaccacgaccagctaatttttgtatttttagtagaggtggggtttcaccttgttggccaggatctcctgacctcatgatccacctgcctcagcctcccaaagtgctgggattataggcgtgagccaccgcgcccggcctttacattttaatagtgccattcatttccagaactggtaatttatatattggaggatattgtcttattgtattaacattttgaataataccaaggtttagggtttttttttttttttttttaagccatggaacatccttttaatttacaatttggctatttagaattgtattttggcaaaaagactttcatattctcttttgctatgtctgctagtgcagttggttacatctttttggttctagggatttggattcttgtaatttgatcgcatgtccttggtagtggctttttctagaagtgaaagttgatattgactatacgatgtcatatctagaaaattgagagttttgggtggaggtaataaatgagaaatgggcctgagaaaatgtataacgtctgtggtgttgatattacataataggtttgtttctctcttctttcagactggtcgaattgacaaatcttaccctacagtatgtggccacacaggaccagtgctggacatagactggtgcccacataacgatcaggtcattgccagcggttcagaggactgcacggtcatggtaagctcccagggtgttgtgtgcacacaggccagtgagactcacctactgctttcaaaagcatgtgtgtgggtgtgtgtgtatgtatagaggcttgaaaagcagaacgttatagcagttttgactgtctgttggattttacaataatttactacgtttaagtttaattacagataatcctttcaagaagcccttaaatcaaaaaggttgtactgcagtgtctgccgtgtctttctttttcttttttttttttgagatggagtcttgctctgtcacccaggctggagtgcagtggcatgatctcggctcactgtaacctccgcctcccgggttcaagtgattctcctgcctcagcctcccgagtaattgggattacaggcatctgctaccacacctggctaatttttgtatttttaatagagacgaggtttcaccatgttggccaggctggtctcgaactcctgacctcaagtgatccgcctgcctcggcctcccaaagtgctgggattacagtcttttctgtgagtgtgtttgtgtatgtgcttattgacagttgacatgttctctgttggaagattttagggaaagtaaagtgacttttcagtaattctgtaatgccatttgaccacatgaatttcccctcgccccaaaaggagagaaaaaactgaaactgctggcacagactgtacaagacagtgacgtaagatgccaaagttatgcagataaaatgggatatgtcacaggtggtaaaagagtttttgcaattgcttgtttccaagctaatggcagaactgtgttctgtccagtggaccctggttaagaaagtccttttcataaagatatacaaacaaaaaacgtgaaaggtgaattaagtactttacattccctcctttagtttccaaaagtaggttatgtgtgaaacaaggctttggaatactttttaatatgatttcttgtccttagttatgatttttaactttaaaatgtgattattggtttggatcagtttttaatgctagcccaaagtaggctgaaaaggttaggcataaacacaaatgggagtacttgctgcccctgaaataagggaagatggtctctaattaatttgtaagcagtctcgcacatgtcaggtagtctcgcacgtgtcagcattggagaaccatgctacttttattttcctctctattggctgtggactgaaacattgtttggaaagctttattaattaaaattattttacataaatacaaattaattcctgaactgtgtcatttaaacatttacccgcttttcctcatgggcttttggctgggaatgtctcctcctgtgatctcataattttggcagctaaagcatattaaggaaatacgctgctgtgaaagggaattgttctgtttaatgtgccttgctaaattgatcattttaatggctatggacgcattttgttaagagaaaggaatatcgtttagacctgatgccagaatttttttttttttttttgggatggagtctcactttgtcacccaggttggagtataatggcgtgatctcagctcactgcaacctctacctcccaggttcaagtgattctcctgcctcagcctcccgagtagctgggattacagccctgcgccaccatgcctggctaatttttatgtttttagtagaaacggagtttcatcatgttggccaggctggtctcgaactcctgacctcaagtgatccccccgcctcagcctcccaaagtgctgggattacaggcacgagccactgcgcctaactctgatgccagaatcttaaacggagagtctgaacctcttttgaagaagcaggtttgatccatctctggctctccctgtctctagcattactggtcacgttatccttttaaaaaaaatagtgtgtattataaaacagaaaaacacaccaaatagttaagtgaaaaagcagactcagggagttaagtgatttatgacatagcgaacaccatgaaaccaccttccatgtcaaaaagtagaactttcccaacctcctcagacttctccatgtgccccatcccagtcacaacatccctcctccctctcaaagtaaccactctcctgacttttgtaatactcatttccttgcctttctttgtagtggtaatcactcaggtgtatacctctagactctagattggtcttgccagttttaaaaacttgatatgtagtcttttaagtcttaatctaaagattcctccttcatcattttcttttccctacaatttatctattcggaagccctgacctttgacctgtgcttttcaaccatctggattttgctgattgtaccctcatgttgcagttcagcttgctcctctgtcctctgaatttcctgcaaattggcagctggaacctgaagtgcggtcagattcaggttctgtccttttggctagactatattgttcgcattatgttcttccatacgctaggaagcacatgatgtcacagtgtctgggtttcatcctttttccatttgtgtattctgtgcctatatccagtcattcactaggggttgcaatatggtgacagtaaattctgtcattttgttttcaatttttagctggtaaaattttataagataatgtcctcacttacttactatttagttaccaaatagtatagttcatttaggaaagcaggataagtgcttgattctttccttttatttacctagttctcaagataatgaattgattctctgtcatcctcagaaggtgacaaattagggtttttttttccccgttcctttcattttgaagtcatggatttgaacatatttgatgggttcaatccattataattcttatctcaaagccgactttctcgccttttcccattgaaacctcttcaagatttctgagtccttttgaaatgaccatcatagtctttgagtctttgatagatagattccttgctatgtgatatgttgaggtgtttcaggctcactttggacatccctgcccaagccatttctttcggaagtcctggtttattttaagggaaaattatatctattaagtatgcagtagcattatgtatatatatatatacatttaaaaatactgtattaccaaagagagtgtaatctttttgctgtggagggtttcccctcagtgttgatggctgctgactgatgagggtggtggttgctgaaggttgggctggatgagaccacgacaataaagtttgtcatactgattgacttggcctctcacaaaagctttctctgtagcatgtgatgctgtttgatagcattttacctgccatagaacttctttcaaaattggagtcagtcctctcaaacccttttgctgccttatcaactaagtttatgtaagtaatattctaaatgttttgttgtcatttcaacagtgttcacagcgtcgttaccaggagtacattccatctcaagagaccattttctttgcttatccataaggaacaactcctcatctgttcaagttttatcatgagattgcagcaattcactcacatcttgaggctccactttttattctctagttctctatttccaccatatctacagttacttcttccaccaaagtcttgaactcctcaaatgttgatatttagaactccttccacgaatcatgaattttcttaatgtcacctaaaatggtgaatcctttccagaaggttttttttttttttttttttaaattgagacggagtctcgctctgtcgcccaggctggagcgcagtggtacgatctcggctcactgcaacctccgcctcctgggttcaagcgattctcctgcctcagccctccgagtagctgggactacagtcatgtgccaccatgcccggctaattttttgtatttttaatagagatggagtttcaccatgttagccaggatggtctccatctcctgatctcgcgatccgcccgccttggcctcccaaaggtgtgagccaccgtgcccagcccagaaggtttttaattcactttgcccagatccatcaggggaatcactatcagtggtagctgtagccttatgaaatgtatttcttaaataataagatttgaaagtcaaaatgattccttgttccaagggctgcagaattgatgttagcaggtgaaaacaacgttaatctccttgtacattttcatcagaggtcttgggtgataaggtgcattgttggtgagcagtaatattttgtaaggaatctttttttttcctgatcggtggttctcaatggtgggcttaaaatattcagtaaaccatgcagtaaacagatgtgctgtcattcatgctttgtttttccatttctagaacatagagtagatttagcataattatttatttatttattttttattttattattattatactttaagttttagggtacatgtgcacaatgtgcaggttagttacatatgtatacatgtgccatgctggtgtgctgcacccattaactcatcatttagcattaggtatatctcctaatgatttagcataattcttaagggccctaggatttttggtgcggtaaatgagcattggcgtcaacttaaagtcaccagctgcgtgagcctctaacaagacaggcagctcatcttttgaagctttgaagccaggcattgacttctcctctctagccatgaaagttctagatggcatcttctttcagtaaaaggctgtttcatctacactgaaaatgtgttgtttagtgtagccaccttcatcaatgatcttatccagaccttccggataacttgctgcagcttctccatcagcacttgctgctttcccttgtacttttatataatggagatggcgtctttcgttaacctcatgaactaacctctgctagtttccaacttttcttctgcagcttcttcacctctgtcagcctccatggaattgaagagagttaggactttgctctggattaggctttggcttaagggaatcttgtggctggtttgtatttctatccagaccactaaaacaaggctgtttttgcttttttatcattcatgtgttcactggagtagcacttttaatttcctgaacttttcttttgcattcacaacttggctaactggcttaagaggcgcttagcttttggcctgtttcagctttcaacatggcttcctcactaagcttaatcatttctaattttttatttaaagtgagaaatgtgcaactcttcctttcacccaaacacttaaaggtcatttagggttattaattggcctaatttcaatgttgttatgtctcagataatagggaggcccaaggagaggaagagacaggaatacaggaagagcaggtggtggagcaatgagaaaacacacagcgtttatcgatgaagttcactgtcttatatgagtgcagttcatagtgccccgaaacaattacagtagtaacatcagacattactgatcactgtaacagatacagtaataacaaaaaagtttgaaatcctgcaagaattgccaaaatgtgacacagagacagtgaacatacgctgttggaaaaatggtgcagatagacttgccttagggttgataaaaagcttcaatttgtttaaaaaaaaaaacaaaacaaaaacaccaccacaatatctgtgaagtgcaataaaatgaggtatgcctgtatttacctaacctctttaatattaattacatctccatctcctttctttcacacagagaatgcagggtcttagggatacagaagaagaattagaacatcctgatctatctcatttgtcttttcacgttatacatgtaatagtctcagagtgaaaatactaataccaccaccataccatgatactgaaaatcgttaaaaaactaaacgacttttagttgaaaaactaaacaactttttaaaacccatgctgtgtctattatccctccatttaaaaatgatgtattctgtattttcaagaccacatagctgttacattcagcagtctctcctcccttggttctgtgagtaactacattgaagtactctccatcaatcattgtgtcaatcttgcaccaggcatttggatcatccgaagcttgttcttgggtggattccttaagaaggagtgggaacaatattctctgagttcttgtatactgataataagttatctgtgatctttttacttgaaagtgagtttctctgaatataaaatgattgggcagggacagtgcctcacacctgtaattccagcaatttgggaggccgaggcaggtggacgggttgagcccaggagttcaagaccagcctgggcaacatggtgaaaccccgtgtctacaaaaaaataaaaaattagctgggtgtggtggtgagtgcctgtggtcccagctgcttgggagcctgaggtgggaggacctcttggacctggaagatcaaggctgcattgagccgtgatcgtgccactgtactacagcctggttaacagagtgagaccaatcctgtctctaaataaataaataaataaaattattgactcacagtttttccttgagtaactaaataccttattccattttcttttggcataggtgttgctgtcaaagtcagattataatctaatttcctttcctttataaatcatatgctctttttgcctaaatgttcataagattttttttcttcaaatatagttaattttactagaagattgttggtcattctgagttggtatctctagataccatgatatgctctttcaatatatagtttccagtcttttttttttttcttgcattacagtttttaattttttttttcctgttcctttgctttggttttctttatcagaagctcctgttatccatatgctttgtcttctttacttctctttagtcattgtcagtttctctccaaacctcttttcttttcctccccccactccttttctttctttttttgagacaaggtcttgctctgtcacccaggctggagtacagtggcacgatcatgccttgacctcctgggcccaagcaatcctcccacctcaaccttccgagtagctgcaaccacaggcactcaccaccatgcccagctaattttctattttttttgtagagacgaggtttctcacaatgttgtccaggctggcctctaacttgtggcctcaagcattcctcccaccttggccttccaaagtgttgggattacacgtgtgagccaccatgccaggccctaaaccttttttttttattctttttttttagactttattattattattattattttgctcttttccttttatttcttttgggggcattatttgttgtgtttatttgctcttgtgttctttcttggtttgtcttcatttatttctaatttttttcttgatgtctgtcactttgttttgagtttttcaagttctggtttataatgttttatatattgttttcttattttgaatcactataatgtagtttttatctcttttgagcatgtctttttagcagtcttatattgtctaaagggatcttattctgtgtcttattttctttttttctgacagtaattttggagttcaaccttgatttttttttcttgcttatttttatgtggatttaattttcccaagctttttaaatggtggcttggttcagatagctgctctaatttcacagaactccctctctgacatattcagatagtgttcagaaacatggtgccttgctttctaatatttcctagcctggcttttatgtagcctctcttatgcttttatccctcttactgctatcctgctgaaattcgatttcatttcctggagtgtctcctttgtgggcccatcctggaagggagcccgctgtgggtgattttgagagtgctggggtctagattgtgcctgcctcttcagaccttttaaattcagtacccatgtgcccagcttctgttggaaaaggcaaaatccttcccagtttctgctgctgatctcacaccggcctgctgccctcaggtctgtcaggtgtccccttgctgtcccttcccacacacacccgaggctgatcacatgcaggtcgtgtggctgttggtgtttgctcccacctgcttaaattttggggatatcacctagtttgtgtaaatgttgtccctggatttttgttttgttttgttttctgctagctctgtctttttacggagggacttcggaaaaacccccaaaaaatgctgccactgagattctctcatcttcccagaatcctcaatgtcgcccttttattggcattgctggagtgcacattttgtaaattaaataatgctttgggataaatctttctaattttaaaaaatctttaagtatagaactgatatttaaatcaccctttaatcacttaatatcccctatatcatgttattattggagtaattgaagcttgtatagcttagcagttgaaatgaaagtttaaagaaatgtttgatcttctcctagcctacctgcttcttaataccttattttccaccttgctcttctgaaggtaaaagaacactgtattatagatcaaatggtttcagacaacaccccccgccaccccccgcctttttttttttttttttaacggaaaagctctgtgtagtttctcaagcctaggctattggtagtagctcatgagctacaaatagtagatagtataacaaggcctagttttagtagaagaaggatatcaaggagatcctgggagtaggagttctgagcatttgcaggtcgcttcgcttaaacgctctcagccccagttgccttccatataatatggaggtatgataataatatgcctatcgagagtcaaaaggaagctgtaaacgtataatggactgttattttttgtaatggggattttgatggatacctatagtggattcctagcagcaagagtacctttaatagacatttcatagaaaaatacagtagaaccagtttatcaaatgaactgtaaaagaataaaagtaattttttaaaaactgctttttgtattacttatggtataaatccatgaagtcctaagcatttaagcattgatttgttaattttgtgggcattgatttagtgacagctactttgcagttttaggagagggaacaccaatcttaagatacattcccccattttttagacgtggcttctttacacagcctaaaattaaattatattgacacagtttacctttcatgtactactttgtgaaacagcattttatactatcacacagcagttgtgtaaattgtactcccagaaactacacttcactcctagctttgcagagttttggctctgtgagttcttttcttcagcagtatcttctcaaagagagttttaagattgtggctacctaagtattttacttgggggaaatattagctccaagaaaataatagtgctttaaataatacaaagagcagtcaacttaagtttagtgaatgatgttgattcaacattgttccttatctgcagggtagtaatcaaacacaaatgcaaaaaatggctaatttggacaatgggattgcataattgttccttccagagtctgggagttggaaagatattgcaaaatgatagtcttaattgtctccagctatagaatagtccaaatttttaagtttaaaggacgcttctcccttctctcaaatcagtttattcttctgtagaaatcaacaaaaataccctatctaatccatttttgcttccattataaattttcctaatatagttttttttggcgggtgggaaggcatttgacaaagactggaaaacctgctagacaatttttaaaagagctttaatgctttctaatatagtttttgccctgaaataaaaatggaagtgatgttttggttcctctcaggcattcagcagggagggcttcgtcttaattccattttgtacagattgcatctgggccatttgccagaggatattataaccctggcagatcggaacccaacactcggttcttggttttcccgaactcggtgccactctgcacgtcatggttcatttgggaatgccctgatgccctacatgcaggcctttgtgggcgtctgtaggacgctgtactggtctgcagctgctaccacatctttaagctttctcctgtctcatgtattttcttcatttcccatttggaattggtttccttaggaatggaaaaatagggtcttttgggggtgtaaccctttttatggctgtaactctagtcctagcccagtagcaagttgatgatgggtgactaaaatagggaagcagtgtctggaaagcagtatttgaaaaataaaactatttaactaattgtactttaaaattagcacgtgagagaaacccaagtgtcttagttttccttttttcttgttgggattgttctcttgagttgtcctttttccatatccaggctttcacatgtgaaaaggatgcccatggtacagtagttctgaacatgtgcttaaagttgtttttttccagaaccacaatgggattttactgatggattcactttttcatgtaggagcccttggaactgaatgtcatttttttggttatatagatgagaggtttctatgttgcacaggctggccttgaacgccgagcctcacttccttatgcaccaggacaacaggcctgagccaccacagctcctctgatttcatttttgtcctttcaaaacaaaacattgccatagtaatgtgttgtccaaacagaaaatgttaggaacacacagcattatttaaattaagaaaataaaataaaaaagaggaagtagggataacttgtactctctgctgcactgagatgcctactctgggtgttttgtgtctgttttcctctgcactcactgcatacagttttgagaaagctggttggtattacagtaccagtctgtagccatagaacaaagaaaagctaacaagcctgcacagagatcagatctgtccttactgtggtaattggcctaggtataaaccagagctttcacacataatgatatcttgggtgtaaattagttagtattaattaattgggtacagtgctgaattaatttgaagacaagactcattctaagaaattctgatgttcagacctagaaatatatatggcgtcatagtggtcatattaacagcaaaaaaagtcatcatgaaaatatggtaggctcttttttttttttgccatgcgctattctaagcctttatgtgcatgataatatttagttattgtatccgcacagtaagccatgagtgtggcctattttacaacttaggaaacaggctcagagagtggcagttttgttaagggtcacacagctgataaaaggctcagccagacccagatctgtctagctccaaagaaagccccatgctcttctccctagttgcagtatttcctattagggtggtgctttggggcatgcaaaatgtttgagctcatttaacccttctaataacccctgagtaagcacagctgtccccagtattaaggaaattcaggctcccagaagtgaaatcccttcttaatgctaacatgaccaattagtgtcccagctctgacaggagcctgtgtcttctgacacccaggccagcatcccatattacacacaagaggaccaaacatgtaccaagtggtgcttctgtttgttgttgtccctgagctgcaggaacatcagtccaaaccgagcaggccatcacccagagtagcagacaaccctgaagagggcagagagccacataatgacaggcctgtgagcatggcctttgggtgccagccagagcatgtgtatgctgagtgtggaaagacctacagaccgcccccaacccccaagctctttccacagtccaccgtagagaacaccaccccctctttaccagtggacacaagaattctgttgtcttcttatttcatttcagagactttttcactcactttcttctcgcattgcagtccttgtgcttatagtattagctttttcactctggtgctttttccctagcagctcctgagccagcttctttatggcattgtttaaatgctgcatgcactttttagaaaattgctctacacatctgcgtgttttattttgagactggatattcaatttctcctcatattctgctctactttcacctaagtcttgttcatccttagaggtcacctcctcagggagccctcctgggtggaccaagcttggttagcaggaagctaatttcgtagtagtgcggtcggcttatgccagcatagcattggttgcactgtgcaataataccaactaacactcagtgtctgccttatgccaggcattcttctaaatgtgtcagtttcatgttaccatgttagtcttcaaaccgcctcacagaaggcaggttcaatattaagtcctggaaaggttaggtgaatgtcctcaaggtcacaccactatgtgactgaatcaggaattcagtcacatcagtctggccagagcccataatctcagccctgctgtgtactgtctctgcattctggaggcactatgtgtgtgtctggctctgtgctgagggttaattaattccttaattctcttagcacacctcgcaggcataggtactaatgttttctctatgcagtgatgtttgccaggatcatcacaggtagtggcccaggcaggatttgaaccagactctgcctgactctggtgctcactctctaactgtctgtatcacaccacttggatttgttgtctttgattttcagtctgatagaagtctctgctttctgttagaccatcaacttctcaagagcagggcctgtatttagttacccagtactagatgggttacaatacaatttattgtaactcaataaatgtgttacaagaaagagttaaccaaggtagtaaaatggcttaggtgcttgtcttatgtgaataaacccagctgagggaaccgttaaaccagctggaggtgaggtaaagaaggaacacacagagtttccttattttaaaaattaataaatgttgcttcatcattaaaattttcttttaatccaggaaaagatgatggggagaagctagagaaaggaaaaggttaagtccccattatgagctctgcttctgccctcatattttaaggttggaaatgctgattataaacaaagtctcccatcactccacgtctcattagtgatttggaaaatgcactagctgtgctcagagtgagacacagaggcgttttcagtccttgcaaggaaacccagcaggccatggttggggtgccatctggagattgaaggtggtattaccactctgtcagttctaagtggggtcacagtgcatcttgcaaaatgcttttcctgttgagtcactgaagtcccatttcataattgtttttctgtcgacttcatgctttgatcaaattagtagtcactgttttctgtttgttctgttcaaaatgtcagtcctgctttatattcagatagtcaagttcaatgtggagttgtttcactaatcataaattcttgaataaaaatagtgcatgtcaggatgaaagctaacatgcagtaatggaggagagcagatgcccatgttctccgcaggggaaagaggcctgggtcaaggtctcttccgcagagggagggagagggcagggtaggtcttccttttccttctatgcttgttcacacctgccttgcttaaaatttggctctggggaaattaggtgatgttctaagcttgggccctcaaaatgcaggtttatttttgttatgatttgcataaggggttatatttagcctgggcagaatttagctgtaaaaatgaacaaatcactcaactcatgactttttcccactcttcagaatggcaaactttttgttctcattttttgcaggacagtagaactgagctgaaccctaaacactcatccagtctagatctctgccttccactaagcaattgaaaacagacaattgtttgtctccttctttaaagttcccacaaaggaaaattctttttctcacgtgttctagtgttgaacatgatttttcattgacaagttcttaaatttttcatgagctagttcctcaaaatcattttctgatggtaaatttacttgttttaatcttcatgtagaagataatgattttaaactttagctttttcataaacttaaatattatttaatatctggtcttcggtagggttcttgatgctactcagcttacctgtaactcagcccttttcttagaggttgtttgtttcttaaccttttgaaacctttgttgttcattgttaaacataaagtctttcattccttccactcatactttccctgtccctttctccccctgtgcccaggcatgtccccaattaagatgtggtgagtcttctgcatgtcttcactagtcaagaggattttcttaaataacaagttttattgagatataattcacatagaattcactcatttaaaatgtacaattcactgagttttagaatattcacaaccatcaccacagacaattatagaaaattttcatcacctcatatagaaacccaaatcctttagctatcacccctccacctgcctccctccactctccccaacactaagcaaccactattctactttctgtctttacggatttgcctattctggacatttcacatacatggaatcctgcaatatgcggtcttctatgtctggcttctttcactttgcataatgtttttagagtttgctcatgttgtagcatgtatcagtacttcattcttttttatggccaaataatattccagtgtatgaatatgtcgcattttgttcagccatttatcgatagatggatatttgggttgtttccacctttgggctattacaaataatgcttctatgaacattcttgtacaagtttttgcatagacacatagtttccatcctcttgggtatatccctaggagtggaattaccggatcatatgataactctgtttaatcatttaaggaactgccaggctgttttccaaggtctgccaccaaatggtggctataccattttacattttcaccagccatgtgtgcaggctctgattttttcacatgcttgtgaacacttgttatctgtctttttgattctagccatcctaatgggcatgaagagagagcttgtggttttgatttgcatttctgtaattactaataatgccaaacatcttttcatgtgctttttcgccatttatatgtcttccttgaaatgtctatttagatgactggcctatttttcaattgggttatttgtcctttggttgaattctaagagttctttctatattcaggctatgggtctcttatcaaatgtatgatttgtaagttattttctcccattctgcaggttgttttttcactttcttcatagtgtcctttgaagcacaaaagcttttaattttgatgaggtctaattcatttttttcttttgtaatattttctataatacatgttataaaaatattaagtgtatttttgttttccaagtgtaaaattatagaaaatatgttttaaaaactatgtcatcccatcaagaaccacagacttagctaagtgtcttcattcccattccttttcttgagtgtttcaatcattttgtagttttctttcaattttttgcatgcttctaactggagagttttgaacttaacaaggaatttagaataaaatcccaaataatattaaataaaagctgagaggaaatgttttgtagtccttgttggtatcctgatctccgataacatattacattttaaaaacagccgatacttgggagtctgaggcaggagaattgcttcaacctgggagatggaggttgcagtgagccgagatcgcgccactgcactccagtttgggtaacagtgtgagactccgtctcaaaaacgaaaaacaaaaaacaaaaaaacaaacaaaaaaaaaaccgcctaacacggtcatttcacaacattctgcctttcatccagatatcactctatgttctgtttacatagagcaaatctttatagtggatggtcactgtaaatgtgataatgaaaggcaatagctttcatgtggatcatctttcttccttgtccaacaggtatggcagatcccagaaaatggactcaccctttccctgactgaacctgtggtgattttggaaggccactcaaagagagtcggcatcgtggcttggcatccaacggcccgcaatgtgcttcttagtgcaggtgggagctgagctcagcggtcctccccttgtcttccactcttgtggctctctgagtggggggaagcaaatgtgttttggttgtgtgctatatggttttaaagcagattattaggaaaccatggtgaagagtattggggtgcactgctcccccagcccacatacatacttgtgtgtgtgtgcacgtgtgtgtgtttcaaggccatttcgacaacctgaggaaagctatgaatttcctgctataatttcagcaggtttcatggttcctgccagggccctccatgaaccatagttttggttatttctgatatggtagaaggtgtactttgttgggagccagaagccctgtgttccctctgtggtgttgctgccagctttgggagacccctattaggcaaatacactccttccttttaaagaaaactttgattttcccctgctatacaattagtacatgtatactgtagagaacatatataaacaaaaggaaaaaaaaatcacttttaatcccaccactcagagagaagatcattattacttttttgatgtttctttccgaaagatatttctgtgcacatacataaattattttacatacagagatgggttcatacactttacacatgggctgctttctgcacttggtggtaggctgtgacccttttcacgtgccattaagctctcttcctatttttaatgacttcatactaatccattttctggatatacctcattttacttgataagtcccctatttctggacactggtgttgtacagaaatcttttcctttatctaaaattggagatttcattttcttttatgaaagcaatacagagagcatgagggaactttgtggggtgatggaaatattctgtatcttgatcatagtagtggctacatgagtttatacatttgttgaaacttagcaaatatatacttaaaatgggtgcattgtattgtatgtaagttataccttaataaaagtggtttatttaaaaagtgatactaatgttagagataggatttttaaaggtctttcccctcaccagtaaaaaggaggaggggcagttcagtttttaactgggaatacacaatgtttatgactcatagtgagttaaataaaaaattataatgccaagtaactattgaaactaaggcccacttttcaaaaaagatgccatgttttttataatcaccatcgactatacttgggaatcatttttgatgttctctcagaacctcagtctgattaaggagaggaaaaaaattccagagctggaattccttcatggaaaattccctgctacctttctcatcaaggctcaatacagggcagcagcaacagactggtctgcattctcccttttacatgtgaaggagaatgggtgattgtcgtgttctgcatatttttaggctatatgatccagctgccggggctgaagttacctgtttgcctatagggaagaaggcagaggaaggttcaattgtccatcccagagtttagcttcaacttttgttactgttgtgtagtttttttctccagtttcctacttcttttttttttttttttttttttgagatggagtttcgctcttgttgctcaggctggagtgcaatggcatgatctcagctcaccgcaacctccgcctcctgagttcaagcgattctcctgcctcagcctcccaagtagctgggactacaggcatgtgccaccacacctggctaatgttgtatttttagtagagacagggtttctccatgttggtcaggctggtctccaactcctgacctcaggtgatctgcccgcctcggcctcccagggtgctgggattacaggcgtgagccaccgtgcccggccagtttcctacttctaacccttaggtaacttaagtatcctggatgttagtgactattttttctaaatgatttccaaattgctttgttggcaagaatccacctctaggatgtccttcccgtattttgcttcatccttgaactaacatcctaggagcaacacatgctgcctctttttaaaggggcctggaggcgtggggcagacccttgaaggaaggaaggagttggtgagctgagatggtgaatgagttgacattgtgggcttctttcagaatccgtttctgaatctatgtagctacttgattacagtttgggcttctcaccatgatcagagcagtcttggcctatttttctcttcatttaaaggtacagatctgttgtgagcaaacaggccttactcttggcttttcccttccactgttgtaccatctttaatatcccaaagctgtgtcttagagtctcactgatttgaataacctgccacccagagtttttgttgagtgccctaaacagtcatttaaaccttttacttttagtttatttggcacgtgaaaagggtcacagcctaccaccaagtgcagaaagcagcccatgtgtaaagtgtatgaacccatctctgtatgtaaaataatttatgtatgtgcacagaaatatctttcggaaagaaacatcaaaaaagtaataatgatcttctctctgagtggtgggattaaaagtgattttttttccttttgtttatatatgttctctatagtatacatgtactaattgtatagcaggggaaaatcaaagttttctttaaaaggaaggagcgtatttgcctaataggggtctcccaaagctggcagcaacaccctgatgcttgttttactagaaagggaaacttgaagtcacttgggtctaccagcccagttaactctttaaagaaaatagggttctgttttggtgtggttctttgtttttgtttggttgattgtttcatatgaacccaaacttaacaagttgtgtttttactttaacacttttatttcttttatacaaactttttcctttgtcacttcagtttttaacgctgttagtaagtagggcctctggtagggcctctgacaatcagccgcatcttttctctctctctctttctctctctctctctctgcatatacatatgtgtattctcactgtatctgtagttttctgagtgtgttacataggtgtttctaatcttctaatctctgatggttttgcctgttttaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgtgagtattcctaggatgaaaactcagtagttggagcacttgagtgagtgtgagctttctgctttttaaggcaggcagcggtactggtcagtgggaccctgttgtgtgtagacaccaactgtgaataagagaaggcttataaaggcttctgtctccccagttgtgcttctctccagagttgtaaattttccagcttttactcaagtctctcactttgtagccttttttcacaaagaaatagtttgtatcagttcactagagtccttaagagtttataagtcttgatcaattaaaccaattggctgcattcctgattttgcagcttagtattgaatattgatgaatcaattcctcacccttttccaaacacagctgttaaagatgcaacaggtggccgggcatggtggctcacacttgtaatcccagcactttgggaggccgaggtgggtggatcatttgaggtcaggagtttgagaccagcctggccaacatggtgaaactctgtctctactaaaaatacaaaaataaataaataaataaataaataaatgcgcagggcgaaaagcaacaagttctctcatcagctcagtgtcttagtttctgccacccaaactggacctcaacaaaatcacataccttgacaaaagatggacatttgggtcttcagtcggtgttgaaactacacatagtaagtctgagaagtcctcatttgccacactctgaggcccttcctgagatgtggttgttctttggctgcatctcttttcaagagttgggcaatgatagtagctggtgcttactgagccctggggacttgcccagccctgtgttaagtgttttctccacccgacatcttctaagggttgtcctagtgcattcattaaactactgaggtcaaggaaagcgttaactagacaaggcttctttctgccctatgatattggtagaaatggtagggcatgcctaatctccttatgttattatcctcttgagaaacaaacatttgtcagagtcctttcatgtgttttattttcacagtgcatagacttgggttggcagcaggatatggtggagagagcgagtcttctgagttaaatcctggcattcttgcagcctcacagagggaccttgaccagatcacatagtatctctttgtttcctcatctggggaagggggatggttaacactgacctccctcccacacccaggtgaacatgaatggcagttggtgaggttggatctgtgcccgagtttctccactcaccttgtcttcttgcagtttaatgtgtggcatgtgcctttttgctctccaggagaaggagaaagcacatgaaggagcaagacccatgagagccatcttcctggccgatggcaatgtcttcaccactgggttcagccgcatgagcgagcggcagctggctctctggaatccggtacgccctccccaggctttccacttgctttcacttgagctttctctctgttctgagcaggtcttccagtgagtaagtagattatgggattcttagtgtagttttctaaacgcctgattgtcttagattggatgtgaagttcttatcctcgttggagacttactggtaaatgtatttcaaagacatacttttgatactcctgaagaggctgttgactatatattttttatttttttaattttttttaattttaattttattggtcatttttgggtgtttcttgcagagggggatttggcagggtcataggacaatagtggagggaaggtcagcagttaaacaagtgaacaaaggtctctggttttcctagggagaggaccctgcggccttccgcagtgtttgtgtccctgggtacttgagattagggagcggtgatgactcttaacgagcatgctgccttcaagcatctgttcaacaaagcacatcttgcaccgcccttaatccatttaaccctgagtggacacagcacatgtttcagagagcacagggttgggggtaaggtcatagatcaacaacatcccaaggcagaagaatttttcttagtacacagcaaaatgaagtctcccatgtctacttccttctacacagacacagcaacaatctgatttctctatcctttccccaccttttccccttttctattccacaaaaccgccatcgtcatcatggcccgttctcaatgagctgttgggtacacctcccagacaggatggtggccgggcagaggggctcctcaattcccagaaggggcggcagggcagaggcgccccccacctcccggatggggtggtggccgggtggaggctgaccccccacctccctcccggatggggctgctggccgggcgggggctgcccccccacctccctcccggacggggcggctggccgggtgggggctgaccccccacctccctcccggacggggcggctggccgggcgggggctgagcccccacctccctcccggacggggtggctgccgggcagagacgctcctcacttcccagacggggtggctgccgggcggaggggctcctcacttctcagacggggcggctgccgggcggaggggctcctcacttctcagacggggcggctgccgggtggaggggctcctcacttctcagacggggcggctgccgggcagaggggctcctcacttctcagacgggtcggccaggcagagacgctcctaacctcccagacggggtcccggccgggcagaggcgctcctcacatcccagacggggcggcggagcagaggcgctccccacatctcagacgatgggcggccgggcagagacgctcctcacttcctagacgggatggcggccgggaagaggcgctcctcacttcccagactgggcagccgggcagaggggctcctcacatcccagacgatgggcggccaggcagagatgcccctcacctcccagacagggtggtggccgggcagaggctgcaatctgggcactttgggaggccaaggcaggcggctgggaggtggaggttgtagctagccgagatcacaccactgcactccagcccgggcaacattgagcactgagtgaacgagactccgtttgcaatcccggcacctcgggaggccgaggctggcggattactcgtggtcaggagctggagaccagccccgccaacacagcgaaaccccgtctccaccaaaaaaatacgaaaaccagtcaggcgtggcggtgcgcgcttgcaatcgcaggcactcagcaggctgaggcaggagaatcaggcagggaggttgcagtgagtcgagatggcagcgtccagcttcggctcggcatcagagggagagcgtggaaagagagggagagggagaccgtggggagagggagagggggagggggagggggaaggggagagggaggggactatattttttaaaaagaatgaagaatctagtgttttggatttggaaaataagttcatatttcataaataatatgatcagttgtctaaatcaaaatagtcatgcttgggaaaatgttcataattagcttaagtggggaaaaatacaacatacattctatcatctcaatctctgtgtacatgtgtcggaaggaaatagatcaaaatgataatagcttctgtcacccactgggctgtaggattttgatggaatgatttttatgttcttttttatatctttcaactttttaaaagcacacatattttataattaaagaagtactttaaaaaaataaaatagggtaggcgcagtggccattcctgtaatcccagcactttgggaggctgaggtggctggatcacttgaggctgggagttggagaccagcctggccaacatggtgaaactctgtgtctactaaaaatacaaaaattagccacgggtggtggcatgtgcctatctataatcccagctcttgccaggctgaggcaggaaaatcgcttgaacttgggaggcggagattgcagtgagccgagatagcactactgcactccagcctgggcgacagagggagactcagtctttaaaaaaaaaaaaaagaaaaagaaaacagtaacaaaggagaagggctttctcatcattgtcatgaaatcacgctgatgtatgcgcgcattatgttgtcaaatcagtgaaattttgtgagttggatctcatttagcatccctgttgctgtttccatgtatgagtattgtatgtgcatagttcaaacttctgttattctaggaaaatggctcgcttaattgggatagaagaatatataataaggttataaaaatttatttttaaaaaaatgtatacatacacatatatgtattattattatcttccccccagaaaaatatgcaggaaccaattgctcttcatgagatggacactagcaatggggtgttgctgcctttctatgaccctgacaccagcatcatttacttatgtggaaaggtaaacagtaattttgatgtttggtgttaaatcctgtaagtggaaacatttatccttcagagatttagaggacgggcaatgtgttgtatctgtttaatttttctaatttgtgtgtgtatgttataagccaaggacagataatttggtatttttaggtcttgagactggactgtgtgcagcttgccagttgtgcagtgataacacgccatgttgcatacttttgactgaagcagaggttgggctggggtattggggaaaatgctccaatcagggcgctcttgtgaaaaaaagaagatacactggtgtttcatcttcacctagcagtgctacctgattggtgattttagatttatctgtacttatgtcagggatgggcaaccagttggccacatctaatgctgaaatttgttggataaccctagatgagcatgtgtatacttagtaccacacaccatggacttggaaggagaatggtgctttgtggatgcaaacttttgagggcctcagagactctccagagggttcttgttcctggggttcagtgctagggctctgggcttgaagatatgaggcctgactaaagctcaggggtgataacagttatagggagactccacactgaactccaaaaaccttcctcctgccttatgagctcagcatacctagactgtgggtagctttattatttcatttttgtaagtgggaaccttatagttcccttttttttcttgtaggctcaatttcccttagaactttttgtagttgaaataaatgaattaataacagtggagctgttgaggtagtccctagacctgttagatagcccttcactgggtggtaaagctggtgtttgcttttcatagctgattgagcatgctgcagacctgctttacatttttataggtcattgttttagaaatggagatcttgtctgtttccttgaaagccattttactgcagatgttaacaggtgttaagtgcatttaccttgctgttgttgcccttgactgaattaaaacaaacaaaatgagcagttactcagatattagtaacatgagatggaaaattcttttgggcatgcagaaatgactagtaagggtttagcttcttttccattgctttagatatctcagtcattgagacaaatggaaatcatgagaactgggagcactgttgaggcatgataccacctagctatttttgccttcttctttcttacatatatgtatatctcctctctgccagacaagattgccgtcattgttcaggttggtgtaactgtgtgacaattatttgtacttagactaacatatgcttcagtactcaaagatatctgactattctaagcaagaaagtagtagaattgtacacattgccatgagatggcactttctgaggatactcactaaaactgagtttcttcattagaaaaatctcactttttatcatcatactggcataacagcattgcgttatgccagtaaatgaatacttaaatcaataattgcattctcagcagtcctcttagtctttgtttgtttgtttgtttttcacagttgaattgcaatgtagctgtttggcagaggcattaacatttttgccctaaccctggcctggtgcctaggctcaggggagtaaaattagagccaggagccaggaggctgaggagaccacttaaaaggcatgctagcatttgataagtaaggggttactttgtgaggaaaagaaacttttatatgctttaggcaagcctctttatgaggaagaaaaggtcagctactgaagcggggtcccaactactgctgggtttgtagaggagagagacacccccataatccagatgtttcagttaacaatcagacacagacttgtctctggtttcttacagggtgacagcagtattcgctattttgagatcacggatgaatccccgtacgtccactacctcaacacattcagcagcaaggagcctcagagagggatgggttacatgcccaagaggggacttgatgttaacaaatgtgagattgccaggtaaagaatcgagattgtcaagtattctaggttggtgtaactgtgtgacaattatttgtacttggactagcatatacttcagatctcaaaaatatctgaccattctgagcaagaaagtagtagaattgtacacattgccatgagatggcactttctaaggatatcactaaaactgagtttcttcattagaaaaaaatctcaaaaaaaaaaaaaaaagaaaagaaaaaaatctcacttttttttttttgagacggagtctggctctgttgcccaggcaggagtgcagtggtgtgatctcagctcactgcaacctccgcctccctggttcaagcaattctcctgccttagccttccaagtagctgggattacaggcgcccaccaccacacccggcacatctcactttttatcatcacctgaatgcctggtgataccagagcaatacagctacaagaaattctatgaagcccaagtctttctatccttgtgtgtactgtggaattaatacctcatttcctgcccatataactgaagtgcaacaatgaagcagcatagctggggtgtattgcacacctactgaaatagtgaaacatgcatctttaatcttcaagctgaggccatggtcagcgttccctggtgggcaagtagggagagcctggctcggggatggaaaagtgggtggttttcctaccctatgagtggaagaaccagagtcaaaactgtatttggggccccactggtcctaaaatagagaaaccaaaggtcctataatggggcggtaggttagcttgatttaggaagttcagctatgatataatttctacctctctgtactacttctgatttttagaaaattcatattctaaatgctagcaggcttcctaagggacaggcttttttctcatgctagtcaacaaatatatcctctgagactcagtgaccactggccatttcaaacaacagaataattagcactacatcatcacatataaggtcgtaccaaacatttgtgtaacactgtgtttatgtggacttttaaaacgcttgctgttctggtctcacaattaaagaattgatacttacgtcttccaaataaaaggaagagaatttttataagccccttttttatattaatctctactaaaaataaaaaatttgctatgtgtggtcgtgggtgcctgtaatcccagctaattgggaggcagagtcaggagaatcacttgaacccaggaggcggagtgagccgagatggtgccactgcactccagcctgggcaacacagcgagactccgtctcaaacaaacaaaaacaaacaaaccaaaactctctatgtgattttttttttttagttggaataatgaaggaaagctgttaaagataattgaaaattgtggtttaaaccaaactaatcaaaatatggttcaaaatagactgaattcaaatttatgattacatccaatattttgaaacacatttgttgtcatctaaaagttcgacagactataaacacagttgttcagaatgtctccgatttatgaagtgtttcttgagcatttattgtatgccaggactgtgctaaatatgctacttgctacctctttcttttcataacaatcatatgtggtaggtgtaacttttatccccattttatggatgaagaacttaaggcttggtgaggttgtcacactctcgtgggttttggtagtagagctggaagtcaaagccaagtcagtctttttattggctatactaaccacagaattttcattaaatcagtctttaaaaatgtttttgggccaggagtggtggttcaccctgtaatcccaacactttgggaggccaaggtgggaggatcacttgagcctgggagttcaagagcagtatggacaatctagtgagaccctgtctctacaaaacattaaaaaaattagccaggtgtggtagtacgtacctgtggtcccagttattccagaggctgaggatttggcttgagcccaggaggtcaagacctcaatgagcttgtgccactgcactccagcctgggcgatggagcaagacccagtcccaaaaaaaaaaaaaaaaaaaaaaaaaaggtttttggtttatctgggactcttttagtttttggttgaaatagtaaagaggcacatttgacacaaccttccttttaaagaggatgatgattttataaacctttaccaccctgagctctactcagcttttgttcccctgatgcgttagagcagtgtatctgccaggttgtcttcaatggactcctgcccagtttcagatgccaaaggctgcaggtttccaggagaaatggttttgcatatttgatgtggctgtgtcttctctgacttaaactcttggaattcagaaaacatttccccagcagcattgacgcccacattcaactccccccttgcacaccagccgtttgatctggtgatctggccaggatgctcactaaggctacctctcttgccaggagctttagagactttttttgttgtttcccgtcttgactgaaaaagaaaattggcttgaccttatcagggtcatcataagagaagtcatttctggtctgtttagttctcttgtaggatacaaataaaaatgttatacctttcttccccattacagagctctttgctcccttcttccagtattacagtgcaagtggctttacattctctttccacattttggatagtttcacatttttcttgagtgtcatgtacgatgtggtttgctaggatgagaaaatcataatcctaggattgttttcttttgctttctaaaagtcatatttatacttatatgttcaaccacctcaagctggcagaagaccttgtacccgcgttgtagatacaatctaacagatgtgtgttctctcctgtaggttgacatggtaattttttcataagtgagtcagtttcagtgttgctattatttccaccacagttggtctgtcccccagataattggcatttgtcatcatcatacgtagacctctactcatggttcttgtctccagtctgccagttcctagcatagtgactctcagcttccgttctctcatctgtcaaccgggaacactaaattctgcctattcccggggtggatcagatgtggggatgggtaaagaagcacttgacatttcagacagcattgtagaaaactaattattcatcctgttagtcagcctcatatttcacttaatgcaactttgcctttatttcccctctgaagattcttcaaacttcatgagagaaagtgtgaacctattattatgactgttcccaggaaggtgagtgctgagttttctagacaatccatattttaaacaaatgtaaaaataaaattcaaaaatcccaggcctttcttcttccttacccacgggtgccaaatgtctcttgtagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtggtgaggaccagtggagtgcaggggtgcttggctggttcaggctttatcctctagaaagcccttgtggtccagggcgtcggcgagtactgtcccagctgggtgctcaggggttttcagtaaatgaaaaagtgggagaaggtcctcggtcacgtgatggtggtggtttgtggcaacacttgcctcctttaacggagttaaagctcctttagccccattaaaggagccaagtgtggccacagaccaccatgattgggataggtatcagtttcctcctatctctcagtgtgaacaggagcctcttgggtttttcctgtcttttgccaaactagttaaacccttctctgatttgggtagaaataaaatatcatgggagtgtggggtcataggcaccagggagaggaggtccctggaaggagggagtggcacgtgttcagatgtagctgagtggctacgacagaaggatctggcggtgtggggctggcaacaagggggatttaggcaagagccctttgggtggggaattgggaatcaagcctgcctttgactcgctgcggccactggagagtgctgctgttgccgggagagcaggtcctgggtaagagagaaggagtggacacacagggcaagggtttccctcccaagaaggagcctcacagatggcaggagctctgtagcctctgggagagtcacccctctctctggtcagatagaagttactcttgatggaatgattggggtggttaggacgtaggacactgttgaaggagcctgttttgtcctatagtctaactgtgacccaggagaccctttgtttgagtaaatgcacaggcttcgggatcagaagtggcactgtgacactgtgacacactgttgttttgccacgggatctcagatagatcggccagtgctcattgcattcaaagccccagacatagtagggctttgacttctcttttcaacttggtgactatggcttgccgtttgcaaaatagaaaactacattttatatcttacaagttttgaacagtgttgaactttgtttactgcattttaatcactgcctcctttttttgttttcttagcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaatggtgtttgtgtttatttcacgccttggctgtctgtgaggcagcccccacctctctgcctgacatagcttctctgactttggtggacgagcacggtgccatactcctctccgggggtaagtacaggggaagcgcgtgtgggtggctcagttcaagtacaagtgaggtctccaagccagtcaagcactgtgttttggcttccagcagacctgagcctttggatcctgcctcagacctttgccagcggtgtgtcctgggatggggttcctaatccttctgagtcccttttcttgaaaggaggatgataattccatgtagttcagatgagaggaatacctgtgtggccacacaaacaaccctcgctgcatggccgctactgttactattatgagttgattttctgacagagtctttgaaagcactttttcttcaatagaagcaaaattctcttggctcagctgtgacttttattccagcaggcttccagggtcagttgaattgcagggcttccctttcgcactatgacattgtctcgtga

SEQ ID NO: 17151 - DNA, 15503 bp, Human; identical to SEQ ID NO: 12169

SEQ ID NO: 17152 - DNA, 65966 bp, Human
taagtggataatcagatttgtatttatggtattcagtgatagttttgattcttaatttgaggttgtaagaaaaggagctctgagttggatgcttgattagttaatgtaagccccatcactatcttggaaactccatgaaggcaggtatctatcttgatttgccagtacatccccagcatctagcaagaagtactcatgccaagtacaaaatggaaactcaagagcaaggaagataaagaaatgttagaagaagagttaagagaaatcaaagaagccgacttctaaaaaattttacctagaactctcctggtgcttttcatgacagttgattttcctaccagtatagattgtagttacttgccagagagtaatgtgatatattaacaattgtctatgtgcagtcattgacttctccaacaatctatagctcagcaaaacctcccttccaggcttctgttatgagcatatttgcaacactgcaataaaaaggagataagcctggatttataggctttagattcagttagattaacaaagagatagcatttaagcctcccagaattgttatcgtttctgtctcagggtgcttgaactgttaatatttataactctcttagctaggtattagaaaatggtaataagggaatggagtttttatttgttggctaagaaatgggctgctgtgtaggtaagaaacttgttttgtagaggagggggatagtatagtggagagtagaaaagattaaggagaagggtaccaagggctaactccctctgaaagtttttctagagctatcagattgatccctccactacctctctactctcataatattttaactcttattcctaccaaattaattgaaaattgtacttccatattcctctttcctctagactgaaagtttctcaaatgcaaggagagttttcttcatctttgtgtctgtgtatagttgatgtttaaatattccttgtactaaactgagctaggcgctgttgtaggtgttaacccaaagataagttccttgccctcatggagctcatattctacttgtaatgacagaagcatggctattacagatttccttggatttttctagtgttctttttcctctcctcgcagacagcatggtaaagttgaatgtgagtgaagaaatggaaccctctcagataaaaattttgcatgggacaagggaagaaactttctctcttcttatttcctataccagatccacctttactccaggactctgaactttggctagttacacatttccccacaagaattaccaaatttttctgagcatgacattcttgaaacttcatttatgaacaaaattatgaaaaatgcaattttcctctatgcaccattagcttatttggataaccacatagttactcttatttaccactggatgaggtttcagtgaccataaggtgaagccattggtggagttttaaaaatgggtcatcaatctgagtagtttcagtatactgtacttgtccttaagctgatacaattggagctgtttatatagatcaactacattgtgggacaaataaattttgatgaattaggctgagaagctgaatatcagtaagtacattttttaaaattaaaagctttctgaagagaaatatggaattactaggttgcatcattctcatcagtgttcaaagtaaggatttttttactcttttaatggctgcccttcaatcacagccctaagggctgaattaaatgtttcttccacttttaatccctttggtggagttagatatgttaatacctatgtttaggatatttgtgtaggtgtgttgatatttcaagagcagtactctattataaaaattgttaatagtgactagttttggggtgacagtagtgttacagagagtaatttgagcactttattttctactgtttcaagaagtgtttcagaactatttttaacagtgtgaaaccactttgtttttcagtattcttgccatgagaaaaagaatgtgataagttattcaacttatgaaattcaagttacatgtgaattctgccaggtatgtgtgcaatatttggtatttttagccattttttacattttgggttgtaaaaatctttatagcttgtttctattaggtaagtatttgtggtgtttttttccatacaaaacaagtcacttacttagtatgtagtttagctgatactcctattttgtttttaaataatcaaattaaaagcatctaagtacacttagctatgacagacataaacatgttttaaggttttgatttcctctaaaatgagttctatcagtcccatgggatgttctgtgaaaaagtattcaaatagcaaatagctttggcaaaaatgccatactctgggtgctcccctagtcattttacattagcatattaaagactgtgaagagtcctgccaaaaaaaaaaaaaaaaaacaaagaaagaaagaaaagtatattttagcatttcccggatttgtttggccacacctttttttctttagtgtctactgacatccccgttgaaatgttttggggagcattgctattgaagggttaacaagctactatttgaaaaagaaacagtgttacagaattattagttgagtcaaatatatttgctatatagaatttctagaaagaaaacaagttgatggatgggataattaattgagaacttttaaatcgaaatttaaaagtaggaaagtaatcctgactcagagatgtctttttgcatttgttttgttcaaatcaggatccaaaaaggtccttaatttggttgtatgtttattaaatttcttctaatggaaaacagcaaccctcttcctttgctcttcttttcatctccatgacatttacttgttgaggagaccaggtcatttgttctaacttacagtgattcatcttagtgttttttgactttacgatggtgggaaagtaatacagtcagtatactgctcaattcatggtggggttatgtcccaataaacccatcgtaaattgaaaatatctgtattggatttggatgattgcctcctggtggtgttgtttaacttctttttctgtctcctgaatttccttgtagttggagctagggaggcttgattagattcactttcgacttttgacattccctgtccccacccttaacaacctttggtgttaatttaagactaatctgtgaattcagatgctgtcagcctggtccaaccattatgaagttcctatcaacttttctcctaatggttttaaaaatcagacattgatgatagttgcccagatccattatttcattagggattaaagtggtggtattcttcctcttccacttgttcctcctcctcccccttctccatgcctggttaattttttgtatttttagtagaggtggggtttcgaaagtgttagccaggatggtctttttttttttttttttttttttaaagagatggggtcttattttgtcacccaggctggattgcagtggcacaatcacaggttactgcagcctggacctcctgggctcaagagatcctcctgcctcagcctccagagtagctgggactacaggtgtacaccaccatgacgctaccacgacactaccacaagtggctgttttaaattatttgtagagatggggtcacgccgtctttcccaggctagtcttgaactcctgggctcaagccatcctcccacctcagcctcccaaagtgctgggattatagtcatgagccactgcacccagctaaagtggcaattttctaattattttattcttctgcacttgttgaaattctataaaagacttttccttcatcaactctttggttactggaaatacattttatgcacaaaaggcagattaaacacactgatcttttttctttctttcttttttttttttttttaaaccagttttcagatgagtgcattttcttagttgttgggttgtatgacttgtctgtcaagcccttactggtttgctgtatgccaggcttttctttcaatctcttactccacttctacttagagtcctgtgaaaatcagtcgttttttttagatatacagttgttcctcaatatctgtgggtgattggatccaggatctcctgaagataccaaaatttgaggatgctccagttacttatataaaatcgtgtaatatttgtgtatcacctatgcacatcctcccgtatactttaaatcatctctagattacttttaatacctactacaatgcatatgctgtgtgaatagttgttacactatattgtttaggtaataatgacaagaaaaaaagtctgtacatgtttagtacagatgcagttttttctcacatatttttgatccaagattgattgaatccatggatgcaaaactcatagatacagagggctgactgtacatattcttttatttttaattattttttatagtttgtgtccttctcaaagcttctgtaaggtttcctggaacacactgtctctggatgtagttacctgtataatttttgtctttttcctagtattaggttaaataactgtttgctccttttttgctttttattgaggtataatttaaacagaataaaatgcactatgtagagtaaaatctgttttatcaatcttttcttttatggaccttttgtgtcctgtttaacctttgcctactccaaaatcatgaagattctttcctatttttcttctagaaacttatgctttgcctttcacttttaggtctatgatctactgtgacttaatttttagtataatgtgagatagaattcatggggcattttttaaagttatgaatccttaattgacataacattaaggtcacgaaaagtcctgtgaaatgaagcctacacattcaacatttcccaaatttatttggctaaaaatcttttttccatgatagctaccatgctttgggaaacattgatctaaagcactgataaactactgttgtcaagggaatattacataattattattagttgagtcaagtactcttgctatataaaatttctagaaccaattattgaaaagaccatccttttcccacttaactgcagttgagcatttgtacaaatcaggtagccttatgtgtggttccatttctgtactccttcttttccatttctttgtatgtttatcattggactgataccacagtgtcttaattattgtaattttataatgggtcatgatatctggtaataaaagtcctctagcttaattacaattcttcatgactgccttgtttattcattgtcttttgcattttgttacagatttttcagtttctacacatacataaaagcactgggatttattttatttatttattttttttttttttgagacagagtctcactctgttgcccaggctggagtgcagtggtacagtctcagctcactgcaacctctacctccccaggttcaagtgattctcatgcctcagcctctctcaagtagctgggactacaggtgtgtgccaccatgcccagcttattttttaatttttagtagagacagggtttcaccatgttggccaggcttgtctcgaacttctgaccttaagtgatccacctgcctcagcctcccagagtgctgggattgcaggcatgagccaccacacctggctgaagaacaaaactgatataataattttggtttgtatctatttaaagatactgaattcattacttaaaaccacccagaagagaaacctccaggctcagatagcttcactggtgaattcttccaacatttaaggaagaattagtacctatcttatgcagatttttctagagaatggaaaagaattaacatgacccaattcttataaagccactgaacttagatacctggcaaggttatttcttatgacatagattgtaaacatcttaaaatacgagcaaaagggaggatttatttaagaaattctggtttgtttgttcaacattcagtgtgatataccacattaaaacaataagagaaaaaaatagtatctgaatagatgcagaaaaagcatttgataaagctcaatgtctactcatcattaaaactcgcaggaaactagaaattggaggaagctttcttaatctgataaagagtatccgaaaaaaatctgcagcatctgctttctccctgagatttacgtgtatttttaagactagcatctgcacagtgcaataaagctaagcacaataaaatgagatatgcctgtaccaggaattctcataatgtgagagcggtctgtgaagtcaaaaacatttttataataatactaaaatatttacctttttaaaattctcattatctcacaaggatttgatgccattttctagaggatacatgatgatatcacaacaggttgaataccagaagcacataggagaattcagctgtgttatactctgttaagccagatgttaaggatttgcaaaaagtgggaaataatgcctttctcactaaattttttgttttgaaaatatattgttttaaaaaatatgtgttaacatgcagtgagttcattgttatttttaaatcataaattaatatttttagaatttctcagttttaatttctgatgtggtcagtattgatagtacataaacaaaaacgttctttgggagcctaaatttttaagagtgtagaggatcctgtttgagaactgcggtgccatactgttctcactcattatttagtaagttttactagtggtcagttacagccaatcttgttagaatactttgctcttacttaaaaatttatatatcagtattccttagtttgtaaacatttaagaagcactagaaggataatatgttatttagataaatcgcagatatcatgaggaggtgttccaaatttagttataaaatagcttataatgctcacagattgtgtaggtcaaaaatttgtacagggtacaagaaaatggcttgtctctgctttttgtctctgcctagtactggcaccagcagcaggcatttgctattaataaactgtgattctcagtgtctgcctcagtcttaacttttcagggcactgccctttgacctcatttctctgatggatgtaagaagagttgatgattttccgtttgtttaacttatttctctttatgaggacaggaatgatgactttcaagttctttatgtgttggactagaaaccagaagtctagaccagtgtttccccaagtgtcatccttgcacctaccagtgcaatatcaagttgtccataggctatttgacaattatagcaataaatattttggataaagcaataaaacttttgttaacacatttcacaaattttgtatatgagattaataatggtgacttcctggaaaccatttgtattctcagtgatcattgcgtacatgctttaaacatgaagcagtgactactgtgaaccagcatgggtttcctaaaaatgagatatatcaaatctttggcaaaagttttgatacattacaaggaaacagcataaaatattgacaagacttttaaacttggactcagaagattaacttatgatcctcagtataccactaacaaaaagttggaaattaaggatttagaaagagatcagagttagagatacagattttgttatgttaatactaccttatctcctttactgggaggagagattccctgaggctgggatccatttctcttttatttttgaatttctctgagtcttctatagtgcttccaatataggaaaaggtgtaaatttaagaagggatttaagagtttgtttttagacatgttgatgttttggtagcatatttaggtagaaatgtttaagccaatagatacaaatattccactagaatataggactggagatggagattttgccacattattttcataacagtacagtaggatccttggaagactgcatagtatttgctcatttaattttcttgaataaatgaaatgtgttcatttcaccataagtacttttacactgttgagcaggaaaaagtttgcctgacagagcagtgttcctaacctttttcctatagtgcaaaatctgcatgttacatgtattttatctactctcataataagaaagatagaattaaaatgtcagaaaagtgttttattttgtattaaaatagaaaagttaataagcttaatgaaaaatcttgagatttatattttaaattattctttattttaaaatatgtactctaaagtgtcttctgtttgattataggcaatacaaggacctgtggaatatgagtgatgacaaaccctttctatgtactgcgcctggatgtggccaggtaatatataaattactttaaattattttgtatatttccacttattaaaacattgatgatataatatgttatcactaaaagtattttcttacagtattctgtaaaattttagagttaggatgaaaaaaaacccaggaaacttttggcaagaaattctgctttttcttcaatagtgcaactgagctttagaaagtataatccaatacggagggggggagcattatatcttgtaatggaaaggtggaaatcctacacaaaagtccaagatataaaagtataatttgactgttattggttgaaaattattgataaactgcctaattagaaatcagatcgatattatatgagaattattttgcttactgaacttttatgaaattaactggtatttacttcttagagtatcactaatgtattaatgttgttaagcctaacgtctttaatattgggcatgtggcagcagtttcagaaagtaatattttagtttttttttaacaacccactaaattattaatctattcctattatacttatcttaaaataactatagacaggaagaattaaagaataaatgtaatgtatagcaaagttacaaagtacttaaatatacggaccataaatgtaagtaagcattattctttctcatttattttctttagttgatattttaaattgaaatataattgacttacaataaactgtatatacttaaaatgtaccatttgataagttttaacacacgtatactcaaaaccatcagcacaatcaggatagtaaacatacaatcacccaaaagtttcctcatgcctatttataattcctcttatcccacctaccttcatcaattactggtctgccttctgttactgtagatttgtttgcattttccagaattttgtataaatggaatcatatagtatgtatgttttttcactccacataattcaatatttctccatgttatgttaccaatagttaattccttttcattgagatataatatttcattatctcacaatttatctgttcatctgatggatattggtttacttctattttttagttgttaataaagctgatgtgaatacttgtgtacaagtctttttatggacacatgctttcatttctcttggaggaatacatgggagtataatgatgggattatctgatagatatatgtttgactttttaggaaattaccaggctgcttttttcattgtgtttgttggccatttgtatcccttacattttgtgaagtatctttttaaatcttttgctcattttaaaaaattgggttgtctttttattattgagttgtaggagttctttatatatcctggataccagtccttgtcagaggcttctttttctgtggtttgcatcttaattttcgtaataatatcttttgatgagcagatgtttctaattttaatgaatcctaatgtattaatttttttcctcttatggttgttgcttcctgtgacttgtcagaaatttttgcttgcctttagattatgaaggtattctcctttgttttcctctaaaacttactgtttcatttagatttctctttaatcttgaattaatttttgtgtatggtgtgagataggggttgaagctaactttttttttttttttgagacggaatttcgctcttgttgcccaggcaggagtgcaatggcacaatctcggctcaccacaatctccgcctcccaggttaaagtgattctcctgccttagcctcccaagtagcttggattacaggcatgcgccaccacacctggctaattttgtatttttagtagagatggggtttcttcatgttggtcaggctggtcttgaactcctgatctcaggtgatccgcctgcctcgacctcccaaagtgctgagatgataggcgtgagccaccgcgcccagccagttgaagctaagtttttaaaaaatacgggtttagatatcccagcataatttcctgaaaagatttttctttcctcattaaactgctttggctcctttaatgaaaatcaaatgattgtgtaagtgtgggtctgtttctgggcattatattctgttccattcatcactctgtcaacttttatgctagtaccacaccattttgattactctagctttacagttagtgttccagtcagttagggtaaattctccaatttagtcctcatttttcaagatatttttggttagtctcttaagttttagtcattctggtgagggtttaatggtatctcattgtaattttgatttatgtgatatttaatgatgtagagcgaggtaaacataggagttatcagggttaatgcaattttagataggttaaccagggaatgtgcctctgctaaggtgacatttgaacaaagacctgaagaaaatgcaggagcaaaccttgtatgtttctagactaaaggagcagcaaatgtaaaagctctagggagggaatgtgtatggtgtgtttaagaacagaaacgcaactactgtggctggagcatataatgaccaacagagagaaggttaagagaggaggtcagaggagacagaaaaaaagacatatcctatgataaggtgtttgggttttattcactgagcagtgaaaagccactgctgagtggtcacagggagacaagaggctgacagcagtccaggtgagagatgatggtggtttgaattaggtgttaacagtggacacagagagagaaataggctaatttgacatatgttttggagatatatttgacatatatatttttctgtaaagttaagagagctaaaaactacagttctctttgcacctagaattctgcatatgattttaggtttcaccaaccaaatttactctttctggtaaatcagatttactttaacttttttttttttttttctcgagacagggtctcactctgtcacccgggctggagtgcagtagcatgatcatgacacactgaagcctcaacctcctgggctcaggtgatcctcccacctcagcctccagagtagccgggaccacaggtgctcaccaccacacctgactaattttttgcttggtttttttttttggatacaggatctctcaatgttgtccaggctgttctcaaactcctgggctcaagccatctgcctaccttggcctcccagtgtgctgagattgtagacatgagccacttcgcctgacccactttactttttggatttggtactgagttaaatggaatgagagatagtattactcaaatcatccattttgctggcttggagtgaacaaacaacttgattctgtaatccctgaagtacagctaatgcaatatgtgtttctagggccagcctttggacaaagactagttttgacatgttctagatatcattcttggagactcaaaaaagccctttcctgattctcttctgcttaaaatagttagaatgggttttgtgattgaattcttactaatacacatgccattttaaataaaagcattacaattaaacagaagaaaaactgattgctgaacattagaatttgtgtgtgtatgtgtatcataaggaattgttaaaagacctctgtaacattaactatatatgtgaaaaacattaagaagttagggaattatttttttaggtttcctactattaaaggagttaacatgcatactttctacctccacttccctatcccctaatgtctgataattactcttattttttccattgtcgaggtttgtaatacttacattttgtcttatccataattcccatatttgcttagttttacttctgtatcacaatagtatagatggaagggtgaaagctaagctttagggcacctctggtgtttaaaagtcagaaagaggaggagaatgtagcacagaagattaagaagtagcaaccagtgaggaaaattgaatcttgaaagttagaaaaaatatttcaaagtaagagaaacaatatagtcatatcctaaataggataagatgataattcagtatttactattgaatttagagactatgataagagtagctttcaatgaaggggcagtaacaacagtgtaattggagtaggttgaagagagaatgggaagaaccagaaatggagacattataggacagttctttcttggaggtgtagctaaagggaaagtgagatacatagcttcaatgtaggattgaagatggtggaacttttttgttttgcattttaaggtgggaatatcacagcatatttggcaatgcagaaaatgggaccattgcaggagtggggtccttaaatagctaggagaggatgggatttagttttatttttaaaacaaaattgggaccatactgcacagttttgtattctgttagtatttggatgacattacacatatcagcattttgtgtattaatcgaaagcatggctttaagtcactattgcttgagcatgtctgattccactattataaacttttaattttggtattataagcaacattgtgatgaatatctttctacataaccctttgtatatgtctacttagtttcttaaaatacattttggaactagaataactggatttaaatgtttacacgtttctaagtttcttcgtgtattttgccaaattgttttttaaaagctaaatcaattttttatactcactcataattgaattctcactaatagtgatgcttttaaacattaaacatttgatcctgagtattattttaggggggcctgtgttcgtaccctaagatacttaaaataatctctttgcaagtattactgatcaaaatataacctggctactcatccatttgttaaatcttgctgagaacagaaatggtatggtctgtttttagatttatataatatttcctaggaactacttagtaagaattggttttagaagcatcattttgatggtgactgctttttcacaagattgctttttcacacagtctttttaagtttcttgttattttttgtcaccagtaagcaatgacattattctgaatttgagtttcagctttaacacaatggtcttagttaaatttaaggtttcaaatagatttttacaatttaaaatctattttggtgacaatacaacttcagagagagtcctatagaaatgattacaaagagtttttaatactagacttgtgctattaaatcttttcttgtatgcctcagttactcttaggttttccacatgcctgttaatttcacttgttttaaagtgatgctccttggaatttagtaaaagagacactgagataatttggtgaaagattcatttatctttgttagtcttccatatacttggtagtatttttgcttttggtgccccgtcattgaaaaatgtttctttggtagaatgtttacacattataagctgttttataaaggagataaagattcattttatatttagtctaaagtgacaatggagatgtatgtgtgggagtgtgtgcgtgtgtgtgcatgagagagacagtgaatatatcagtgtaacttcctgctgttgttcaatagtccttaaactagtgaaaaaagtagtgaaatgagctattggcccaatggcttgaaaacttatttgtgtctatctaatatgtttaaaaggaataataatatatcatggatatgagtgtatgtattaactatagaatgactgattttttaggaagttaattctggtgagagtggtcaagccttagtaacacagatttcccagatatcagaacttaaattattatagaagcaactgatctaccttcttcccatctgacaggttaccctttctttttaaccttttaagagagattgctacctgctaggcacctatcaaaaaaaaaaatcttttttttttcactttttccattgtttattgagctatatactcaaggtcttagtcttgtttaacaaaatacttgtgtttctttgtatatctacagtattttctttggggttgtgctttgaaatgcctggaagaatacagtttatgaattcagtatgttggtgttgctagtaatatagatatttttacaaaacttatttttggaataaactttaatttgactgggaagacatttcatatagattctgtaaaaaaatttagcttgcagctattttataaataaataaagaatgcatttctttcatattaaacttctggtgactgccttttcacaagattgccttttcacacggtcttaagtttcttgttaaaaataataaattttctcagataaccaaggtcaaattcacctgtatcaagtgccagtgtattttgtcttttgcagtgtttttgtattttgagtgtattttgtcctttgcagtgttgctgtccctgtatataattaatactgttacaggatcagtaatccctttgtaaattgcatttagggaaatttgatctgtggatcttatatgagagtttataaatacatattccttgcattctcccttttaatattcatatgatcctaaatatttgttaggttgcttctggccacttctttacacttaggattgaacttggtgccatttcgtatgttttgtacgaacacaatgttatttattctacatgcagttctttgatttgaatatttggggtcaaactaatccaagcaaagaaaattgatagaataaaattcctaggcgacaacattccaacttcttatctattaatttgttgagtttgcagttttaaaatctgggacctgcaccaaaatgcattcattcacaaatgtttaatgattgccttcagtggaaaagccacattatgaggttctttgaaacataaactaaatattactttcagatgcttttagtgtaggatgtaagacacgtatatttaaaacagcaatacaaagaaaaagcataaaatattaatgtcagtatgctctgcagatatgttcgttttctgagaactttgttattcagcaatctgtcaaaagtaccactgtttcttatttctccaaaattgggggagattcttataatgataaagtaataggaagacagtacctgggtggggaaaagtttgattgtggtcctactgcctatagttgctgcccagtaaatgtctgaagagtgaatgaatatgtcaagtagtggaagtgttgttgcatctgaacactctccttcagtggtaatacaggcaggttctgaagagaggttataaaataatagttttctgttggtatgtgaagtaatccaaagactaagtgataaaatgtagcaagattaaattgaagttgaattcatcttaatgaacaatggtttagggtcttttttagccccctcagattgatctttaagattcatctattttattgtaatgaattcattctttcagttagcatttattgagtacttaactatatgctaagtttgggggaccacggtaggagctcagcctacttaaaaggacagacatatgaaaatatgataggtgctataaccaaggcattgtgccgcacacatgagatgattttcacctctacaggcagacggatagtggactgggccaaagatgttaaaatgttaaaaatgtttcattcttttacattgtgtttaaggtaaccctaaagctactattattagttgcatgaaaggatgtagtgaattgggtaggggaaggagaccacaagaaatggaattcattttgatggtttgggcaaaccaagttcaagtatatatattttaacatcctcacttgtaaggttataaagagtgaattgagatctgttaacttagcattttaaaattattgctctgaaataacagctccctgttttcagttataaatgttgcttaatgagcatcttcaaaaatgttgatgttcagacattggagataatgcatttattatgttgtaatcataaatgttacctttggcatgcaaaacttatccaagttagaggtaggaaaaaatatgatggataactttaaaaataaaatgttctaaaaacaactttgctccatttttatgtaagaactctcatgaaaaaattattttggctactttaaatttttttattttaaaatgagctgttttgttattgtatcggttgctatttctttgctggattaaaacaaaggcattcttttttatgtggtaacataaaaatcagatttatttctaaattttgtccaggcgtaatacttttataagaaaattctcttttaaaaagtggtaagtaaccttaagtctaggtaaatattaatactacagtactttcttgaaaagtcattgaaccatggagtatagtttctactatgataagacaaattaatggtggtctatttttagtatccataagaaatttatataaagtttctttgcctccaattttatttttaaatgctctcaaatgagttatgtgacctagcaatatatcagtattgcttattcttgagtaataggtttctctgtgattgtttgcaatctagtgtgctatctactaacaataacggattcttttatagtttaaaaactgctatttcactgttaatggtggttttacatgttgtggaaattaatttcctaatcattttacttatttgatcaaattgaaaatcttaactatattttaaaactttttgccacagcgttttaccaacgaggatcatttggctgtccataaacataaacatgagatgacactgaaatttggtccagcacgtaatgacagtgtcattgtggctggttagtatatgcttttattaatagcttgtatacatatttcacctggaatgtgcacaatttttgtgtattctctgtaaataatatagtctggtgatattccaatgacttcattatagtaaatgttggcaacatgtattttacccattacattttcatgtttccttctgactattcatttcatttttttgtgtggttttcaaatttatattccaatgtcgattttgtggaagttcattagaactctgggaacattcataccatctacaaattttacatttaactaataattgaactaacatggtatttagtcagcatttcttttagctgtcttgtacaactgacttacaaggctgtgtgaagatagaaaatgatcaagcttctcccattggagaaagaacagtgagcagacttgttcattagagttgtttatatttcttttcagactaaacatttgtattagtaaaatattctcagtaaggaggctctaaattcagtcaatgcagtttttgtgtgttgacactatgaacgtacagtatcacctaagcagatgattatttttcactgtatgtgaaaagaaaaacccagttcatacattggttgattgtcattccatgctgtattagctgcctttttttggtatttaaatatatacacacacacatctatgtatatatacatatatgtcatgtataattttgctacttttttgtatattttataagtattatgataaaacaaaactatataaatttcagatcctttgtgtcatcacagatttacatatcataaatattcagattaactccagatttttcttttctcttgtaaagcttgttatatgtcatataagtctggaattacacccaaatactgtaatacttttaaattattaatcagtatagagaccaaattgttctatgcagtgttttggatagataataaagcaaatattcggtggttttccctctacttacagtattgaaatttttgtaatgaagaaattgaaggtaacaaagttaatttatcgaaaacaatatacgtaggaaaaatgtaggggaacttccaacatatcctaactaagttccataagtaacttagagatatgttacttatacagaagagtgagataatgcttttttttttttggagtattttacattagacattaagagctagaaccaaaggaaccaaacaagcaaaatagtaacaacctcgaaagttcactctcctaggcatgaagctctttgtttctctgaaactttctgccttagcacaatctctgtctgtgtgtaactctttaactcaaatatgttttgaaattggtttctagaaattactttcctgtctgatcacatttaatgcagtagaaaaatagagcacattcaaacacagtacttgaccttttttttcactaacatgttgagatgaataggttaacattactatgcaaataaaatgcatgatgtgtgtggtatatttttggtgatcagtagccatatgcaatgtgcatgttaaatgattgtgcctatgttgacttttctgaagtctgatggttccagtaatcattgataaaagtgacttatgcttatgtattttatttttttaagattttcccctccctttaatgtaagttaagagccttctgatgaacttagatagacaaaccctttgggtgtgaacagaagagtcacatttagatttgacctactaatttagtcatgatggacttaagctaatacatgtactttacttactgtaatgtgatttttgagatcttttgggaggtgggaattaagggataggctagaaactagtaaaattatgatataatagagtccttttagtaattctgatattactaacagtgcctgaaacaggcctgcattatgtctagttttgtattacaagtgggtcattttagtgtgaaatatatttgtacatagtaaaaatactagtcctctaggtatacatgtggggggcaaaggtaaaataggaagtaatgccctctgtggggacataatggttaacaaatatgtaaattttaatcttacaaaaggaattaggagtattttctcttaaaccaagagtcttccttagtagagtacttttacttcacttaggctagatccctgctatagcctgtaaaattggtgctctaaaatatattaaatgtgaatagaatttgaatgtgctaccaactctaatcaatatgaatagacacccttgaaaatagtaacactaaataggcagaatttataagtttcttgcttttcattcagtgtaaatcttacctggcattttttgtagcctatacatggacactgagtacctatgttaatgtacatagtaggagtacatattcgagtaaagttgaaatgtttcatgttgtaagaaaatagagtagactctttctttactccttaggaattaagctagaacattctggaggcatgtgactcacacatattccttgtacctagcttgtaaaatgcattaaattagaaaattagtttcagtagatagtggtaaaaagagggtttgttgttttagggctgttttaactttttttttctttcttacaatatttttatctacctattaaagattgttttatcttagtttgctttcataatagagtatgaacagctagtggaagaaccaagttaaagcagatatacatgctcttatcctagttttccccaaatttcatttatttaaataattgtagtttttaataatgtaaatttaaaaaattctttatactgtgttagataataatagtttatctcttgagtagaggatgtttatgccattctactcagaaagaagcagtggactaaggagcaaaaaggacttctttcctactttcatatttcatagttcttaaagttggaggaaatacgaagtacaacaaaaatttaaccaaattttgtttgttttaaaggaagaggtctttccaaagagagaattaacaactgactgaaccagtcctgctaatttgttaacttagtagctatattttagagtcttaacatatttaaatatgcatgattacttcttgacatttatttcagatcagaccccaacaccaacaagattcttgaaaaactgtgaagaagtgggtttgtttaatgagttggcgagtccatttgagaatgaattcaagaaagcttcagaagatgacattaaaaaagtatgttgtaaccatgaaatttaaaaagagtacttctgacagaaaagtaatcatagtttatacttcctgctttttaaatttagacacactgtttttgaacttataaccttttccttattatttgaattatagatgcctctagatttatcccctcttgcaacacctatcataagaagcaaaattgaggagccttctgttgtagaaacaactcaccaggatagtcctttacctcacccagagtctactaccagtgatgagaaggttagaaatttttagaaatacaaagtaagggggaggaacagtacccaaataaagtttactatttaatctccataaaatgttaatgtattaaattcagtgtcagcttgcaatagttttatatgtgaaagcctgtcaatactcagatatttcagggtaagaagactgcagcttttattgtacatagaaaaattataggggagaacagtcatgttacataaaacttatttttaaaagatatataaatttataaatttaacttaatttttctgtgttttgctattttatatttagctacttttatacagtaacagcttaattaagaatctattcaaaaaattatttgaacagtggttttttagacttttacaggattaagggactagttactcattctcagcagtggatctttgttagcggcaattaggacgatgatgatactagcttgaatacccagataatctgggaccacctgggctacagttgtgtgttgagtaacattattatgggaacttcttgatcactcttttgttcacaagcacatagaataagcacatatttatttgggagtaccatgcaggacacagcgaagggcaatgggacacataaagaggcagtggcaatattcttttttagattgttattctaaaaccatacttattaatggacttctgtcatggcagaggagctagaaataaggaaatacagaaaaaataactttttggctaagaataaatgctttgttttctgtttttttttcttcattttctttttctcattttaaaagtacattctcattcttcttctctaagaatacagaaacatgaaaagaaaaccaaaatcacctattagcacataattgaataagaattactatcttgaaacatttttttctagatatatacatttataggtacaaatacataagtgaatagttaaatagaaggatagatggatataaagatcctagctttattttatattgtgctttagaccctcagtattgatgaatattttcccatgtcattagagagttccccaaatcatactttttaatgattgtactttattttattatatgatatgtatatgtattatgttatcctgttctttttggacataaaggttgtttccacattattacagttattggaaatgctttttaaatctctgatacaaatcttttttcctagagagcatttcattcttttcacacttaacagtttttcattgttcgtggctgcttcagcatcttttaggagtattccttctttctgcattccccaatcattaggccctccttgagcaaggtataccatatgaaattgatttaaaaaaaaaaaaatctggacctcttcttctttcttgattttcttcctaggtgatctcatccaggcccataactttaataaacatctacatactgatgactcccaaatttctatgggcataggtatctcaccagattgccagatttatatccaactccatcttgacattaccttttctatgtctaatagacatcttaaacttaataggtcaaaatcagagtccttgattcttcccccagttttccccatctcagtaaattttctccatccatttagttgttctagctgagaatttaggggtcatccttaatttcttctttcttttacactgaaactaacagcatattttatcagacctgaatctcatcctctatgtctgtgttcagtgacaccacgtaagcccaaaccatcatcatcttttgtttggattattaacagttaccttctaacttgtcttcctgcttctacctccaatccattttctgtaagatgacttttaatacattaaatatgtcacctgcttaaaatctttcaatggtctaccattgtatttaaaataattcacactccttggcataagccctctttgatctgggcctgtctacgcatctatccttacctcatgcctctctattgtgttcatcaaatattcaaagctttttcctacctcaggacatgacatatatggtattgcttccttctccctacaatgaaatgctctcctcctcatccttttatcatcagttcgaatgctgtttttgcaaagaagctcacctattcttactatgctgtctaaattaactgactcttccttaccttcagctaatctttcatcctttgttacattgcacgtattattctgtaacacttaacatttactacaatctgaaattttcttacttgttttacttgtttattgtctcttccttgagagctagtccttgggagcataagttctcaacttactgaataaatgaagttacaatactactactttatccttcttcctatgtagcttaataagattttgatgataagtggcagcatacaggccaattcataaaacaccatagacccaatttttacactgactatttaaggagttctgggtaaaatcttttaaaactttttgttctataatttgtaaaaccagaggaaataccatctttaaggtcttggctgacaaattctgttttcctgacttgaaagagttcactccggtaattatttattttacattcaagatatcagtattacgtggccttttgatatgaagaaattattgatatagaagaggtagctaactggaattaacaattatttgtattgctctaaaagttcttatttctgttacttaattgtatcagccataacacagtctcactggacctgtttcctcttcatacagtataatgagggagggggactaaacagtcccttctggattttaagttctgtgattctctgagaatggattatatttttattttttattaaaattctcttggtatcatagccaagttgcccagtctaacttatttctggattgataggagaacaagttgtactggaaaaaaaaaaaacgagtctttttaaaattaaaatattaattgaacattgcatttgaatctttacagctcttctaaaatgttcttttaattaatttgagatattaatttgcttttagcagttattattctgtagatgcttttagaagtgtgttacattctgttcactaaggtacatgatttgtatttttaaatgccacccttttttatctcattgttaaataggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtgtaagtgattcaggccaatcattgaacatatacatgaattaagtttgttttgtaatgatttttcctaagacatttgattattcaaactaagatcttagttttgtatgtgtgtgcatgcttcgaattttggaaaaagtacttgcgtagtcttctttaatataaatattaactaacagagtgggagataaatacaactaaaaacaaatatagaatgtgaatttaagatagtcttattttcatgctatttcacacaaaatataaaattactgcatcaccagattccatttctttcagttcttactggtagctcccaagagctctctgatgacagtttttctcattttacaaattggagattgtcctaagtaaatccataacttttctcttcttttcaatactgctacacaggttatgcatttaagatgcaattaaaaataattaaattttgctatttgctttgctgtggttagaaaatgtatttttaaatgatatgattataggagtaaaaatactattgtatttttaagagacagttggtatgaatctcttttttaaaatttctcttcttttgtttttcttagccctgtaccaggcccatttcctcttctgttacatcttcctaatggacaaaccatgcctgttgctattcctgcatcaattacaagttctaatgtgcatgttccagctgcagtcccagtaagaaagttagactatttaaatctctatcgcaaaactgatctttgtagtcagaaaataaagttggctgcttgactggcttatgaaattgaatttaacataatattgattagcagttgatagtatttatttgttatcattgtaatagcatataccattcaaggtatagctattttttctcttctccccaaaaccttaattttttttttatactgagatcttcttattcaacccatatcaatttgactggacttgtagcattcaaatattaacacagatttcaaattttagaaagatatttgtactagaatacttgtcaggtaactctgtggtatttctattagtatggaaattgtttataaagacacactctgaatttttgtggtcaagtagggtttgtagaatctttgatagcccagcatgttaaaatgtaaatgttctagaaaaataatctttcactttccctgtgaaaagaccccgcaaaaaagttttttgaggggtgtgttaaatatataaattttgaaagacgtagacaaaatagttaactatctacttatgatatttaatagtttggccaggcatggcaactcatgcctgttgtaatcccagcgtattgggcggctgaggtaggaggattgtgtgagcccaggcgtttgagactgcagtgagctatggatcctgcctggatgacagggcaagaccccaagtcaaaaaaaaaaaaaaagtaatagtttaatgaacatttaaaaacacattgtttggaataatgtgtgttagaaaattgcttttttcttacttacattacataaaacagttttattcaaacaaactcttcagttatgtctttgacattcaaattttcatcctgagaaccactttttgagacatctagcacagtttccagaacacagtattttctttttcatctaaatcatttacgatattactttatgaatctctctattattctctccctggaaatcttacaccaagcattaggtacttatttatgtaataaaaagatagttttttcttttaccttctaagatgcttgttactgatcagtacagtgtaatcatttacagtgtagcttttaaaaattatttttaggccaagtgcagtggctcatgcctgtaatcccagcactttgggagaccagggtgggtggcttgcctaagtccaggagttcaagaccaggctgggcaacatggcaaaaccccatctctacaaaaaataaacacaaattagccagttgtgatggaagcacctgtagtctcagctactcagaaggctgaggtgggaggatcacttgagcctggaggttgagactgtagttagccgagattgcaccactgcattccaggctgggcaacaaagtaagaccttgtctcaaaaataataaaaaataaaacttatttttaaaagcttacttatagtaacattccaacactttcggtgagattacccccaagaatattactaggattaatgtttgatatttatatctttttttaattaactaattcttccacgtgatctttcaaactatccaaaattagcattgattgacgtaatttcaagataatgtgccttctttaaaaagaactttgttgttcaaaatgcattatttgagagactttgtaaggactcagatataaggtatctgcttcctctttactgagaatatttttttgaggagggaaacattcttgccttgtttttgagattctgattatcctgttacatgtacctagtgatgaaagcaaccggaaatgaaagaaaagatatgctttatttatacagtaactgtgttcactcagtgttaggtttaagaaaaaaaaggaaaaaaccaaaatggtaaaacctgttacagattatttcagaaattattacagtgtgttatttgttattatgtggtatgtataagaaaattcattgtatatatttttagaaaagcaaaattcattgttgaaattattttttatgcctaagtgtcacaagttttgacattcttcctttcatattcaaaatggaagtttgacagatctttgagaatttttgcattaatcactttgaatattatgaatttctaacagggaccattaagaaagaaattgtagaaactgaaaattaggaaagcacacgtctcagaaattgacaacttttgaaggataagtcaggatataagaccaaataaggatttggtatagagataaaatcagctggtgataaatttacaatgttctgattcttaaagtctcaaattattacaacagcagtaaagtacaaatctcattttgaatatattctctagcaattatttttccttatgtcatgcatagctcgttcgaccagtcaccatggtgcctagtgttccaggaatcccaggtccttcctctccccaaccagtacagtcagaagcaaaaatggtaagccagattttatttgttctgtacattgcttgaggctgttttgaattaatgttttcactaaagcctgcttcaaatgcacaatttagatcacatttttataaagttacggactgttttatactatagataaaccacaaaatttgaaaaaagaaatcttcctttagcatagtgagtagttagtgatactttaaaattagtggcagattagaagttctgtttcttgtcacttgttgtttgtctggctttttcttgtggctttttctcctcctagtggaaaataggagtattacatctgaaactagatgtgatcatctgaaggcagtgctgctaataatgatgagtggttttaacagtattaaaaagaattctgaaatagtgtacaagttagcaaacatgataaaaccatttttttctgttgtgctgtttggatgctattaaattaatgtttagatgtgtattttaattttaattttaatcctaactccactattcactacctttaattaagcaactgtaactttcctgagattgcatttcctcatctgtaaaataaaaagattaagctttggtttctggggtacttcttaaccctaaatcctataaacgttctaattttcttagtagaagatctgacgattctatttttaaagaaaatcagggccgggcgcagtggctcacacctgtaatcccaagcactttgggaggctgaggtgagcagatcacctaaggtcaggagttcgagagcaacctggccaacatggtgaaaccccatctctactaaaaatacaaaaattagccgagcgtggtggtgcatgcctgtaatcctagctactcgggtggctgaggcacaagaatttgcttgaacccgggaggccgaggttgcagtgagccagcatcgcactattgcactccagcctgggtgacagagtgaaactccatctcaaaaataaaataaaataaaataaaaatcagtgtaattctccttgctgtgttataatacaataatgtcagttaattaataacatcgattaattgggtagatgttaacgttctatatcataatagggctaacaacagcaattaattaatgtatccttaggaaatcaatagattagtagttattagacaccttctatttgcttcagttatttgctaggcactatactaaatacaaatttttacatgctaaaacatattgcagagctgattatttatttatttatttattttttgagatggagtctcgctctctcacccaggctggagtacagtggcacaatctcagctcactgcaacctccgcctcctgggttcaagcaattctcctgcctcagcctcctgagtagctgggattacaggtgtgcaccaccatgcctggctaatttttgtatttttagtagagacgggttttcaccatgttggtcagactggtctcgaactcctgacctcgtgatcccccctccccagcctcccaaagtgttgggattacaggcgtgagccaccgcacccggcctgaaaaatttttactgctattctccattagtgcagacaatcagtcagaaatttgcacaggacaccctgttttagcaataaaacttacatattatctgaatgaacagcagttggttgaagagtataaaaattaggtcgttattgattgttagagaagaccctaaaaacccaaggaggaaatttttcacatcatagtatgttcaggtcagagctttggaaatactaagatgaatcttcttcacttgatagcagaagagcttcaccaggggcattttttgcacttcctattttagtatactgattgatgaaaaattcaatttaatttaccatgcagtgggaactgaatagagcagatatagatattaaaaggagatcctgttattgtgtactgcatctaaaagtatttttacatattcattggacttttttctataaattaattcaaaaggaacaaatccagttttaagaaatacctttatttacaagagtaggccatatttttagaaactgttaaactttacacttaacctgaataactgtttcttttaggtcatcaggaaattaaattaaaaagaataaaagtttctctctttccgatcagtccactccatctattctgatgtttgtaaccatagattagttatagaatttcatataaatagccactttatactcttatgtccagctcagcatgtctcagatttatccatgttgttgagtgatcacagtttgcttctttttattgctgagtggtattccattgtgtgaatataccacaatttctttgtccattctcctgctcatggacactttaatggtttctagtgtttagctattgtgaataaagctaccatacacagtcttttttttttttttttttttttttattgatcattcttgggtgtttctcacagaggggaatttggcagggtcataggacaatagtggagggaaggtcagcacataaacaagtgaacaaaggtctctggttttcctatgcagaggaccctgcggccttccgcagtgtttgtgtccctgggtacttgagattagggagtggtgatgactcttaacgagcatgctgccttcatgcatctgtttaacaaagcacatcttgcaccgcccttaatccatttaaccctgagtggacacagcacaagtttcagagagcacatgattgggggtaaggtcatagatcaacagcatcccaaggcagaggaatttttcttagtacagaactaagtgaagtctcccatgtctacttctttctacacagatacagcaacaatctgatttctctatcttttccccacctttcccccttttctattccgcaaaaccgccatcgtcatcatggcccgttctcaatgagctgttgggtacacctcccagatggggtggtggccaggcaaaggggctcctcacttcccagaaggggcggccgggcagaggcgccccccacctcccggacgggtcggctggccgggcggaggcgccccccacctccctcccggatggggcggctggccgggcgggggctgaccccccacctccctcccggaaggggcggctggccgggcgggggctgaccccccacctccctcccggacggggctgctggccgggcgggggctgaccccccacctccctcccggacggggcggctggccgggtggacgctgaccccccacctccctcccggacgaggcggctggccgggcgggggttgaccccccacctccctcccggacggggtggctgccggacggagacgctcctggcttcccagacggggcggctgctgggcggaggggctcctcacttctcagatggggcggctgccgggcggcggggctcctcacatcccagacggggtcgcggccgggcagaggcgctccccacatctgagacgatgggcggctgggcagagacgctcctcacttcctagatgggatggcggccgggaagaggcgctcctcacttcccagactgggcagccgggcagaggggctcctcacatcccagacgatgggcggccaggcagagacgctcctcacttcccagacggggtggcggctgggcagagggtgcaatctcggcactttgggaggccaaggcaggcggctgggaggtggaggttgtagcgagccgagatcacgccactgcactccagcctgggcacctttgagcactgagtgaacgagactccgtctgcaatcctggcacctcggggggccgaggctggcagatcactcgcggttaggagctggagaccagcccggccaacacagcgaaaccccgtctccaccaaaaaaaatacgaaaaccagtcaggcgtggcggcgcgcgcctgcaatcgcaggcactcggcctgctgtggcaggagaatcaggcagggaggttgcagtgagcagagatggcggcagcacagtccagctttggctcggcatcagagggagaccgtggaaagagagggagagggagaccatggggagagggagagggagaccgtggggagagggagagggagagggagccacaaaacgtacttctatgaggatatctgctcagcaattgtctgtctcatacacattcttatgtaactttcatggccatatattttcattttattgactaaacagctaaaagtagaatcgccgagtcagagggtaggtatacatttaactttataagaaattgctaaacctttacccaaaggtttacattcctaccagcagcgtgtgggaattccagttgttcccacattcttgtcaacatttggttctccctgtctttttaatcatagacattctagagctgtttagcagtgtctcataattttaatttccatttcctttttggccaggcattagttgtgaggtcttttgcccatttaaaaaattgtgttgtttttcttttattgattgattgattgagacggggtttggctctgttactcaggctggagtgttgtggcatgatcttggctcactgcagcctggatctcccagcctcaagtgatcctcctgccttagcccctcaagtagctgggactacttgtatttttttgtaaagattgctctgccaggcttgtcttgaactcctgagctcaggcaatccaccctcctcggcctcccaaagtactgggattacgggcatgagagtcaccgcaccgggccaattgtttttattattgcataattatttttatttatttatttttgagacagagtcttgctctgtcgcccaggctggagtgcagtggcacaatctcagttcactgcaacctctgcctccagggttcacgcagttttcctgcctcagcctcccgagtagctgggattacaggcttccgccaccacatgcagctaatttttgtatttttagtagagatggggtttcaccatgttggccaggctggtctcgaactcctgaccttaagtgatctgcctaccccagcttcccaaagtgttgggattacaggcgtgagtcactgcacctgactgtaattctttttttgttgttgttgtttttggacagtctttctctttgtcactcaggctggagtgcagtggtgagatcttggctcactgcagcctccccttcccaggttcaagcgattctcccgcctcagcctcctagtagctgggattacagtcacctgccaccacacccagctaatttttgtatttttagagatgggtatcaccatgttggccaggctggtctcaaactcctgacctaaggtgatccacctgcctcggcttcccaaagtgctgtgattacaggcgtgagctactgcactcagcctggaattctttatttacactggatataaggtttttgttagagagagaggtacgtatatttctactgtctattttcttttagtgtgtagcttgcctttatttttcttaatggtatgtttatactcccattgacttacttttgtctttaatatttgttttctcctacttaattaagcttaatttgcttatcttttttgggtttcttaaagtagaagcttagattatctatttaaatcttttttctaatatagacatttaaagctataaaatttcctctgtgcacaaattttgatatgctatacttttattgtcattacttttttaatttctcctgtgatttcttctttgacctgtgagttatttagaagtgcactgtataatttccaaatatttcaaggcttttctatttatctttttcatattgatttatattttaattacattgtggtttgggaacttaccatctttggtatatttgattttcctttatttccattttctaatagatcatagctatttatttcagctcatttgtgaaacagtagatattgctatgctggtacagtaacctgaactggtaacttaaaatgtcagtgtactggataagggaattctggttacttgaatttttttgttgcatagaaattatttcacacttcaatattctttttatattaacaacatcatttaacagctatttctatcaattgttacatggcaaacatttcttgggttctaagaaattcaatagacatgatcttaaattttgagatttttcttgcaaatgtgttcagtagccatcaggagagtcaaaaaagaatgttcttctaagaagaccattatggttttcttttccagcatgtgtagcaattaggattgtattttatcaatgagctattttgttttgggttttgatttcatatttttttgggggggggcagattttaatgcccttgatggtgacttgtacacataatgattattcagggactacttttaaaaaataatataagatttattaagattacaagtttaaaaacctagtgctttcctaagttctcaaggcaatttacatgtacagttatgtaatgattgcttttaaagagcttaaaatataatcttaaacacgctaagctatatacatgtaaagctatgtactcaataattctctcaattgtctttcttaagtacttaaataattcttaaatttaactaaacttagtgatacatagttttcttaaatattcattaattatttagaagcttacttaagattatctcagcacttacaactaaaatcacaggcccattatctcagcacttaacaactaaaatcacaggcccaagtcaatctcttaattaaacattttcacttaaagtccaagggtaacgtgttattccgcttggcaagttagattagacacttgtagaacgtaaaataccaaataggtatagtttatttgaaatttaagtttgaaattaaaatgtcagtggtattggtttacttttttaagcttcagtgggcttaagaagactcaccatataaacaattctgtcatcccaactgaagaacattgaagatgggttcgtatcccagtgcacagagctttcttaatgaccagataaatggtcacagaacttgattctttcatgccttaaagatagaactccaagtccacattctccaaataagtggttcccagctcacattccctagattcatgttacacattaagtgatttttctgactcttcacctgtttgcgcaccgccccccccaccctgccaccaccttaaaacttgtaatttcttcttttactgcttttgttggattttactttgttgttttcagatctttgaaagtattttaaacatcatccttttggggttctgcatctctctcaagaatttattagacctttatgatcacaatctgttaataacatgctgtatattgtagcagtagtgattctgctaaaatgacctgtggttaaaaataatgggattggaacatggaagaatgagtagcacactacagctaaagagaagtttactttgtatgctaacataggatgtttttgtaattctctgattttcagatgttcagtgcctttccaggaagatattatgtatgcattgtgtttgtgtgtgctgtgaatactgaaataagatctttcttttctgctaaaaaaaaaaaaaagtcttcagagtaagcttgtattttttaatttttaagaactttaagcctttggaaaagtaagcatgtgttaaatgtcgatagggaccgaaaaatgaaagactatatagtactttttaatacaacagaaaaattcccaggatataattttctacagaattagactagttgtcactaaattttggtttcagggttttgtttgtcgttaagcccgtaaatcatattactcttctaataaaacaattttcttttgtaatatttgtaatcaaaaagcagctcttctgaataagaaaatgttaatcatctgggaattttaagatttagtaaagtatttaaatagtatcctccagaatctttttttttttttttttaagatgtgtgacaaactgagaaatatctttgcacacagtgggtagccagtaggttttctgcagggggtttctactgaaagctgacagagggcatcttggcaaatgttcagaaacctacattaacttggttgggccctgcatggaacctcatgttcagcagaattcttctgacctgcctctgcatgccgagctaatcagcaaatacctaatgagcccactccaaagaaacagaccctctctcaacctacttgattttcatatgttctctgggggtggggtgacaagatttcatgaggactgatgatgctgcaaagaccacaataatgataattaacttgctgaatttagaagattatgctgttaattagttgcaaaataaagataagtaatagagcagcagatggtaggataacacccaggagaaggagggttattactctgatgagcttttgtggcacatatgaaatatggatctgactttttcataaattgtttctagagaacattatcttttttctttgaactgtgatggagtactttgttcctactactaagttctgacagatgtgataaaatttattttcaagggtgcaacatagaacttgaatgacaattatttctaggagatcacctcttaaagcgaatgtgtcagattggtcagcacaacaaattattcatcctttaattaattgaaacaatctatatctctctaagaaaaagagttttcagtatagtagttgaactttacatcactgaaaattaaacattaaaatactggtctgtttcatagaaacataatgaagacatttttgtttatcaaacaaagtctacctttactttaaattaaaattatgcctaagttttcttgtacatgttggataatatagaccttataaagtcctccttttttttttttcctcttttttttgagtcagggtcttgctctgttacccaggccagagctcactgcagcctcaaacttctgggctcaagcaaacctcctgcctcagcctcctgagtagttgggactacaggcatgcaccaccacacctggctaatttttaagttttttgtagaaatggagttttaccatattgcccaggctggtgtggaactcctgggctcaaggagtcctgccttggcctcccaaagtgctgagattacaggcataagccatcacaccccaccttaaatctttaatttttatgagtgctcaatctttacttcttagagtacttaatccttatttacatatattaaatttgtctattgagagagatttttgatcttagtaatggactgaccaatatcagatgcttaacttaattgattactaatagatttagaaaatttaacattagactagagctccagtttggcaaagcttttgtttagaatatgtttggtgaactgggagtcaacaaatagagtttctggttttatctctgctaactttgattctgggaagtaacttcagttttttggagtttctgtatctgtaagatggtgattggactaattgactttcattatctctgctagctccaaaattctattgtaaaataaatgttcattacatttgttttcattgattttttttttaaaccaaagtatttggccttcttcaaatgctcctaacaaatatgtatggctggattgtagatatccttacattaattgtaaaatttatatgaatgatatttagtgactgcttttttgacctaagtctaatttttttagcgtgtgtgcatttttgttgtagttttagaaaaattaatggacagtttagaacagtgttaattaacccttaaaatctttttcttctgttgtatacccactggcatacttttcaagtcagacccattgtaatcaatgtaacagcatggagcaaacattagagcttcctcactggatgagtactgtataccctagggcagtcaaggaaggataatgaatgaatactgatgctgcttttaagtgctttataaggtagtaacttgccctactaaagattattcaagagagtgatgtttatgtacttcaggctcccctatgtgcagttactgtatttcattaattctgagagttaagctcttcactgtaaaactttaaatgctcttcaattctatgataatttctacctaaggacttaaaaatcttttccaaacacataatttactaagcctcacatttctacttctagttatatttgtgcacattttaaaactagaaatgaaagccccaatttatcactatagactgggtactagtcattgtattttgatgtctaacattctatttataaaatatataaatatgcagactggcgacctcccaagactctctccctttgttctgacccacacttttccaactcaggtctttctactttaaatacttcttgatcgtttttctaagtattcctatctggttctagccagctactactttagtcccgcatttaatttcagttttaatccatccacttccacattatcccatcaattagggtcctaatttcctatgttttagctactaatatagttgtttctgattgtttagaaaaggaactaggaatcttatcttgattctaaaaaattcagtttttcttatggtcttgagcatgtctctgttaggaatgcttacttgttccccggtgctgtaaagaaatagcacttgaacataaatttaatttcctcagcaaggccaatttttttactttctgcagaaagggtacactcgccagcagttttcccatgagagtacactgaacaaaggagacagggtcatttataacctgacgcatccaccctactgctgtgtccagtttccattggctggaatgggacctcacattctgtatttgtcctgattggctagcaacttagaagttttaaaagaggcaaaggcagaggagaacaaaggaaggaggaagtaacttgtggaatgctaagaaaggtaaaaacaccttcaaataaggaagaggaacaggctatgacctaatgcttacttggaccagtatacgcatgccagggcaaatatgtaggtaaattgtgggagctaagaacataaagtacattgatttctttattacggctagcagatatttgaatgttagcacaggtctttgaataaattttgcttctaagagaagttactatttattcctaattagatggggaggagagtctttgaagaggaacctctactttactttttacatctcatatataaaatatgtctgggatcaaaccaatgcttaagatgacccttagggatattttgaaaattcagaaacataggaactatcctgattctttggacctccgtgctaagaaaatagaggcctcagtagtattcttaaaagaaataaggaaactgacatctgaaaaattcttttacgagtcagatagttttacatgttatatttatttttcaattcaactctgcaaggaagttattattcccagttttataggtaaagaaattgagactcaaagatcaatgatttgttcaaagtcacagatagtttgaggtagagttaggttctgaacctaaagtgtattctcagctttataagaccatagtacattgcatgttctaatcagtgaaagcactaggatattacataagtggtactttttataattcataaagaagtagtctgtcagaaaagagggagaaaacatgccagatcctggcttagcagttgcagtaacaggtttggcactctaaatccttatgattgttttttgaatcattaagccacaaagtttcagactctctgtcttgagttttccctgtgttttctggtagcaccaaggataaagtatgcagcatggtgctgtggaaatattttgcacttgaaattaaagagatctgggtttatatccaggatttgaactagcttaacagctctgcatccttgagcaaatgatatctggtttcctaaagtgtaaaatggggatactatacaattaaaaactcattaaaaaactacagataatacaacaacacaggtgaatctcaactgcattgtgctaagagaaagaagccagattcaaaaggctatacaatgtatgtttccaagtatgtgatcttctggaagagacaaaactcttgggatcagaaaacagatcagtcgtttccagggccagggagtagaaggagagtatgacaggaaagggcatgaggattttattgtggtaaaactgctgtgtatcctgattgtagggtaggttgcatgagtgtatttgtttgttaaaattcaatagaggccaggcacgatggctcacacctgtaatcccagaactttaggagccgaggagggtggatcacttgaggtcaggagttcaagaccagcctggccaacatggcaaaaccctgtctctattaaaaatacaaaaatgagccggtcgtggtggcatgcacctgtaatcccagctcctcaggaggctaaggcaggagaattgcttgaaccgtgaaggtgaaggttgcagtgagctaagatcatgccactgccctccagcctgggcgacaggcgagactccctcttgaaaaaaaaaaaaaaaaaaaagaaatttaataggattgtacactaaacagagttaacttgctatgtgtaacttatatctcaagaaaaaacttttctttttacaaattgactttattttaaaaatcacacccagaatatacggtgattcacaagagagagaaaatgtccactaacatttgttcacgcataattactgcctcagttgaaattccggtgatcttttcatatatgcttcagtttttatgggatctggatcacatatgatagacagtaagaagataggcctagatgaaaaggaagaaattacaagttttgaaatagttataaaaatttctgaattgttcttagttgaagtgaatggaaatacttgtactggtattatttgggggtcttttttaaaagctcttctctcactcacccctttctgctgtactcagggaaggaagaaaggaaaagattgccaagaatatgtgttcttaacacttaacaccccagacagttatgtatttctaagaagtttgggaagcactgggtaggctgcaacatggttctcacatctctatctctcttttgtctctcagttgcactcgctctcactctcttattagcctccatcccctcaaagatgcacctctataagaatcttaggaaagtgtaatatacataactctgactccaattcctgtaataatatgtatttggggcccaagaactacatctcagttattaagaacagtatcagcaataatagtctcaggtctgttggatccctgaagtccctttcattgctgagatactgtggtctgattatctgtgcaaattatttcatatttacagatcataacaaaaccaccttaaagatcacatatgaccattttcactaaagaaaccaatttctatcagttaacagatatgtttgttttgtacctatgtagcaaatcattatatcagttgctaaaaggaatacccaaaagtataagataatctctgctcttagagagcttactaactggttgggagataaaatagttgcatatgacaaatttttattgatagcataataagcttcattcaaattgttgcttgataaagtggtagacataaatatctagggcctcattctaatactaggtctgtcatgctctgaatgtgagtccagtacaatccaataattaactggcaaacctgcaacagcaaaagagaactagatctgcttactggggacagggaaaacctaagagagacaaacccagctgtaggttcttggaggaggctcagtttgggcccatttgatctctgtttgcaggtttggtgccagtgcttacttggacaatgacatgatgttacatttttaaggcctttattattattttctcaaaattcactaggaacagcaaaatacagaatcctctagtagtactaggcaaaaggactcagggaaactacccaaggtgctattgtttgtcttgttgatattcatgatgatctttaaggacttaaaaaaaatttttaatggtgtttgcattgcagagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggtatgtgtgttgtttttattattcagcactctgtcatctttaaacagaaaagtacagtgtaacttacggcttatttaaaaaatattactctggtcatgttgttattccaaagatgtatcaaaagcctcaggaaaaggtagctcagtatacaagtattgatacaaaaataaacataatagagcagtgtttctgttcaggacacctgcaaatatttctgtgggtgtccatatatgttggtcacaattctttttaaagaaaacatctttttctgttgattttaggacagtgaaactgaatactgctttgagaaatttcctttactctctatttcctgattgaagaagtttatagagttatgactttggaaaatagttatataaccagaaaaataatattagaaccttatagtgagaagaatgaaattgtatcttgttttcttattgtccaaaactacaaatttgacataaactgtaactattaacactagatattttttcttgctgtggcataaacaggtttgatttgaactgttctcctatgtaaccaaagtattgatgttataggaaaatttaataggttaagttctgtaaattttatagacaataacaacttctttgttaagagatgctgtgttcttcagaaatgtatgtaactaaatcttacgttctttttcaagtagcaaaactaagatttctaaagaatctttttggatctcttcttaaaaaattattgattttcctttttcctaaaatgccatatgtttatgattacaatgcatatcatatttcagtattgtgttgccatctacaaccattaaagtgtgtatgtcccaaagaggcagatgttttttctgtttccgttactagcagaacaaataattcttgtttctgcttttaatatttgctcactcattgtaaaacattactctttgttatttatttgtataagtaaccttatctcacttgtaggtaatcagaagtcttttagagaaataggtagataaatattcacacatatacacacatatgtaggtattacattactaacataaatcaaatgattcctgaattaaaacttgtgaaacatcaccaaaggagcaaatatgctttatggcagctatttatactagagacccctttcacttatctctagtttgtgactgcctatgagatgattgatattgttatatgcctgcagtgcttttctaattctttctagtaaaggattattgtactcctgttaaatgtttcagaattctatttagaccttttatctttacttgaagaatattagcattggcattaaaaagcaaaagttttcaatcaaagaaacacatataaacaagttttagattgccacctaagcataggtatttacataactgtatcttgtcttttaaaaacttaatatataatgaaatgtagttgtggttgtcatccactaaccaactttacttagggaccaaaagggaaaatgaggggctgagtgattgtgtatatgtgttaatgttatacctcagggtttaacaatgattcacaggccatatgcaacccatgggtgtttttgtgtggtctgcaagttaagtatgattttttacatttttaaagggttatttctaaaaaatgaatataatttattgtccttactttcttgcactaactatagtttccctggatctaatttttatttatatccttatatgttattgtattggatggaagccccatgagggtaggactttatctgtttgttcactgctatacttagtttctagaatagttcctataaggattttctgaatgaaatagaatgaattaatagacatggggagagaaggagcagtatacacttctaagaagcctccaatccttggtaggcataaaaatatacaaatgtaactctgagtagcagaaattaagcttctgttattctgctagtacttatgattagtctttgctataatgagttaaatcaattaaaaacaaaaataaactgttctctcttattcagccagatgagtaaaagaaaaaacctgccattctcaataagaaaaataggaggttgtggctcacgcctataatcccagcactttgggagcctgaggcgggtggatcacctgaggtcaggagttcgagaccacaacctggtgaaaccccgtctctactaaaaatacaaaaattaagctgggtgtggtggtgggcacctgtaatccgagctactcgggaggctgagtaggagaatcacttggaacccaggaggcggaagttgtagtgagccaagatcacgtcattgcactccagcctgggccacagagcgagactccatctcaaaaaaaaaaagaaaaagaaaaataggaggatgaagaaaaaaatttcaagattgcaaatcttgaagccagccatagaaatatttttctaaaacattaagttgcaattatgtaagtaaaataaacgctctaatttaaatgcttaatctttattacaattaaaatatttcttttttgagacgggatcttcctctgttgcccatgcggagtacagtggtgcgatcatggctcactgcagcctcgacttcccaggctcaagcaatcctctcccacctcagcctcttgagtaactaggaccacaagcacatgccaccgcacttggctaattttttaaattatttgtagagatgaggttttgctatgttgcccaggcgtgaaatactttatacatgaaataactctctttgtaatgctagttatttggacaaagaaatgataactttattttttggaatttgttagagtgaaaaatagtttggtaatttacctgcagaatttatcttgagctttatataagacttgtattacatagattaggagaaaacaaattttatttgtgcataccatttttaaatataataaattataggtaaaagattgttttcaggcttctcctttggattgtgtgcctgtagccataaagtgttcttttctctgcaccatttccaagagctcattttcttctttcttttttttttttttttttttttttttcgtattttttgagactgagtctcgctgtattgcccaggctggcgtgcagtggtgttatcttgactcactgcaacctctgcctcccgggttcaagtgattctcgtgcctcagcctcccaattatctaggattataggcatgcaccaccacgctcagctaatttttttgtattttaatagagactggttttcaccatgttggccaggctggtctcgaactcctgacctcaagtgatccacccgccttggcctcccagagtgctgggattacaggcatgagccaccacgcccggccaagagttcattttttgacacccatattcatttgttctgtggcacagttttggggtttgtgaaagacttgaagatacctattgttttatagtcttatacactagacaatattactagtgactgaagatttctttctcttactaatctgagataaccaagctgattcattggggagcagagggaacaattaaaatgaaaattaaggctcctgtgggattctccctaccagaaaaatgagtattaataaatataagaacttgacccttagaaaaagactgaccctaaatttcacaaactgaagaaaagctgaatataccaaagaatatatatattttcactccataactttagagaaacaaattttaagaaaattggcatttaatgtgagatatttaatttaaaaatagcatagaaatcatggttttctatcatgaatttaaataggaagttattaaacgttttgagaaatttataatcagttttccagggatttaataatataataaaatctgttaaaatatacttggaaaaatatttctatatatcatttgtattgtattttaaattttttcatatttgtatgtaaatgaaaatattatacataaagaatacatttgctgtgacattgcattagtgagaattgtgttatagcatagctcataacataagtatattcaagaaggaagttaaaccacagggtgattttcatattgccccaacatactgatgtattcaacaagacttagaaaatacagttgctctccccctttgacaccctttactgcctatgttaattcactcactagatacaaatataacaggctttcatctctgtttataataggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcaggtatggtgcatatatgtgaattttgttttatttcttttttaataattgtgaacatagattttttttttcctagttgggcctccaaacattttaggacatgatattgggtgtgtatggaatctatagtaaatcatagttttgtaaacctgtttgtttggatgctgagatgaaataatataaaactttcaacactgatacagtgaagaaatttaaaatgtgtttacctgtgtacaaaagtagctaaactatccggtttgaactttataaagttgtgatataaagtgcagagaattttaaaatttaaaaatatcactgttatttcacttttcttgtctatttttttggtttatagcacaactataagtttcttcagtagcagtttttatttttaaattatttcattctttgaattataaattttgttctgttttgttttatttaaagtgaatatattgctcgtgaaaggtgccagattgacagctttggaaactgaaggactctaattatccacagaccaggtacaatatggccagtggcagtacagatcatttcatactgccctgccaatgtgcctcagatacatttcttaaaacctcatggagtataaagttttaaggcagcaccgaatctgtttcctttgtttttcttccttccttttgtttttgttgtgttttttaacgtaaatattctcctatataatcttaaactgccaactgataagtatcaaccagaaaattgatgttaatgaattgcagttattagtctagctcaatcttctgaattatccatacccagttaaaagtgaatctttctgtataatcataattgatggtaagagacctgctgtcttcttaaatctgtctttaagatatcaccaatatagttgtctgtttaaatggttaggaaacagtttttagcatcagacatagcatttaaccaaatgtaagttttataatttaaatttttttaatgtgaagcagacatctttaagtctttattttgctttgaatattgacatgatagaacaaatagattgtcttgcagaacttatttttaacgattttattttaatgatttagaagaaaattttaatacaacttaccacatcacatagacttaaaatatgtgcttatcttctagggtttattaagaaatatattttatcatttatcatctgataaattgtttttttgtttttgagacggagtctcactctatcacctgggctgaagtgcagtggtgcaatctcggctcactgcaacctccagctcccgggtgccagtgattctcctgcctcagcctcccaggtagctgggattacaggtgtgcaccaccacacccggctaatttttgtatttttagtagagatggggtttcaccatgttggccaggctggtctcgaactcctgacctcaggtgatccacccgcctcagcctcccaaattgctagattacaggcgtgagccactgtgcccagcccatcatctgataaatttttaatccagaatgtttcagaaatttttagaaaacatttctaaattttctttttttttaatagtacagactgtaggtactaatttatgctgcaaaaatggctattttatatcaagtctgttagaatatttattattatttaaattttcaaatattacatgaacaaagtgatttaggtatgtgtattttttttctgttcttaactaacaaaatcttctgaatgacctgctattttatagttgtatgacataaaacacaatcactgttgtcttcagttgtcttacctgtagaatagatgtggtaataccacttctctgtattgttacataaatcagtcaattcaagggtttcttcgtacagaaaattttaactagtaagacaaatttaccattattttcctttgtaatttggcttattatgccttatttaagaagtaaaagtacctgaaaactatgaagtagtacatacatatatgttattatttacagggattttaagctgggcaagttttctgctttgacccattttagagcaatcttaataccttttaatgagatattgctgtttccatagttacactgcagcactggttaccactattagccctttattattgcagaaaaccatggaaaattaagtattcaaaataaatataatcttgactccatttatttcatgttttttctgtcacacagtctatgattaaaatgtcattattgtagcagtgctttgtatatacttcctaatttgggtagaagttttttgattggagaaataaagataagatttatcattaggtagaagtttgctgacatcattttttgaagcatgagactattaaatgaaagctaaatttaggaaatcactaaattaagctctacatttgaacttgagtttagttaatacctcaaattatgtacagaagaagtaaaaccagtatttttgaccattaaaagctgggtgatgatggcatcatcttagatttagaaatgcattttaaaataggatccaaaatgatatattatcaaggattttacttacaatacttctccaaaaaagaaaaagcattatatccatctatttatattaacctgggaaaatatctataatatatatatttgtatgggcaaaaagaaagttgttggaaacagcccaaatgtccatccaagatgaatggatagacaagttgtggtttatatgtacaatggaatattattccaccataaaaaggaatgaagtatatgctacagtgtagatgaacctcaaaacattatgttaagtgaaagaatatagaacaaacatcagatgttgtatcattccatttatgtgaaatacccagaataaataaatccatagagagagatggcatattaatgggggagggagaataaggagaaactgcttagtgggtaagggttttactttggagcgatggaaatattttgttactagacagagggtggtagttgcacaacattgtgaatgcactaaatgccagtttaaactgattacctttatgttatatgaatctcaccttggtaaattacgaaaaaaggtcagttacatctaaattaagcattattattatgcttaataaagcataatgctttcttattaataaaaaggtttacagttagatgggtaaatgtataggtataggaactggtatagaaatgactccgtaagtataggtagcattttagaaatgacatgtaccaaggtgcaaacgatggtgaggagggaattgagagcatggatggtttgggaagaaagggtacttcaatgatgactttctgttattgcttcaagtcaatatattattttgactttttgttgttttctacttatttgtcaagtaaaataagttttttaaaagtgacagattgtagctttcagaatgtgaagagttaacatgcctataatagattcagggagaaaaatttctttcagtctgccaacagcaaaaccgttaactgtgaagaacagaatgacttgtaaagaaaattgaatgtcagagaaataattaaaccctactttatgtgaaaacattaatcaattctgtatttccttgatgatccttcatgtgacatgtaggcttagctgatcagtgtagtgggctgtaatgacccatagtttacttatatattttatatgtaatacaaggtttaacaagtgttgaggtatgattgttcatatttttaccaaatacatattaggccttaaaatatattcaaccttattgccgcattcactaaatttaatcatgttttagttttcccaaatcattgctaaaagagcaatttcatcaaattatattagagacatttatggtaatctagaccaaaaattgaatactgttggttataaattattgttttttttttttggagacagagttttgctcttattccccaggctagagtgcaatggcgcaatctcagctcactgcaacctccacctcccgggttcaagcaattctcctgcctcagcctcctgagtagctgggattacaggcatgcgccaccacacctggctaattttgtatttttagtagagatgggtttctccacgttggtcaggctggtctcgaactcccgacctcaagtgatctgcccgcctcagcttcccaaagtgctgggattacaggcatgagcaactgcacccagccaattactgtatttttaaagtaatatctattttgttaattttgttatcttttacttgaaatggtttttacctgtttatagctttgtcttgcagttatgctcattatgggggttaattttcagtttataaatgtagcatgtttccttatgaacaaaaagcagattccttttctttactaacagtagctgcttaacagttactctgtgggtacaacttgataattatttttgtgtggatttggctgttatattaggttggtgcaaacagaatcgcagcttttgccattaaaggtaacggcaaaacatacttttaatggcaaaaactgtgattccgtttgcaccaacctaataacttagatactgcaaaatgtgtgtggagtggaagcacaataaattaatgaaagcacacttttatagctagagaattatttactcataagttaatgatgtggaaaaggttttattggtccgttgacttatagaaaatgagattaaatcttttatttctggtaccagacaatattttatttcagtatttatcacttgaaataggaaaaaatagcaataattggaagatacattataatacctttttgatttaatttctgaattctatgatctatcttccacgtttttccactgagtttttaactatattctagatgaaagaaaggggtattagtgtagctgccatcatctcatgcattttattctgagtttgagatctaatacttacatttgaagcttttactaagaatcttcctaagcctttgtttctccgtcaaactgatagaataagtactattatgaaaagcaactgaaataaggtatagaacagtgttgtaactacactgtgcaaatgctagttatttttcattctgtcattatgcatctattatgtgcaaggcatattattagatgtggataacagcgaaaaagacattgtctttgcacttacagaatttgtggcagaggagacagacatgaaacaagtaattaaagtgtgagaataggaaaggagtcattcccattcattttgcaaagtgtttccaaaatattttgtagctctagtgagaactcttgtctttttttctgttaaaaatataaattttttaaaaactagtttgttttcatatgtaaggttttacattccacgataacccttggaactgtgtggagggaaacttgatacttaactgccttttgtgaggcttaaacattttaaaaattcatagcaatgagaaattccgcaaaataagaaactattcatactgtttctttatttttgggggtaatggctgaagtagaaagtcaaagatcataaatttagggaatacctgatattcatggccaaatatcaataaaagtttcgattgattagtcagttggctatcgtgtgatgatttcagcaggctgatttacattacatagacaatgtaagaaaaatttgtctgctgctatgtaattaacctttgagtagccacattattagagtggagcggtggtagagataatgacaaaataatttacattagattttagaccagaataataatttcttttagcatctgttccatcttgccaaatatgttttactttgacaaagtgatgatttctcacatttgaatgggactttcacattttcaaaatgcttttatatcccttattttacttcatcttcagaatgacccaggaagataactaacatatcctgcaagtatactaactcacaaatagtagatagtacaaccagaaggactttggaggctgaatccaactaaaatctagtctaaaataatccacaaaatagtaagaggtatacatttttttttcatttaatattaagtctttttgtggctgaacatccccttgatatttattttggcttaagcagactggttttgtgtgtgtgtgtaacctctgtttttatattctgaggtctctgtgtatagaaacttaaggagtcttcccattatatttgtgtagcagccccttctctctgtctacctgtcttctgatctttcttaatagaaagatttcagaattaaaatcaggacttatgcagccatcttatctgaatagtaataaatcatgcctatctttatttttagaaatacagtattttctttatgagattaaaattcttgaatgcttggagtagtttgttgaatttactatatttatcataaatgaggccaggagcagtggctcactcctgtaattccagcactttgggaggctgaggcaggtagatcacttgaggctgggagttcaagaccagcgtggccaacatggtgaaaccccatctctactaaaataaataaatgtgtatatatatatgacttaggaaccactcagcttttgtctcttctaactaattcagttataaaacctttaccagcatgagcatcctatttccaacccacgcttgacctggtcttgaccactagcatatgcttatacttactagggctgtacagctcaactaatccacttcttaaaggtttggcccaccctcatgcctaaactgcactccagctatgtttgctttgcagtatttctctcagtcccaattcctagccagtaattgtgtctcatttgctgcttttaatctagtggtgataccatcttttaatgaaatcgactattagagtacagtaataatacaagttatatttaatttgtaacctgtcatccaaaagtcacttttgagcttcagaatcatcattaggaaaatgttactgtaaaacattttagatcaggacaatgtaaaaaattggactgaatttgtattgtgcagaccttgaatttgttggtttatttcttaaccatttctgccatttaaaaggtgtagtggaaaaaattggttatttgaattttggataaatataatttacagcatgcttgtatattataccttttagatacatgcaaatttatatataagaatgtgcagagtttttaaaacgaagagtaacaaattaaaaaataaaagaatgtgcaaaagtttttatttttaatttcttcttcttggccttttccattgtttccccaagttaatgccaattaaaattcagttagcacaaatatacgttgtagcaagaatcaagtactgtacctcttcagtccttgatgttcattaacctttcctagctactggcatcttcatgttacaactatatgttagtaaaccaggtagtctaattagatcaacagtctgaataccaccaaccgttaagtttgaaatgtagaaattgatgtcctgttcatcagtttcagacctgtctatttaaagagagaattgtgtgtgtgtgtgtgtgtgtgtgtgtgtgtgtgtgtgtgtgtatgttatgtatttatttatttattttatttttttgagacttgagtctcactctgtagcccaggctggaatgcagtggtgcaacctccacctcttgaattcaagcagttctcctgcctcagccttccaagtcgctgggattacaggcatgcgccaccagacccagctaattcttatatttttagtagagacagggtttcaccacgttggccaggctggtcttaaactcctgacctcaagttatctgcccgcctcagtctcccaaagttctgggattacaggcatgagccaccacacccagtctatatttaaatcacttattttatatcacttagctagccaacacataacactttcagtacttttgtcacatatagcattttgttacataatacggtttattatgaatgtatagagtgtttcagagagaagacatttgtgatttttagagttccgtaattgaggtgatactacataatatgccaatttacataactgagaaaattaacagtgtagctgtattggtgagattattgctataaatgatgaagttaggacctctgaccagattcatattatttaagctttttcatttcaccttctttgatattttttacctcctagacatagaattacgtggtcctctctaaaatatgtctgtctactcagtccatatcaggcaatgtgctgtgctctggggataccaaggaaaagatatgttctgccttcaagaaattcccagtctggtagaggtagcaagcaagtacaccaaaagttacaatccagtgtgataagtactatggaagagatctatatgtatacacacaaaagtatgtggctgtgggaacccagaaataggcacctaacttattttcctatgcattctttttttttttaactttttttttttttttatactttaagttttagcgtacatgtgcacaatgtgccggttagttacatatgtatacatgtgccatgctggtgtgctgtacccattaactcgtcatttagcattaggtatatctcctaatgctatccctcccccctccccccaccccacaacagtccccagagtgtgatgttccccttcctgtgtccatgtgttctcattgttcggttcccatctatgagtgagaacatgtggtgtttggtttttttgtccttgcgatagtttacggagaatgatgatttgcattttcatccttgtccctacaaaggacatgaacacatcattttttatggctgcatagtattccatggtgtatatgtgccacattttcttaatccagtctatcatcgttggacattttggttggttccaagtctttgctattgtgaatagtgctgcaataaacatacatgtgcatgtgtctttatagcagcatgatttatagtcctttgggtatatacccagtaatgggatggctgggtcaattggtatttctagttctagatccctgaggaatcgccacactgacttccacaatggttgaactagtttacagtcccaccaacagtgtaaaagtgttcctatttctccatatcctctccagcacctgttgtttcctgcctttttaatgattgccattctaattggtgtgagatggtatctcattgtggttttgatttgcatttctccgatggccagtgatgagcatttttttcatgtgtcttttggctgcataaatgtcttcttttgagaagtgtctgttcatatcctttgcccagttttggatggggttctttgtttttttcttgtaaatttgtttgagttcattgtagattctcgatattagccctttgtcagataagtaggttgcgaaaattttcttccattttgtaggttgcctgttcactctgatggtagtttcttttgctgtgcagaagctctttagtttaattagatcccatttgtcaattttggcttttgttgccattgcttttggtgttttagacatgaagtctttgcccatgcctatgtcctgaatggtaatgcctaggttttcttctagggtttttatggttttaggtctaaccttaaagtctttaatccatcttgagttaatttttgtataagtaaggaagggatccagtttcagctttctacatatggctagccagttttcccagcaccatttattaaatagggaatcctttccccattgcttgtttttctcaggtttgtcaacgatcagatagttgtacatatgcggcgttatttctgagggctctattctgttccattgatctatatctctgttttggtaccagtaccatgctgttttggttactgtagccttgtagtatagtttgaagtcaggtagcgtgatgcctccagctttgttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacgtcccttgtaagttggattcttatgtattttattctctttgaagcaattgtgaaatgctttcctatgcattctaaactgttctgagttgacacttaaataaaatatttagcaagacaaagaagaggggataaagacaacggtatgtatttagctagcaatttcaaacttacttttgtaagtcaagacaaatactggttatttcatatggttcaaactaatgtgaaggtagcaagggtatgagaggcttgaagcatcactagtgtttggtgttaaaggatagagtatgttggaagagcagtgagagttgaaaatcattatgttcaccatcaccagattgtaaaagattgtatattcttgagtaaaaataaatatccagcccatttcctgttacaggatttaatgagagaaacttgtagacatcagtctcaaaatcaagctgacaggatgggtaatatacattgggtaatatacattggattattcataacatggtttcatcaatagtgtcatttatactgaactataattagcagtattgacaccagttggagaaggtgtttcctaaatgacagcttatcttttcaagccaaactgttttaaattttaccttttgtactttgattactatctacccattcttgcctcaaatacaatattctaaatcatttaatcttttaattaacggtttagagttattatgagcatcaatttttgttctgtacttaaatacagtgatgtagttcattgttattggggtgtgaggaactgtttgacccaatagacttgcctttagattgcttaacttttattatttaatttttatgtttctgtcacttatcacttaaggaggcccaagtctgctaaattatttcatttattttttttgagacggagtctcactctgtcaccaaggctggagtacagtggcacaatctcacctcactgcagcctctgcttcctgggttcaagcagttctcctgcctcagcctccagagtagtgagtagctgggattagaagtaccctccaccacgcccaactaatttttgtattttttgtagagacagggtttcaccatgttggccaggctggtcttgaactcctgacctcaagtgatacaactgcctcggcctcccaaagtgctgggatcacaggcgtgagccaccgtgtcagcctgctaaattattttacattcagctttctgcttaagaaacaaggtagaaaatgtcatgcctgagcttttatgtacacctgtttgctatattttctaatttactttttggttcatggatgaaatctgaatggttatagttactgtgtgagtccaagtaagtagaagtatttgtaagctaagaattttttatattaccagtttattaaattcatattatttctaactcttgagtattggtaatgatcactgacttacgtgtttttaatattcggggtgactcaaaggaattagtcggacttgctcaatttggaactttttaccagattaatgtatcccaaacaatggctgaagtactcattctgaagattaggacaaatctccattgacttagcagatttaaatttagatgtgtacaaattgcctgggtcaaaggcagctaagccatttaaatgttatatctagtttcattggtttcagtgtccagcaagagtgccttgcagtgaattttaggtatccatgattctttggttattttggtttcccctgtggagcttttcttggtttctaggaaactggaaacttgcttatttgaatttctaggatgatttttttcatttttaggtgaatggaatcagtgaaaattcatcctgactcccttgatgtttctttttaaataatcagaagagcatgcaacatatataaaataaaaatactttcaacaggtcaccaataatatataagaagtcccagggaaatggaaacaattttgaaatatgctatccagctgtggcattatcttaaatttttattcaagttacagctttttaataaatgctaaaatataaaagctgccctgtgctgattagacatatttaatcagcatattttctttgtttttaatgttctgccagtgatgtccaattttatactttaatccttgcttgttttaaatagtaaaaaatatgtttagtctgtggtaaggtacataagttgtttcttctccagagtgaagtcaccctgctgagaaatgaagtggcacagctgaaacagcttcttctggctcataaagattgccctgtaaccgccatgcagaagaaatctggctatcatagtgagtaatgttccattacctatagccttaggctacgtcagtgaaataccgtcagagtgaactgagctgctactttaaaaatggagactgtgcttctaatattcaagattaaatatcagaatttctgtaaggttattatagaatgcagtagagaggtataattttttagaatctagagagtttgagttttcctgtttctagcttttttcctaagcattactatagatcaacaaaatggattagctaataatttaaaatatactgtaagtacttgatgatattttgttcatcttctcaggataacactttgtcttagattgacagggtgaaacactacttttttcccagcctccgttcattaatgatgatatttttctttttaaaatcagctgactgcctttaacaatatatgatatccctttaaggtatcagatcctattgttctttcttagataatgtcagcattgtgtaacgtttttattgttgtaaacctttatattgagatatctagttagtttataaaaatgttaaaacgggaacagtagttaaattatctgcttgtaaatttcctgctaaatgttttcccaaagaatgagattcttttgttttcagcattttaaaggttaattgtgccttttcctttttgtaatgtccttcttttttgataagatgcacagtgttggaaccagctgttactcttgaataaatggccaattttgtccatagtatacaaatttgtaacaaacaacagagttgggaatgcattaggcaacatttataatatataacccacagttttagtctttatgatttagtgatatttcaggatatttgtaaatgtgaagattgtttcaaccatatgtatccacttcattttaatttgccagtgtcagtaattcaaaagaaagaaacattttgtattggatgcaaacagttcctcaggtgctcacgataaaacttaatggccaccatctttacttgtagtcattgtaagcagtttcatcagaatgggcaatattttttaatttaaaagattccgtagatttagctactctcaattgccatatatatttagaacgctgatttttgtcagttttgagcatataaatcttgcttatttgatatctagtaattttgacaggatggtgaaacacattggagtaaattggaaccatatagaaatatgtttgggatttatattaacaatgattgcttcagggatgaggccattatggttcccatctgacttaacaacataatttcctatagaagctactagttcagcatttatgcatacgtgattttcttaacaagaaatctctcttggattttcatagtttaaaaggaaataaattgttttataaaattaaaaggaaattaactgttctcttaaattgtatccaattcagaattacctgtaatttttaaatctttgataatttattagataatcccaacagttttgactctattatccaggcaatgtatgctcagcagatgcaaaccagttattcatttgacaattgatttacaagatatcttaagtgtatagatgcgtaggtttatatactgtatacttaaatgactgaaaatctagattaatacatttttagtacatagagtactaagttatgagaatataagaaatgaataggatatttttgttgtttggaaataatcctatctttattcctgtctagtcatgtagataatcaaattaactgaaatatagttctaccataaaattaattctcttcagatcttgggagataattggattttgtagaaattttcaggtaatttatattttcaagtttgaaatctttgaaataagtctgacttctctgttgtgtagtagtaaaaatagatacagaaattgactaagtgaatacctttgaaaaatttacactcttcattatgttgtagcacacagctcttgctaacagtggtgagttgtaatactagctaaatctttaaaaacatttgggaatcaaaactaagatttagtagaaattaaggaatgttacaaaatctttcaagtaaaggtggaagtactaagtcacagccatagggtctgtcccgcccagttttagcactgaaagtcctacttcctaagaagacccctcagtcgtgggaaaaccatgacagttagtcaccccaacagttaagtaatataaaacctgaatgaaaataataagagtacattttaaatatttgggttccatgaaaaataaagcacaaaagtgatcttattgccatgaattcacattctttagatctgggcataattaaagttgtattataattgtctctataattataaatgggaagaaaagcttcttggggactaatcaaccacaaatacttttattactgaaaatatgtataggccaggcactgtggctcatcccttgtaagcccaacactttgggaggccaaggcgggaagattgtttgaacccatgagttcaagaccagtctgggtgaaatagcgggaccccatctctacaaaaaataaagtttaaaaaagccaggcattttggcacacacctatagtcccagctacttgggaggctgaggcaagaggatcacttgagcccaagagttcaaggctgcagtgagctgtgatcgtgccatagcactccagcctgggcgacagggagaccctatctcaaataaggaaaagaaacttgtggacataggtagagaactttcaagattactgaattgccaaacagctggtttcttttagcttaggtagagctggaagtggctctttgagtacagcatggttttctgtatctctctagtgcttgtgattacaccagtcattttctcccctcacctagaactggacataggtgcaaatatatcacattgtaaaggtatttgatgtgtatgtaaggtttataattacataattgtgagtacctgattctttgtactgcttaaagatttgctttacctaattctgaaagtctgtaggtaagcattcatcccttataatttactgtttcattttaagttgttgactccagtatgtatttacgtttccttataccactcatcacagatcagcctctttatttttaaaagctggtgtgtcccttgaactcaacattcagggaaacgtcagcctgttgttcttttaaagaatagtggtgaagttagaatggtgatcattaaaaagtcaggaaacaacaggtgctgaagaggatgtggagaaataggaacacttttacactgttggtgggactgtaaactagttcaaccattgtggaagtcagtgtggcgattcctcagggatcttgaactagaaatacgatttgacccagccatcccattactgggtatatacccaaaggattataaatcatgctgctataaaggcacatgcaaatgtatgtttattgcagcactattcacaatagcaaacacttggaaccaacccaaatgtccaacaatgatagactggattaagaaaatgtggcacatatacatcatggaatactatgcagccataaaaaatgatgagttcatgtcctttgtagggacatggatgaagctggaaaccatcattctcagcaaactattgcaaggacaaaaaaccaaacactgcatgttctcactcataggtaggaattgaacaataagaacacatggacataggaaggggaacatcacacaccggggcctgttgtggggtggggggaggggggagggatagcattgggagatatacctaatgttggatgacgagttaatgggtgcagcacaccaacatggcatatgtatacgtatgtaactaacctgcacgttgtgcacatgtaccctaaaacttaaagtataatttttaaaaagtgataaaaataaaaaaattttaaaaatcacatataaatacttaaaaaaaaaaaagaatagtggtgaaacaaaacaaatagagctttttagtattccctccagttaaactgtcattgccagtattttgttttctttatacatgtaatgattatgtaatgattatattggctattttaataactgaattataaatattttataacattcattactgcttgatcagaaaagtaggggggtgaaggagaggggcactagttgagaaacgacctgttgggtgctatgttcactattttggtgataggttcaatagaagcccaaaccccaggattgcacaatatacccatgtaacatacctgcatatgtaccatctgaatctataattttttttaagtattcattctgttttatataatttttaaaggattactacttctggtggttggtggtggtggtggtgttgttttattgtaccttgtggtcaagtatctaggggtatggttttgatttatagcatgttatagagaagatggggttccatctcattaatgtattttaaaacctgcttttcaaaaatgcatggatttgaggcagatgttgaaaaattctgtaaaaactatatttcagaaaatgcacaaaattaataattttattttagctaaagttgacactaccaggtatccccctctccatcttctacattgcaaatcataggctaagtcctgcttcataagatgtccacaatttttttcactaattgactttcagaatgggcatctggccattagtaagcaggccaatacacattcttagatttgattttagaagcctatttactgtcactcctaaacactgaataaaaaaagttttaatgccaagtgaaaaaagcaaggtgcaaaagaatacatccagtgtgatactgtttttaaaatgtttcaaaataaacaaagctgaactatattgtttagggatacatgcctatgtggtaaaactgcagagaaaaaacgagaatggttaaagaaatgtcagagtggtgattacctttggtgaggacaggaacctccaggaagcagaagtgttaatggcaatgttctctcttaagttggcggctcggttcccaggtgttcatgttatcattgttcctcataacttacatatactataaatatttgtgtgttatctatatcaaatttttactaaatgaaattactggattctgttctattaaaataaggatgtaagagacttgttcaggtctaaatatttgcagatttattttcgtaaatatttagaatgccctttccttaatatcttttcagatgcaatgtttagagttttatatggatttttacttgaatcccaatttattcatgcaactataacagctggtggcatttagattctaaatactgcttgttctcctatgtatgcatcattagaatcaggtgttataatcatccatggctgcaatagatggaaaatcagtcagaataaatacagttctggagaatgcagagggaataatttgaagatataatttgtatgtaagaattcattttgtttatgcatgtggttatacatttttatcttgtaataagaatgacatgtaggccaaccagactgagtttgttaaatgtgatacttaatgtttgattgtatctgtaagagactatcttccaaactctccctcattttctttctttaacactatttagcaaatatttcttcagctctattccataaggcagtgggcacccagatgtttccatatgcatggttgtgccttcttttgacctattgcaggtaaaattgcctacttcatgacctatatcaattgctgtaataccaacttgtctaatcagttttgtaagatactttctaactttttactctgtgtattgcctcagcatactggtgcattcttaccgattttaggaaaatgaataatttttcttttttccacccagctgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatg

SEQ ID NO: 17153 - DNA, 76401 bp, Human
aggtaagaactaaggacatctgaataaactgtggactttagttaataattatgtatcactattggtttattaattggtacttatgtatcatactaaatttaagaagttaataataggggagactgggcgtaggatttatgggaactctgtactgtcttctcagtttttctgtaaatctgtaactgttctgaaatataaagtatattaaaatttttaaatgcctaaccagaaaaaaaaaatcatggacagaaagccaggttagggattttcatggaaaattataaagcattttattaaggcctttaaaaattccacacagaacacggcttaagcagaacatatgcagctgcttagttgaaaaatggaactggcagcttaacccagaatgtgagacttctaaatacattcaaattgagtcatcatcatttttcatctatgtagtattttgtttttccaaagttcttacaatttctgactccaagatggcaaaattgtaccattattcctatgttaaagttaatgccatgtctactatagcttggacagccattttgactcaactgtctaatctaaatgtcatttcaatcagaaaaccagccatcaactgtcaaaatggtaaaaacagttatgtgtgttttcaaagccagaagtgcaatcatgtggtgagacttcagggttttactgttgtccacagttctgagtcccaggactggtttccttactcggtattctcccatggaaaacttcatcggggaattatagggtaatattttcaagacttggaatatgtctacagttacctttctaaaaaacaaacaaaaaaatccatttaaaagcatttttttaaaaataatcatgccagggtagccaaatagaagcaactttggggtttttgcagagtcaagtcttataaattgtggaatattccccttggtccaggagatcatttgactcccacacaccaccacttcctatatccacaaattccagtatgtttggaccctcctgatggctgagagaatcccaaaaaaaaaaaaaaaaaaaaaaaaacaaacagaaggcaccagtgagtagaacaagaaagctagatatggtgcccttgggcttgttgcttagtccctgctccagctctcctccagcctctctagctgtacagggcagagagggtcacagccggcactcttctggtgctcttgtcaggccaccatcagagcccccatggccaggactcacacgctgccaggaacccagcaccatcctggaggaagatgatgcccagccctttcaagggaaaccaaaatgctggcatattttggaggtcagcaggagggaaatgtctcccagttatttagccctggaaggctgagaatacagtggttttgttttccgaaccaacaattggggcacactgtctgacagcatgaccacatgtgaacttgagagagtcccaggaaattcagggtgtgtagccatggttgctgcaggatccagaaatatgaaccaaggcctgagtgtgttcccttgatgttggtgccctccagagaggagtgtggggacatcctgggtgcagcactgtcgagggcccttcctcagctgccctgagggtggcagtcccaggggctgtcctaatgacagcagagcacccaagccccaggctcctctgtgagcgctctgccccttctcagctgctgaactccagtctcaagataggtgaccctggggctcaagactgtctctcccttcccccttcaggttcctttggagtcaggagtgcctggagtccaggcatgacttccccctggcttatctcctctttacctgtgtcctgggaacacctgaaagaagctgggggagacaatcatttctgcagacacagggttacccccatgtgaagcaagcagcaaattgatcttatcacatgcctctgaccggttagggaggcgagtcaaagaaggtgcagtgaggaagtataatgtcacatgcaacatttacaggaaactggctagaagacagcaggggaactcgagaagttggttgttttcagcagattaaaacaatacaggttagtgctttttgccccctggaaaacttttcgtagccactctaaaatacctaattctctttccttgaactgtctttaacgatttctttaatgtgaagaacttgctttttggctttgaatgtaagagccagcgcacagctgttaactgcacgttgttagaggaacaaacgctgagccattatggtgaaaatgaaattctcagaatctcttgcttccctgtttagaacttctctgcttctgaaagaacaaaacttcggatgttctttaaataacttatttcgtggaattcagctaggcctcttgtcatttttacctgttaatgtaaatgtgaaacgggacagatcagcctgtgtttgcagacatctgtggggcattcaaagggtgttagaaaatacagaaatactgtgcataaaaacgtgcttgcgaggttatatgcaaaagtttgttgttttgtggggttttcatctcataaaactcatcttttggcttgtatttcatgttaaaatagtatgtcattataaattcttaagtttcctttttttattttttctactgtcctccttcccccttttctttccttccttcttttactaacacaaaacaggagtagagaagcagcagtagggacagcttgaatatgagacgaggaaatccttttcccggcaccagagtttaaggagcaggcacagcccagagcaaagcccagcaggccgtgaagaggccgtgaggtgtgacggttgccagagctttatgtcttcagccttgtgcttcctagagaagagtctgcaaaagagccagaaagacggctagagggttgggaagcagccgtccagaaacatagaaagggcccaagattattcttcctgaggccaatgagggacagtttaattacgcagtggcctgctgctttcagacctgtatgtggaaaaagaaaacgtctcaaatccaagttaagagaaggaagttcctacattattggactgctgtgcagctctaggacaggttagccagagaggctgctgaactctttctgggtgtttttgggaaacatactagacggcatctttgactgtgttattgtgttaactgagacagggaggataaggaggagaggagagcaagatcaggaacttcctgtttcatgtcttcattctagcccaaagtgttgtaaaatgtgtctgtatgataaacaacgaaggggtgaggggctcgtggactcaacttgtttatatcctagtaatgccaaataactagaacagtgatgaaagagaaaaatcatggttgattctgtcctccaattgccacatttttttcatattttaccaccaagttgtacaagaaaatggagacaaagctgacagagaataagagaagattctaagctggacatatcagccctagtggtttcagaaaccccgtgctagctctgacagagccagcccacattgttatcaggtttggagggatggagggaagattggatttatcactggttggagccctttgcacaaatgcctgtaggagacacgcacttgggaactgcagtaggaaggcctcttgtacctggtactgcccttgagccccaggaagaggcttacaacttagcagtggctggacatccctcgaaggagctcttctttcagttttgttttgctttgttagttggctatacagccttgctgtttcagaagttttatattctgcaaatctgctgctcacagtagaaagggactttttatctttttattttgttagaatactttccagatgggcctgatgtctttttttttttttttttttttttttttgagatggagttttgctcttgtcgcctaggttgaagtgcagtggcaccgtctcggctcactgcaacccctgccttctgagttcaagcaattctcctgcctcagcctcccaagcagctgggattacaggcatgcatcaccacacgtggctaatattgtatttttagtagatacggggtttcaccgtgttggtcaggctggtcttgaactcctgacctcaggtgatccgcccgcctcagcctcccaaagtgctgggattacaggtgtgagccactgcacccagctgcctgatgtcatttttgtaaatgcatccttccaaaagctgtttgtatttcttctgggggtccttattctctcctatttctcagccccttccccatctttccactttcactgcgctgtgttccattgtgtttgagatgcaaaaaatggcttataaagtgtcatcattatacaaaacctctgatccccaggttctgaaagaacgagtggagacacagaatggcagaaggtaacagatcctgttgggtggtagagagcacctggagtattaatcttgtgtgtaatttttagataggaatgactgccaagttgaatactgagttaagtttaaaggtcaaagtggaaagagatgaagtcacctttaatctggagaaaaaatggtaaattttgtggggaggaacagtatggacacattcctgaactctctaaatagaagaggaatgaggctaacttcacaaatctctcttcttcctcaacataggcaggcctctcctccctgaatcccagataataccagagtggcactgcgggtcgacatccacagatgtctgagtgaccctggtttcagagggataaaatggtgatatataccaaacattcatgctagtggggaaaagaaagttaaactctgataagtgcaacttttacaactgaactcatccttggtatcgttttgagttggcatgaacaaatctggaggcccaggtctctggatttctcagaaagaagttcccggacatttgtaaggtattattgttatcaccatcatattgggaaatactaagaactataggttttgggggagttttaattgtgataaaggacacataacaaaatttaccatcttaaccattaagatacagttcagtagcgttaagtatattcatattgtgcaaccaatctccagaactctttattttgcaaaactgaaacttaaacccattaaacaacaactccccattccctttcccccagctcttggcagccaccattctactttctgtctttatgaatttgacttttctaggtacctcatataagtagaattatataatatttgtcgttctgtttctgctttatttcacttagcgtaatgtccttaaggtccgtccatgttgttagcacgtgtcaaacattccttcctttttaaggccaaacatatttgtatgtatatatcacattttctttatcccttcattcatcagtggacatttgggctgcttctactttttcgctgttgtgactaatgctgctatgaacgtgggtttgcacatatctttgagatcctggattcagttcctttggtatgtccccagaagtggaattgctgaatcataggtaattctatgtttggcttctgagaattatccagcaattgtgtcttcttataccactcttcctcccaaaacacaaacttgaagatacctcatattataagatcattatcatttttcttcaggaatgcctcaaacaaaatgttcatgtcttgcttctgagcagtaaggatgcagaggggacttgggctgttgtcccaggaaaaggagcaagaccaatggggctattctggaggggtgaccatggtaggtgtttggattacagattctgtgcaaggaagtggtaggaaagatgtgatagacggcctgacacagtgctgtgtggtgattcttttgctggagatgttgtctcctaactaaaatatcatgaatactaatgtatactctgtaactctaccagggaagggattgcctatgtgcctgattgattttttactctgccatttcaatttccctctatttcgtcatcagtcagaaggttggtgctgtttaaaggggaaaaaaaagctctaagtgtccccttctcccaaaaaaaggaaccagaaaatgacaagaagagttgcatttgtctatgaaagtgcatagaaagcttttcctggaaaagaataaactgggaaaagatgagtccttgaagtagaaccctgtcatagtgcaacaaactgaatttaagaggcatctgttcccagcttatacaacatccagtaccagttccacagtaggtattcacattaccactcagattgttatttctcaatgctaatgagaagctactgctttgagactgtctaactagctagacacttaccagactttgttttgatattttctggtatgaattaggcttcctttctagttgcgttcatgcccagattttaatatgacatattttaagttaactcattgtattgttttgtaacctagagtggcttaaaaacagagtcatttgttatagtaggatatgtgttcgcacacacaaatatacgtgtgtgtatgtgtgtgtgtataatgggaggaattctctagagcatatgtttcctaaattagaagtcactaagtgatatcttggagcctacaattatttggaatactgctatcttcagactaggaagttatgcatgtattatacatagagattcatttggggggtttgctagtaaactgtaattctttcagtaagtcactgctttactgaatggtgaagatttggaatgtcttctttgatttccaggccaacaatggatagatttggtcgtccttgaagcatttagagacctgtagaatgaacttaacttctgaaaactgggtgcggggccaatagaggggctgctcaatacctcaccagcctgctacgcggaaggctagatggagggctgctaaaggaagagaactgctgttccacctccgcctcctccctgcagtgtggcttcttaggcaagtcccagtttagaagtcatctaactaagtgaacattcttgaactgccaccagacctctcctaaaacttttttctaagcaaacaatatatgctttcagactttctcttcttccctcttcttttccccttctctccactccctactttcgcctctgccatttcatgcccatcaccttgtgaaagctcagggcagaatttacctacatggacagcatgcttccttccctggccctgtctctgagctttttattcctcttccccagagcatttaatagccttccctgcaaaacagaggaaagtcaaggctgatgagcatagttatcagaataaaactgtttaagaggttttatgtaagaaaaataatttggaaaataacaatgttttttataagatcctgatgaatcaggaaggataaatagtttacttttttttgatagagagagactcactatgttgccgaactccatctggagtgcagttgctattcacaggtacagtcatggcacactgcagtctcgaacccctaggctcaagcaattctcctgcctcagcctctctatgttttaaagacttcctttaagggtccataaggaggtagctgtaagggaaggggaactaaaaaggccagaggataattttctctaaaaggcaaaaatgttaggttattcaaaaactatttttttcctctacttcagtgccaggaacatctggcctcaggaaaagtttaggaaagatgctgttgtcatcatttaaatcttaaagaggtaggaaaaaaataatcttggattttttacaactagaagggaccttagagagttatatccttttatttttagatttggaaactaaggcccagagagattaggtgatttgtctatggtcaaagtagctcattaatgatggtagagggtgcagaacaaggcccctggctacacactggtgacataagggggaaatgttgaagggccccaaggacttgggaatctgaaagtaggtgcacctctgggatctacagaggccagatctgtgcctaatgggagtagagtaacagattgaagatttgaggaacttccagaactccagcaaagtgagctctacgtaattcctggaagacagcacagccatatggttggaattttgtgggtagaaagctaatccatcctacctggagaaaggttgtgggcaatgaactggtcctcatggagcagagaggaaaaatttccaatggttgcccagtattggcctggaaaataggtcctgaatcttgtggacatgagtgtggattggtaagtatggatgaagatcttttgtgaagtgtctgttgtgatgcattatcagggctcaccacggcatggattaagcagtcctcagaagggttagccatccttagcactgattccaacacccctgaaccacattctgaatgctaagtcaacttcctgggtaccattagctcagaaaggtatattctggacaatggacatggtcactggaaagaaatggcatttttttgtagattccggggtgcccagcagcctcttgtgaatttttactcagacattctgagtctgatccctctggctcccagataaaagggagatgtggggacctctatgataacgctctgtgcttgatgtagtgttctacccctccccaagaatgccactcttaggggtcttttcagggtaaacagcagcctctcctaagtgtcaggcttactttgttgttgctcctcttcaaaatgccacaaacattattaaaattaaaaaatgagatgtaatacatgggtcctgctattagaaatcacaaggcctggccaggtgtgatgtctcatgcatgtaatcccaggactctaggaggccgagatggccttgaggattgcttgagccaggagttcgagaccagcctgggcaacgtaggaagaccccatctctacaaaaaattaaaaattagccaggtttggtggcattcacctgtggttccagctaatcaggaggctgaggcagggggatcacttgagcccagcaggtcaaggtcaaggctgcagtgagccatgatcacaccactgcactccagcctgggtaacagaggaagactgtctcaaaaaaaaaaaagaaagagaaagaaagagagaaggagggagggaaggaaggaaggaagggaggaaggaagggagggaaaaagagagaaagaaagagaaaggaagaaagaaaggaaagaaagagaaaggaaagaaagaaggaaagaagaaaagaaaaagaaaagaaaatcataagacctttttttggacactggatgttttcaaagttttttctctttgtttttcttgtttggcattttcccttaattcagatttatttattaagtatcttccatgtggatcttatattcaagttaaaagatgtggacaaaaaacaataaatctaaaaaatactaggtgatgtatattaggaatttagaagggatacatgctgtggagaaagaagtctagcggggctaggaggagcagagcacagtggtggaggatgggtgtaggtgagctggtaagggcagctgtcatggagaaaatggtgagataattcaccatgtagccacatggggaaagcctgaggacgcagaagcggaacatgcctggagtattcaaggagtaacatggagccagtaatttggaggtgagatcctggagggccatgttggtcatggtaggactctggctttccccccagagtctgggagtgaggggaggattttgatccaaaaagagacaatgatctgactttaaatttaacagctccctttggccactgtattgagaatagactgtgggagcacaagagtggaagagaaggaccagttaggaggctattgaaatactccagtgagacatgctggtgccatggacaagggttagcagtaaagatgttgaggagtaattagagtctggttattttgaaggtagaaccagcaagattggcagttggattgaaaaataataagcaaaagagaggagttaaggaaaataggaagtggcctaagtgtagtaagaatagaaatgccatcagactgagatggggcgggctgtgagtacagcaatttggggtggaggggagatactaagacttttgtttgggatatagtgagtttgaaatgtctatgagacagacagccaagtggagatgtcaagtgggcagttggatatgtgtgtctgaatataggagttagaatcctagaaaaaagtcatctttcttaatggtcttggtttaatatcactcctaaattcatctgtagcttctaaaacttccattaaaaacatggaatgtgactctgcatagtgatgtgttcactggtttgatttctgggactgaaatcagagagagaatgttcttttgggtaaacagaagtgaagaatcaggattcttgtttcgaactttgcttcttattgcttaaaacttaatgattccataattcttattttaagaaaaagaagtttttttaaacaaaatgagcaaaagcaataccttaacaaatcaagctttcctctgcttttatgtcaaggtagttgagagtattgtgagacggttataatttttatgtttatgtaaatgtcatcttaaatataattgaaattgctttttgtcattgaaacagatattatgtagttttacaaattttaatgaattaaactatgccgtcttcctgtagaaaaggagataccgctggccctccatattcacaagctctgcatctgtgggttcagccaactatggatcgaaatatgcaacttcaaattatcttcattcaggaaggagaaccctgagttcttctgggttggatctaagcatgtaagactattgagttacatttgacttctgaagtcactttttgtctttactttttagtcagcttgtgaaagcaaaaagcatcttatttttaaaatacctatgttagtaccctggaataacactggcatttcctagcccaaactgagactaaaagttttgaattaatctttccctcaacttacaagaaaacagttatcaaatttgtctttaaattatctcattggaccctccaccagcctatgaggcaggcactcccatgagccccattgacagaggtggaaattgcctcagagaggtgaagtgaagtggtgatgcattccacagagctggaattcagacccaggtctatgtgcatccagagccccccagcctgctttccagaagcatggagtaaagtaaaacaaacccgggcatttcagtgaaataatgcagaccaagaggtcatgcagaatgatctcctttgtgataagcctaaaacctgagacctcattcagaaagctgaggaagttgctaaaccaatcctcgaagtgaggggattcatgagccaagtcttttcttaggcctgtatcctgtacagtggtgaggctactcgggtggtatgacacctgtggactgagaacatgccctccatcaaacccacaaggaaacttccactcaaccctcagttgcacagaagcccattgatgccagccggcagcagctgtccctggctgctcccagaaagtgcctggtaactgggagactgccagccagccgccccaaggagacctgagtgaggggttctgcaagccttggaagtggtccaggaccttaaggctctggcctgagctcagggctcagaaaaatggacagggctctgtccccatagtgccagttgtcagaacgctgtagggcgatggggtcagcttccacaccagtagccttccatgggggcccttgggagcagcagccccaacccccctccacagtgaatattcaatcttgtgtgcactggtgcagacatcctgggtattaaaataatgagatgcctaaaaaccagttggcgaattgtcatcaccctcagccccctgagcacacccccagaacccctaagacttctcccataattcaacaactaaaggatgaatgccagcacagcacagggtgcccctggaccctgctccagcatcttatgttgtcctaattggttagtgcctgtgcctcattggttgttaaatattttgaatatcacccaatttccacccaagtgagatgaaacatggaaggcatttctctgaacaggtgatgacaaatttggattggcgtctaggaggggaaaattgaaacctataattgtgtccctagttcactggttctctgataggggcctgtcgatagcatcccaggctgtttttcactagcgagaagaaaaatacctgcagtggttatgactggaaaggtaataagcagaggtcagcccagcccctagaaacacaactttgattaatgttttcagagggccccaagtttaagaagatttgaattttgcgggaagacttctcctccactcactttctgctctagtcctacctgtcattagaaatgtggttattacatctaaccatggcttgtttgctcccatagttcagttggtgaccacctgcccagaggagatgaaaggttcattattagttgagctccactaattctgatttattagtgccaaacacttgccttttgcagctgtgagggaagttttcaaagttgatctatttctgagctgcactagcagtaccacatgttttttttttctttttttaagaatctttcacaaacacagtaaatgcccacagatggtggattccaggggtatgtgaggaatccctgtgcccatccacaaagcaccagactgatttttcagatggtgcaagatagactgcatcctttaacacaggggttttttctgtgttaatatttaacacatttcattcaccaaaagtgaattattaaatccagtgcatattcaggaggagggacttatgccaaggcatgaatttcagcaggtggagatcactggggaccatcttataagctgcctgccacaaaatgaaataaaatatctatgagctctattggtgatggtgtcacagtgctgttaatgctactgcagtttgttggctacattcataatcaaagaaatgcaaaatttcagctagaggttagtgaaaaagaggtactatttttcccatctagttcatagactgagatttgggtataaaaagacggtggcttctttcttaggagctttctctcactctcttgctcactctcagggaagccagctaccgtgttaagagctgccttatagagagatgcatgtgcagagaactgagggagacctgtaaccaacagccagtcaggaaatgaatcctgccaacaacatgtgagtgaacttggaagcagtttctcccccaaactttcagatgggaacacagccccagctgacaccttgagtgcagtcttgtgatagactttgagccagaggtacccagccaagctgtgcccaaatctctgacccacagaaactgtgataaagtaaatgtttattggtttcagctacttagttctgggctaatttattacacaacaatagactaactaatacacactacaatttcagatatcttttaatattgtttatatgtattaccatttgaaattatagtaattattagactagccactagatcttgttatttaatacactaagaagcacttatgttaatatataacacatttgttttaaaccattttggtactacgcatccccatcattgaaatttaccaactcttatttcttaaagtctttgggctttaagataattcataattgaaaatcattttgttaacaacaacaaatagaacacctcttaggagggcattatggtaggtgttgtagttgcctctgccttgtgatgtttataggtaaaagctcaaatcccagacttggcagctctgtaacctctggaaaatcaaaacaaagactgtgtacccacaaaaattaaaaacaaaaataaaaattgttaagaatttccttatagttaatacaggttgccatataaaatttctgaccgcggggcagacacaagtgctaatcagccagaataaatgcaagcctgaaagacaaccagtgggtagcagtgaccatcagcctgctcataggagagtggggattcggtgagttaggataggcgcaccccacggagcactggcggcatagagaggggatcctatagtgttactttcctttcccttccccaagaacagtgttttcaaagtttgataatcataccacaggtggtttgtgaggtgattttaggagacatggataaacgttctttatttaaatatgtatttgttttaatgtgtagtagaaaaaatgtacaacaacatatgaaattcatgatttcatggatatagttacttaggatgacactaaatatgtctttagatttttttaggttagttgagttaaataaaaatattaaacaaatcatatagttttggtggtatgcaggcatgacaaaattatgaagttagtttgcaaatatttgaagtttaggaacaacagccttaggaaatttatcaggagaccagatatatatccacattaagagataacaaattcatggctctaaattcagtcaggttgctgtcagggtatttaataacctaaaaggcaacatttagaggaaatgattttctatgcttcatgtctcctaaacttccaacagcatgtaacactgcccctttgcactccctctgagaagggagggtggggtgggcagtgatttggagggcccagcgggcttcctcattgttctctcatcagtaaaattaaattccatttaatttaattccacaaatttcaagggttaaaaaagttcatgttggtgcctaatcaccctggtaggctactgtgtagtcctgcacagtccaaagcaggggccatttgaaatgtggctagtccaaattgagatggcctgggtcatgagtggaaaattcacattggattttaaatacttagtatgaaaggacaatataaaatatctcgttagtaatttttatattaatgttgaaatgatattgtaaatacattaggttaaataaaatatattcttaaaattaatgtcacctgttttccacatcacttttttaatgtggctattagaaaattgcaaaatatgcatggggcttgcattgtatttttagtggacagtgctgttctacctatatacagacaagaggaagtatccaagtgtgtgggcgatgggggtggaggggagggggagattggtaggagagttgtagctgtatactaattattcagatctatgactctgcttatacctctcctgatctccagagttgtattttcattcgctttctggatatttcattcactttctgatacctcactcgatctcaagctcaatgtgtacaaatccctttcatccaaaacctggccttcctccttcattgcctgtctcattaatgacacccacacatctaattagtctctatgtcttattatttctttctaatatatattactcaaactcatctcctctttcatatttattctgcctctctctaatttaagcctgcaacctggttgtctgtaccaacacagataaagctcctgccttcagagtctccagtccttccccgtactgccattagaatgagcttggtaatgcgccactttgaccatggcatcgctgcttaaacagcttacatgagtcctaacacctccaggcgaagtccaaactcctgaacactgcctgatcccagaccacctttccagcctcatctcccaccagcactaattttcccaggctgctgtgtttagccacatgtgacagcagccttctccagtgggccctgcccctccactccttattcttcttattttatcttaatccacttcttcccctgctttcaagcacaggcacagctcacgtgcctctgtgaagccttccatgttcattgctccggcacccccacggcatcatgtgcaccccgttactgcccagtcacactcactgtgatgatttgctcacatgtccctaaaatgaatccctcttttcttaccttggtactctgcccccttttactacagcacctagcacagggtctggccatagtatagacctagtaaatgttggctggatgagaggataatgggtatgtgctgaatattttaatggtcctaggaaaaaaattatttgtagattttagcagagatcttgaaaataaagtagtaactaggtgtgaatttttacttttgtctataaaataactttttctaacttggtactatgaagataaaatagagtttagaacaactgtagtttctttttcaaatatattcttgtgcagtttttttccttatactttcaccccggtaacaatggcttgttgcttccattaggttaatgaaggaatctgttctaaagaaatgaatcacagggcaagacacctagattctagttgcaagtcaagtatattacccaggtcatttaacttctctgagttttggttaccttagatattcactgaagctgtttactcagtgatctctgatttccatttctgaaattctaaagcattttaaggcgtcagtggtctcaacattggagactgtaggttataggcttttgctcttaataaacacgcaaatggccctttgacattttattaaggagcatagagtttaaatgtatgcattattctgacccattcaagaaatcaaattaagataaaggttttctaaacctgcagcattcattgttgtcaagggtatggtgaatggagatttctttttttttttttttcttgagacagagtcttgccctgtggcccaggctggagtgcagtggcgcagtcatggcttcttgcaacgtcgacgtcctgggctcaagtggtcctcctgcctcagcttcccaagtaactgggactacaggcagacaccactacacctggctaattttttaatttattgtagagacagggtcttactgtactgtcaggctggtctcaaactcctgagctcaagtgatcctcccaccttggcctcccaaagtgctgggattacaggtgtgagccaccatgcccagaccctggagcttttatgtagccaaagggggtctaggccttccccgaaggccatctgcactgtgtatcaagtgaacttaaattgttcaaactctttgatccaatacttctgtttctataatttattctatagcataatcctacctgtgcacaaggatttgtgtataaagatattgacattagcacaattataaaagcaaagtaagagatagctagatgactatttttgagaaagggtctcactgtgacacacaggctggcgtgcaatggtacaatcactgcaacgtcgtcctcctggactcaagtgatcacttaatgttaagtgttaaataaataagtgattaagtaaatgttaaataaatgaatataatgcagtcattaaaagtcatgctttcaaagaatatttagtggcatgaaaggataacaaaaactggattcaaaactacattcatgctttggaggctgaggtgggaggattgcttgagcccaagagtttgagaccagcctgggcaacatagtgtgaccccgtatctaaaaaaaagaaacagctgggcatggtggcatgcgtctgtggtcccagctactcaggaggctgaggtaggaggatcacttgagtccaggaggttgaggttgcagtgattccaccactgtctgccagcctgtgtgtcacagtgagaccctttctcaaaaactctgtgtgcgtgtgtgtgtgtgtatgtgtcagttaataagattcataatgagtggagccaaggaaaatgctaattgtgagacaatagaagagtaaaagaccctctgtagggcctctttaataggaggggctttattgtaaagatgggcaataaaggagacaggagactcaggactagccccacagggaggcacagactgagcagaggcatgaagccagaccacttgagcttaaattatgtctctgccacttataagctctgtggccttggtcaaataacttaacttgtctgttcatcagcatcagcagcacccagatgtatcttacagggttgtgagaattgaatgagttgataatacttataaaagcacctagaacactccttagcacataatcagagctcagtacatgctcattgttactgttgttattactgttagtattaatattattagaattattgggactaggatgtggttcaggtacctgaaaagccacagtgcaccctcagttccaggagatggcagatctcccctcctctcttaagtccactgattgactggctcagctgtccatttttgcctgctcttgtttccctagtgctaactgcctgcccctccttgatcctcagttcatacttctgagacaaggaaggacatgagttgcctcgtgcattaccttttccttgtctgtgccgagcttttcaggacagaccagctcacagcctgctctccagcctgaggcctggctggcctggtccagttgaccatggttggggtgagcccagctctagttgatctcagaaggggaatgtgggcacaaaggaaggtcttttaattatgggattttcaattattctggaaagaggacttgaagagtataaaagaaaggttaaaataaccctgctgaagtggcaagatgacctttgtcatttcccacctagcataccaattcgattccttttcaaagccttattagttaccgttaaaatccacaaaggaaattgtgtgactaagaactgtggaaatgaaaggaaacctcaaaggcctttattgaacctctgcctttccagaccacaccctttccacctctgcatcaggtcacattgcagtttgtctactttctgatatctttattcacttctttccattcatggactggccaagaaaatacaatacgatatttaaactacacagagagatgctgagggcctcctaataatttactatggctgggtgagacctttgggaaatgctaatggagaacatcaccaccacagggtgcgcgttccaaccaaccgcacttccttcttgctctgatgctgccatggactcaacttttcaccactccctgtgtccacaaggtgatcagaacaatgacatttcactccctggaagtcaatccattgctacttgaagaccacaccagcacttgagtcatgactgatagaaattaccatttgctccgatgcctatagctcagtattaagcagacagcaggtagatgaacatgtacgaggggtctgtgctcacaggctttgtaacatcatcattctttctgggctgtctctcttttccagatgcctatgatttggtatttctcctggccagagagtagcactggaaacattgaacacaaagtattctaacccttattgctcaatgtgtttttccagagcagcccaaaaggttatgctgggtttcatgagctgcagaggatgactgactggtgccacctagaaagacaaacagcagaaactgcagagcttggactgagctcagacaaaaatctctgctgcttgtacccagcttgaatattatggccaacacttgaagaatagaaagcatcacttaaaacattttaattatccccacatgtaacatgggccctaaatgttctgaactgaaaacctcactatgtagttgaaggtcaatgacacaagtttcagatattaaaggtttatcactgtttcctgtcttcctattaaaaaaaatgaaaaaaaaatcaaataaatcatcagttgtgagacaaatttccttgatgaccaaaaccagagggctctttgggcttccttaatccagttagcaagaaacacctcaaaatagcaatacaaagccaggattgaaaagaatttaaagaccattactgacaaagttcttgtcaaataaaagttatttgaaaataaaaataaggatctttttgaaattttggtagcagttgccacctgttctctcagaaaagtaactgcttttacagaaaactctaaataattttcaaaacccagtaaaacatggtctttattgcttatgtattcccttaatttgaagaatatttttaaacgctcaaaaatggaaaattcaatgttggtcatcttaaagattctagatgtatttcagcccaagcttgacaaacaagtgctttaggtatcctcttccctccttagctccttaaggaccacactgtggaaggaagactggaaaggcctcagcaggggagaaaccatgtgatggaggctcagagtggacttctgatctagtagtggcttcaggaagggacgccagacttgccattccagcaggggtcgaggcctccctgtctcgtgaagaggaaggtgtgaaatcctcttatagacacatgattctctttcagtgtattttctttattccatcttgacctcaggatggataactcatcatcccttttggcacggatcaaaatccctggataaatgccaaccttaagtttgcctgcatgtgtgtaaccatggccaaggtaaactggtctcttgggtttcttttgagttgaaatgagctgagctgtttgtttcctctgagccatatacagatgctttttgaactatctttgtgtttgagggaattttttttcatggtatcagcacaccacttcctccaagtcattactttgaaacagttttgtagagggagatattcctgctggccaccagcctagccaagcaaagtgatgactgagggatggcagtaaagctttattagtgcacttcatgtttttggatgagttcatgaaatgatttctcatccactaattttggcaaatagagggtgggctgtcatctgagctcagcagtagaaaacagcactttgttaataccaagcattggctcccctgtttgaatgatactcagaatttcagctaaaataatgtcctccgatgacctttgcctgctcttctctttataagaattccacagaactcttttgaatatggatttccacttaatctttgatacttccaggctcttgggtcctgataagttttagaaactgcaagtttaagtgaagctgtttttaacttcccttttattttgctttaaatatttttagcaatgaatgacctttgaatacttttaaatgttgctatacaaacataaacagtgcttttactaacatattttataaatatttccttttccataaattcataaattgcttttgtcataaaaatagtaatattttatagtattttaagagtaaattctaagcctttaagaacttttatgcctacactaaggaaaataggactagagacttaaaatacataaccatgctacatttatagtgattgttatgttctctgattcatacattaaaaactgatgtgattccataaaattctgactgtatttttttaatgtaattgcttattttgtataggaagtgggaggagttatccttgaggcaaatcaccactgaattgacccatccttttatcaactttatttttttttaagcccaaattctagcaaagcaataacaggtatcagtttcttccctaagtaatatattgtacactgtctttattatggtttggtggcattttagaataaagtcataactttaaaacttttttaaagctgcgcttttaagactgattatatacatgtcacagaatccagagtagaatgaatatatgtcgctattgttctccattgcttgaacttctccatgttacttatgctgtaaatatttttgagatattctcatctttgtgcatcttagaacttctgagaaactctcatctatattctcaagatattggggcagagggaacataggagaaaacttaatctcaacattggtgcaaacagaggttggaaagcattgcagtgaacaatgctagtgaagagtaagatgtacctccacaaggtgttttgcagcaggttaagagtatagcttggatagtaggaaattctgtatacagaagcctttgtactttggaaaataagatttcatattgatcttcatacttgttttccatgaatgccctgacaatgagagttggatactctgttttctgtgtggtgttcaattttgccaaagctttatttgactcttggcactagtacctttcacgtcagaatgccatcagcttgtggtggcagaacttgggaataatgataggaattgtggcatgtttttttttctcacttacgtagttaaatcagatcttgcctcaaggcctattttctctctgtttgttatgtgtcacctctgaaaacattcccagacgtttactgttctctttgtttactcctcaaccactagaataaagcagacttgaaaataagcagtcttccattccctagttgggtgagactatccgaaaagcctttgaacattttcttagtgaaatgaagaggagtcctgttctctgcagtggaggatttggagacaagtggctcggcattcggctcttggaattttaacttaactactaattagcaatggctctctccaggtgaaatgaaaacaagttaatgaacataaaaccaacttattaatccccgtttcttaacttttaggagcaactgtgtttttaggaaatttgtagggcattttctttctgaatttgtgttcattgagtctagtgatatttggaattacacaaaaatacagaggtattagtgaatgagagtgaccagcacaaattgaatggatcagtgcagcttttttaaatagggctaagtgtatttgaaaatgagttttagataaatgacataaatggagactcaaatgattagcacctacttttttcaaatatcaaagagtaaattatttattcttttttgtttaaaattttaaaaaataacccataactcagcattataaaagtcttcattcttacattgcattgaattatccctctgtaaacaaaaggagccactttaccagctgtgttcccatgtttgccttcttacttatcaatcttgccctccctgcccaacctacccttgtttcctcttttaccaagtagcacgaactggggagaagttctgctcacttaataatcgtaatagtagctaatgttgttgagtgtttagtatgtaccaggcacttcatctcaaagcatctgcctgtctaatttagaaatatcaaatatctcctaagtgcaggatgaagaactgtgcaaagtgaggaacatcctgtcacaggtcttcacttgggaagagccaggtggaaaggagatcagttgtccttctagcccaggacaactggaaattacagcccaccaagtagactgctagagttgctttgaatgacctgtgctcaaaagaggtttttatcatcaagtttgcaatcataaaaaaattctaaactagattctaccttttctaaaatatttgcataatggctaatgaaaatggtaaaaatgagagaagcttgagtattcattaggtcagcctaaattacaccttgatttctgggaactttggtcttgtgaacactaaaataaggtgactcagggtcacaactgctgttttctgtaccttagactttagaagtttacacatgtctgcatgtgcataacataaaccaaggcattcctgcttttgcctttgaggcaggaagagctatggtaagatgtgcctagaggtcctaccctctcctcccagcatgggatagaaacatttcttacagtggtaaaaattctcatagactgcacaaaattagccacagctaataaaataaaggtagtccttggtttatgaacatttggtttataaacacacagaaacggtcactgccttccacccagtcagtctacgaatggttagaatattttattttgtttatgaaaaatcatggagcttttaggtaacctttaggttcaaataggaggaaataaggaaaagactaaatccctgtgatttttttttaaatccagataacaaaccactaatggagtaagatatactaataatggagaagacaataaataaacctatcaaattggcaaagattttgaaacgtcataatagcacatgttaaaaagaagaaatgagtactgatgggagtatgcaagctaaaactttgagaaaataatttaatcgtatgtatcaagattccttaaaaaaaaactgttcatgtcttctagtgattgtactctaaaaatttatcctaaggaaatactataaaatgattacaaaacattcagatgcaagtatattaattataataggatttgtaataatgaaattggatgcaatttaaatgtctaacaataaaaaatatttacatagataatagaacatccagaaaatgagatatgcaactattaaaattgtgttaagagaataatatggggaaatgtgaaaaagaaggatatatacagacgcacgtacacatccaaagtatgatcccattttaaatacaaacacaaaaagaaagaaaaacactggaaagaaattctaagatgataactggttttctctgggtattaatgggtgatttttaaaaataggtggggtatggtggcacacacctataatcccagtactttgggaggccaaggcaggatgattgcttgaggccaagagtttgaaggtagcctaggcaacatagcaagactacgtctctacaaaaataaaaaatttgtaaaaattagccaagcgaggcagcatgcacctgtagtcccagctactcaggaggtgggaggattgcttgagcctaggagtttgaagctgcagcgagttgatcatgccactgcactctggcctgggtgatagagcaggaatctgtctcaaaaaaaaataaagttatttaagtgaaggaatcaaactatgaaaagtgggagaaacttaacaaagttaaccctagacagtgtgtgactgtactatgtggtgtcttcctccaactaaatgtcttctctgatctcaaaaaaattcaacatcatatgggttaacatgggttaacacctctcttctcttttaaataaaagacaacttgatttcctcctgatgcctcaatgagatcatcttatcccaggaaagggaattacaatttagggtaagaaatatttgggggacaggagccccttagtgtcttgcatgagaccaagggaaagtttggaggtggcctgaaggtgggggcagaggcagaagctgaggctggggagccccagagagggacgacccttcctcctcctcctcctgataccaccttaaagtcctttcctttgaggactcagaactgaagttttagtttagtgacattatgaactaaatatacttttgtgggctggcctagcaatatatcatcaagtttttttgtttgtttgtttttgtttttgttttatggaaatggtccttggattgaaacgactaacccccaaaggactttggagccctttccatttgcatcctagtttgcctggattagtgctgctctgacagtgatcttggtgaggctgctcttcataatataatatgagctgggcctaaatgaacacctgcacagcataaaacagagggtaaatttccttccacacatcatcaacgcagataggagtgtaagctccatgacggtggacaattctgtctgtttaatctttgtagtatcccctaaagcaaccttggaacatgaagatactgagtatttgttgaatggctgctgtgcatggagccctagcacagctgctcgctagttaacagtggcattagagacacacaaagattataaaacacttctatttctagaaagtcatctacagttttgtgcgtttttcttttggctggagaagagggccgggaggttgagtgtggggccagatctgggggaaaaggtcagtgactgcagggacctagaggttggagaagctcatctggaaggaggaagtgctggtgacagagaggagccgtggtcaggagctgggtgagctgttgaccaaggtggaggttatgtcgggctattctgacacgttgaccttagccacagttcccagaccactacttaacttgccttgccaagacacaactgccatccaaagccaggagtagcacccagcttgagttttgtttaatcattgtttcattttatttttgtgtgttttttgtttttatttaatgatggtgggggtgaggcagggagagaccatttatattttttttctactttgtccatttatcttcctgagggtgtcctacaaaacataaaccacatgtggtttttataccccaaatttttgtggtttgttattcccaaactagtcaatatttaaatgtagtcatggagctgctttttacataagccaccaactgatcattttgttggaatggatctgaaacagaatgaaatggtccaagtctttggattaagcagcttccgtgttgtggggaaaagagtcaacacggagcagaaagaaaataaaacccacacaaaatggtggggaactggtcactttctgatcacacattttctgatcctaccaccacccctgcatacgtatttggagttaaaggaacaacatatgtgcacatgctccagcaggaagcattttcctttgtctttcctgtggcctgataaggtattgaccccatcgaggcaacccgaaagtgtttttccaacaatctgtttccccagtcagtcatttgaagaatccagagaagctgaatgagaggagggaagttcttggagggaatctggggtcattcgagtagaacaaattctgttctggccaagccactgagaaaagcaggatctgctgagaaacaggagaaagaatcacccacgcctctgtgatatgtttggtaacaaaatgtgaagctccttcacaggatcagaggtgagtagctgtggtggtctccactgcccaggctggatgagcagaatcgtctgattggcctttcatgactttaaacggagctcaggcacatgtagacatcccaggaccaccagaagcagtggctcccagccccgactgaccccgtgcccacttgtaataacagtattttctaatgccctcttcaaaatcttcagtgaaccttcacaaataaaataatctgacttcacacacaatttccctccaaatcaatgtagtcttaatttaaaagagaaatgaaagtaatttattataaaataacttcagtttgtaagtgatcaggtacaactcatcagaaaacaaaagtacatggtcaggtgtttgcgtgtatgcgtaggatcacggtgggtgtgacagctgccattgcaggctctcttgagttaaagacttcagtaacaccattgacattgtccttgggctcatgattttccaaaggggcaactaactcttggtaaatatctgaacaaaacaaagtatttcatttgtatgacatttgcattaccggaaaatacagggaatgaatacaacagtgcaataactattttgagtttatgtataaattggagttaaggtctaggctcagataactagaaatagttttttcaaccacatcaatatgtaacaggacctttgaaggtcctgtgggacaattctttactgagtgagacagtgtggtacattgcagatcatctgaatcccaggaaggccccccattcttatggcactcacaaatgcccaccatttactgtccacctgcagagtagttgggtctgcctctcccaggcagctgcactagccaggcctggcttatatgcagtcagagggcccctaggggagtcttaggtcactgagcccttcccacagtgttcagatgggtggtgtcaggcccagaggtgcagagctatttacccttgttcctgagaatccaagggaggggcctttagtgtccatatagttctgtcctccagcaggtgatactgagtagccatttagctacagagaagtctgaataaggaacaatatggctactttcaccagcccagaagtaattgtaaaggcccattctggcctttatacctaatgattagcaaccatagggaacacacagctatcttcatgccagcagcttctctcagtgtgtgtgcacaagtatgtacctggcaggatgtgaaaatggggctttccaccagtttctcccttgggttgcaagaagcctctttctatcattcacatgggttttcccctgggggccacttatattggatgctggtaactgggaaatgtttgcattttaattaaattacctaagacaagatagtgcttagaaaaaaaaaagaaaaaaacatgaatggtctttccacatgtgaaatcattttctcttcaaagaaataaggcaagtgatgttccaacctcagcacttgtatttgtttgctttttgtttcttggtttttgctgagcacaaaactgccaaactcagcatggagaggtgaacttccacgctgtgtcctcagcatctagggtactggcatcaggcacacaggggcatagaatgcagatttgttggatatgagtacgtgaagccgttatgggactgtcctttctagatagtcctgggcctcttttttttcaccctagtttggttcccctgcctcttttccaagtcagtcatctcactattttctaactcattctcttcctgacactggcaaacagccctgcgtgagaaagagtcgttaaatctgttggcagggccccccattattgtctttttaaatggctgtcttgtgtcaacctgttgggagaagcaagagcctccccaggtctttttggagagcaaatctaacaatttccactttatcctggcacctttttgcctagagccaaacgtggagcagcataatcacaaccccaggttaagtgaaagttagaactaaacttagagctggaagcttgtaaaattcacttacaaatattttcaagcacctgcattatgccagatactgttctaagttgttggggcagcagcagtgaccaagacaaactctgccctcgtggagctgcctctctggtgggaagagcagatcaggcacaaatactgcagaacatgagtggagtgaggggagcagccaagagaacagtgtcctcagaagaggggacagcaagcacaaaatccctaaggcaaagagatggggggagaaggtagggaaagaggtcaaggaaggagaggggaagtgggggagtgtcaaatcctcgaggaccttgctagtcatggcaaggactttaggttttacttggtataaaatggaaagccactgaagtgtttgagtccgtgaatgctgtagtttgtatgtgtcccttgaagttcatttgtcagaaacttaatcctgaatgcaaccatgttcagaggtgggacttctttattttattttattttttttgagatggagtcctgctctgttgcccaggttggagtgcagtggtgcgatctcggctcactgcaacctccgcctcctgggttcactccattctcctacctcagcctcccgagtagctgggattacaggcgcccgccaccacgcccagctaattttttgtatttttaatagagacggggtttcaccgtgttagccaggatggtctcgatctcctgccctcgtgatccgcctgcctcagcctcccaaaggagaggtggaacctttaagagatgattaggtcctgagtgctctgcccttataaatgaattaatgtccttatcatgggactaggttagttatcacaagagtgggttcttgataaaaggatgaattctgtttccttccttccctgcctctcattgtgcatgctctcttgccttcagccatggtaatgacacggcaagaaggccctcaccagatgtggcccctcgaccttggacttctcagcatccagaaccgtatctggccttttcataaattactcagtcgccagtattctgttacagcagcacaaaacagactaaggcaatgtattttttctgagcccttaatttaaaacttctttactgcagtatctcttcacatgtggtactagaagtgttagcactaagacctcggggaagagaagccaatttagctcttctactggccacaaatccaacaatacctagtcaattccttgttttaagagatggcttcaagcagaataaactcttcctaagaatttataactataaagcgcagagttggctctaggtggaccaagacttttccgggactgacattgattgaacatctgttaagtgtcattcaggcatcctgccagcataaaagatgagtaagatggggcctgcgtgtcaggccctcactgtctagagttgtgttgcccagtgtggtagtggctctggagcacttgaagtgctgccagtagtaaagtaaacaccagtttctgaagacttcttgtgaaaaaaagagtataaaatacctaattcatagttcttttcaaatgtttagtacatgttataatgatactatttggggggattttcattggtttttttgatactatttttgaagtagtgtgttaaaagaaaatattacaatctcacctatttacttttactatttctaacatagctcgtagaaaatatagaattgcacacgtaactcaaattatatttctactgaacagtgctgatctagaaaaaagggtctgttcttttgttggttggacttttatttttacttttttattgccactaataatgggtgttcagattttgagagtttactccttttctgggaagaaccacttgttctttgaccattgtaggggagccctcattctatccagtttctccaagagcaaaagaaattattttgagaagtaaaaggtaacttctgtaactctgtaagttacctctacaagtctgagcatttttacactagattaagcaaacctctttaacagcctctagtggataaggaagggaatgagccacaagtcttttttttttaatgctttttgttatggaaacattttaaatatatatgaaaagtagacagaactgtgtaacaaactgctgtgtactcctcacccagcttcaagaatggctatttcatgatcaattttgtttcatttgtacccctacccactttccctccttttctatattactttggaaacaagcccaggcatcatatttcatccacaaatatttcagtatatatctctaaaagttagggattctttgtaaaatacaatataaccacagtaacattatcacacctaacaattatcaatatcttaatatcattaaatatctgaacaatatccaaatttccaattgcctcatttttgttttttagtttatttgactcaggatccaagtaacatctacacgttgccttttgtttgtttgtttgtttgacacagagtcttgctctgtcgcccaggctggaatgcagtggcgtaatctcggctcactgtaacctccgccttccgggttcaagcaattctcctgccttagcctcctgagtagctgggattacaggtgcgcaccaccccaccacgcccagctaatttttgtatttttggtagggacagggtttcaccatgttggtcagattggtctcgaactcctgatattgtgatccgcctgcctctgcctcccaaagtgctgggattacaggcgcgagcccctgcgctggcccacatgttgcttttgattgctgtacctcttgagtctcaggctcccctcgctcttactgcattggcttcatgctcagtctccacgtctataatgtgggtataatactgccattccagccccacacctctaatgtggataacatactaccaattcagccccacacaccttagaataagtctcactacatctccttggttcaaaagtagtctctgaaccagtcactgcagccagggaacccaaggctttaattagccagggctggtcactttccattcctggagtcagagtagagttactccagatctggatcataatcccaaaagacacagtccagaacaccataatcccgaatgttgaaattcccaaagatgaaaatccctaaagtataaatctctaaagtctaaaatcctgaacatctaaaatccccaaaatcacaatcacagaatagctgcatcatgttaggccagctcttcggactatctccatgcaattgcccataatctatccccataatactcttttcatatgttgaattttctttttagttctttttcttattttagttttttttccactattttaaagtttcagcatgattttttataattcactatgccatctatttcatcttttcatcatttccaatactggacatatacattgtgaagagacttttggaaaattctaattcattaaatgccttttttgcaaatttaactccataaaaatgcatcagcacagcattgactttgtgtgtaagcattgcgcatatacataaaaatgttgaaacatcctcaataaatgaagagatggccttttatacaaatctgcgtttgtgaagaaaatttcttgagatctcagctctttgggcaactgcctatgtggtaactgcatgtcacagttttttattgatctcatcaaaagattctttgtcacagtatttcagatgaccaaatttataaagctgggcacaaacaataccaactgtagtgatatgcatttgtacacttctcttcttgccctatttctttatgaatacagatgtctgcttataacttctatacctgtgctactgtcgttggaatacctgagtgtttatgcttgcaaaaatatttgtgttattattgtctattttattgtgtaaaatggcctatgaagtgttctgtcatgtttttatatgtttcttaaataaatcctcctttaaaatgtaaataaatatctttcaaataattctctattatttcttccagaattatattttcaggattttgatcttttgggatttcagtattcaggattctggtgtttggaattgtgtctctcaggattatgatcgggtccctccccactctatctaatgttagcatgctgtagagaatttgggttttccaacctgcaagtctccaaattatttgactctcacccatcttggttgcagatcacagccaaaaaaaggcctctcttaacaaagccgtattttttccctctgtgcctctagtcagttttgagcctacatttatctctttcctgtggatcttactaaaagacacaagaaatagccaacacactgcaccattctaaatgcttttccagtgaatccattaatggtgtaccatgagtaggctcctgtctcagaccgaggagtcaataggtggcagcataactagctattttgttgtcacttaacaaggactgccaattttccagtccaggccagcctgcgctagccttccccaacctcaaatcagccagttgcacattttaggcttagtcacattcaacactcacttctagtaccaattcctttatcacttaagagtctttgcattgctaatgatagaaaacgtgaccataccagcttaaataaaatagagaatttatttgcataaattaaaggtctagaaaaaggccatcttcagttatagatagattcagggctcaaccaacaacaccagcacttggtttttctccctcttccaattcccattttgttggtcttggttttagaccccatgtggtcaaaggatgagtgcagcaggcccatcccctacatcctcaacagatctggttccagcctcatccctcagggatagagctcgcctcagcctacaaatttccttgattctgatgatcacaagccatcaccagaagtctctagggccaaatgaatgcaaggctctgattagccagccttgaatcacatgcttttcctctgtctggaatgggagtgaatgcctctggatgcacatggtttgagagtgagcacgggatgattctccatacaaacaaatggacgtgattataagtagggggaatggttgctgagctgccaaaacacaacagaatacactgcagacttttccccaagtaagattacatcaatttatattaacagggtgcagaatactacaaggtttgtttttaatttatctatgtttctgagattatttttaaatgatcaaccctgtatgtagctgtactgataattatgtggtggagaggattattcctttgtttctgctcttttaaatcaaataattcccatattttaacattttgaaaatagattcttacaactaatgcatatctttaatctggtagtgtttctttttcaccctaaaaatctataaggagtcattctgcagtataagaaggaataatgtaagttttagaactgcgggatgcagtattataaaacacctttccactactggggaaatactgcaccataacaggtagtcatggaaacacaacttgaaaaaccagaattatttaaaacttatgttgccatattttacacatgccactgttgcactgattcagtccatgttgactgggggccacggcaggaggctgtgattcttcagcactttttctacactggctagacctacattattgttttataatcttctgcctgctcttggttttttatttctatagattaatatggaggattctttatgtgattggtctgcgagcctattggttattgttttactctgtcattaagctcagactgatgcatattaaatgggaaagagatacgcatttaaaattctctttaagtccagaattgtgattgtctttattcatccaggctttcaatccacttatctcaggcctttggttatagtataacaacctctcccatccgcatcacagcctttctctccaccctctttcttctgcctcttcttgtacttacagaaaggaggtaggtggtatcacccgaacctgaaatgaggctaaagacattaatggcgctggacagtggagtggagcccaggctttggccactgctctgctgctgccagctgtgtgacatgagcaggatgcctaacttctctggacccctgtttcttcctctgtaagtggtgatgtagactttgatctctgcaagtctcctgcagccttaaagttcttttctttttaaagaacgtggctgctggaaaagctgacactgagctgagaactccgcttcactgcggaaggccagacagcactgttacatccagcacctgtgggtcatccactgcagaggtggcttccaaagcctctgaggtcagcagtgtggttgtagctctcctctacccaccacatgatctctccccatctccagcttttcttgccttattttctttatctttttatttcccccccttcctttctgattgttctatttgttttcaattttcttaatccatttttctcttcacattgcccaatggtgtaagccacctgcactgcataagactctgcctgcactgccaggcccactgatgggccaagggttttacctgctgaccttttctctggaaaatttccctttaacagcttctcccaagaaggcttaagtctagtcttggcatttgttatttaccatttcagggggaacagtcttaagcttttaaaggaacattatgctgggcagcgtggtggttcacacctataatcccagcactttgggaggctgaggtggacagatcacttgaggccaggagttggagaccagcctggccaacatggcgaaaccccgtctctactaaaaatacaaaaaaaaaattagccaggcgtggtggtgcacgactgtagtcccagctagggaggccaagacatgagaatcgcttgaacctgggaagtgaagattgcaatgaaccaaggtcatgccactgcactccagcctgggtgacagagtacgactctgtctcaaaaaaaaaaaaaaaaaaaaaaaaaaaaaaggaacattatgctgtagtagaattcgtaagaaacattgattttcttttccattcaacaaacactattttcaaacacctgcattagatgctgaagcaacagcagtcaaacacctgcattagatgctgaagcaacagcagaaacaagatggacaaggtccctgctctcatagagcttgaattctagtggagagaaacatacaagtaaataaacagataaataagacagtgtcaagcggtgacgcatgctatgcataaaagaaaacagcagaaatgggtcatgagggagagcatttttgctgacatttgaagaataaaaaggaacaaaaagatgagtgtaccaggcgtgagtaccaggcttgcaagtaaaaggcctgaagatgcaaatgagcttggtgcatttaaggaacagaaagatttggaaggtaaattagcaaggcagaatattacttgagatgaaggcagagagttaaggaggggccagatctcgtgggtccctgtggacctaagagtttggactttttaagtgaaatgagaagtcattggagggttttaagcaggggaggaacattatctaatttatgtcctaacatgcatagtagacacctgataaatgtgtccaaagttgactgtaggaatagactcaaactacacaactactcccttgcatgtcttggggactgcagccttctaggtgacatactcccttctaagtgagcttttcctaaggtaggggtctccaaccagtctatggccccttaggaaccaggccacacagcaggaagtgagcagctggtgagcaagtgttccctcctgagctctgcctcctatcagatcagctgcgcattagattctcagaggagcaagaatcctaaagtgaactgtgcatgcgagctccttatgagaatctaatgcctgatgatctgagttggagcagtttcatcctgaaaccatccccaccccctgcccccactccgtggaaaaattatcttccacaaaaccagtccctggtgccaaaaaggttagggaccactcccctaagggatggaaatagccatgaatggtatgtgtactgagagagagagagagagagagagatagctagagagagagagagagagagtgtgtgtgtgtgtgtttggggtgtcttacttagagaacttcaaaataattctgaaaatacgtagagaaattgtcatatcgcccatgttctctttttagacccaactataattagacttccccaaagattcactcaggcatttacttaatagttgatcaagttttctgttttcctgagggtttgtatcgcgggaagtggctgatagctgtaggcctccacctctgtccagccccatgcctgcaggtatttatttgtgacctaagtcacgggtggacaccaggccagagttagacaagaggcggtccctgccttcaaggggctccaggcaaagcagaggactctcagtcacttattcttgggtactccactccaggaactgtgcccatggcctggcatcatgaatctgctcatgcaattagactcctatctcagggaattttgagtttaaaagatccttagacatcatctgtcccagtactccccagtaggagcacttctggtattttgggtgggactgtcataagcaccataggaaatttcccattcctggccccacccactgaatgctacaggcccctgcccccaccattcccactcactgctcaccacccccaacagctacctgagttgaaaattactcatctagcccagttccatcactttacaggtaaggcaatgttagacaacatacgttcttttcatgcctctggcctctgatcctagcagaatcaggacccaacattcagattttacaatgaagctagtttctgaaatatgcctctcttttaaattctttgactgttactgttttctcagagttatatactatgtgttgcatatgtaagtctgaacctttaagatgggttaagaaaaaattatgagcattttcagatcgttctatacataactcaaggttttgataaaatgttttctacatgtattccattgccatccacctcttgagttctttaataatgagaaatctgactttcttccttccaccctctttatctctatgcttttgtcaagcatcttctaggagagttactgttatcccattaagtgtgggggacagaaacatttggcatagaaagctatggatctgcagctgacttaagctgtatattattaccctgacttgggcaccaaaatcacgtttcaaaactcatttgctgccaagtatggtagctcaagcctgtaatcccagcaatctgggaagctaagatggaaggatcactttgaagctaggagtgcaagaccaggctgggcaacaaagcaagatcccatctctaccaaatataaaaataaaataaattagccaggtgcagtggcatatgcctgtagtctcagctactcaggaggctgaggctggaggattgctcgaacccaggaggtcagggccacagggagctatgattacgccactgcactccagcctaagtgacagcaagactgtctctctaaaaaaaaagaaataaataaaacaaaaccaaaaaaagaacctcatttgccttcatacacctgacctgctctctttacctgcatttgtaactttctccccacacacttgaatgccctgtaaatgagaagaagcccttagcctaatgaagcgataaggtaaggtaggtaagagcttttctttcttgagtgactcttttccctattactcaatggaatagtcagtatttacagtgatactttcaaatataattttcctaaaggaatctcaagttccatgaacagttatttttgtgggaatatctagaataaagttggactcttcactgagtggaggtgctcatctcctcttgtcactgtaccaaatagctgtgtattacaccttgtggggaggagaaacatttaattttttttaatttaggttttttttcttgcttgcttcttaagcaaaaccaatctagtttctttttctgcagcaaaggaggaaggaacaacaaacaacaaattaatcagacaggaagcgaataaccacagaaggacgtctgcctctgactcagtatgtcacatttaacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacggtaagaaaaattatattcaaactaagtttatttcatttatcagctacagggaagaactaaatggcttttaatggaccatagtatgtcaagataaagttgtttaatttttctgtagagcaccatgtgagctattcctgttgcccagaatgctagtttcaccactatggtgattgtgaatgattcataacttatgctttgagccaaaatgtaagcaagattttcaatagaatttttttgaccactggacaagtttggatccacaggaatttattttcccatttaaattgggggcttatgtcggtaaatatatccttttggtgtatgatacagttgtccacacaactgcctttgaatctttggtgtggccagcaacaataagtgctttcaagtacaaggagccattggaagcttcaaacgaaaataccatggaactaagctgttgcagttctgttgctgccaatgtgctatttaagttcaaaactcaaactaaaccatttctaagcagagtcttttataatacgatttgtcttttagaataagtctattcctgttataacagtgtgtgcacaattactatcgcaaatcaaattctacagcattagttataactttatgtttaatatgattaatgttttggcataaaatattgtgatttttaaaatttcaagccatctactcagaggcttatagagcagaactaaggaaactttttacattaaaaaacttttttctagaatatgtaggaagaaacaatttgacttatgttcctttctccccgtgaagaaatataaaataaagctttaaaaaactcagaaggcacatataactttagtcactaagtacaagttttttgttttttttgtttttgtatttttagtagagacagggtttcatcatgttggtcaggctggtctcaaactcctgacctcaagtgatctgcccgcctcggcctcccaaagtgctgggattacaggcatacaagttattttaaataatttaatggcataactagtatatgtagtagagaatggagaggtggtaaatgaaaaggctactgaaagattctaactaagcaaagtaagacagcttggtagagagaaagatgaaagactggggaaagaataggacaggacagtgagaaaggaagatgagaaactgggaaaaggttttgaggttgatctgtgtggaaatcatactcttacaattcacttggactacagtgctatgtgttaactttatcaagctttgttcttctgtactggaatatcatcatgtcaaaactcttccttttatcagtctaaggtcattaaatgacttacctgaaagtcatttttcactaagtcaggttttctattgctctttgaaaagtttattcatgggctatttgctcatagcgcttcagctactctaatatctaaccttttaagggttacacatactctgggtggactgaaatattcagagaactccctgtggtgaaaattagttcctgggatcgagcagcaacttcagatctgatcaaattctaaatctggcctgtaggctggaagttccccagcctacctaaaatatgagatgaagtgatactgaattcctggaccctttaagtgttatgaccttttgaagccttcttaacattttatgaacacacatcatttactttggaagtttctggctgtttaaattatgatatatttctgctttaaggtttgactcattttgtccaaattgttaaacatgtgcttgttgttgaagaaagcatttctcctggacttccataaatacctctgtctgtcctgaaaattaaaactgtaaaaaaatactagaataaggaatgccttaatcagtatgcttttctgagaaatttgaaatgcactttatacacatctcccttcaccattcacttgtaatatggaagtttgcatgggtgtacacacataggctgatttaaatcagctcatggtttctctttctcgtggttaaatagggggaaagactgtgatatttactgaccacttattttgtgttacgttcttcacctttgcttattttattttttgaaaatggctaatacttattaagcactccttcatttaactcttgaataaccctactaagtaggtgctattattttgaaaaccggacttacataagctaagtaatttacccaaggccacctaacaactaaatgtggaggaagttatctgaattgtaagagctttttttcacaagtgcagcttggaagcaacattataaattgtatgatttctgtttttctttttcttttctgttttttttttttttttttttgagacagggttttgctctgtcatccacactggagtgcaatggcatgatcacagctcactgcaccctcaaactcctggactcaagcagtcctcccacctcagcctcccaagtagctggaactacagatgtgtgccaccatgcccagttaattatatatatatatatatatatatatatatattttttttttttttttttttttgtagagatgagggtcccactatgtttgcccaggatggtctcaaactcttgggctcaagctatcttcccaccctggcctcccagagtgctgggattatagtcatgagctacgacacccagccagtatgatttcttgaggtgcttttccggccttgggaatctgagattacaaatgttttgctttaaatgtcacagcaacagtaaatatctttaaaactaacaatctcaagtaagatattttcctttttaagtcttttcacttcttcagaggtaaacttggtgacacttctgcttatatcataaagctgtactttcaatgataaaatgaatacagtatatatcaagtgtgctgacatatatgctgtgtgtgtatgtgtgtgtgagagagagagagagagaaagagagagagagaaacagtggcacatcttaatcctctggtagaactaaatgtggtgatagcgatttaggcagattttagcttggagatttgaaccccttaaagagatgggaagtatgggagaaaacctgctactctttaattatatggataaaataaaaatgtttcctttccctttccttcagttaaataatgacaggtaggcgtgtcattcagctcaccttcattttctcactattaaaagggtcttcgatgtctgtgaatttgtattaattttaaaattaaatgtgcacaatagtggattaaaaaataattttacttcatagcaacctttatttccctagcagtactcttgcagtaaaattgtgtccaagctcctagccagtcttagtgatgttcgagatgcttcaaaatgtcttctttgaaaaacacctttcctactccccgccaaaataaatcacctccttatctaaaagaactataaaagaagcatttctaggttcagcagacttaaattgacatttaccattaagaagacaacctaatcagacgttgctgaagtattgtttttcaatgatgattgactgagaaaagagcagtacattttgagaaatgagggattctgtgtatggcaagcgtgtgctccacattcagctcaaatggagactaacaatgcataagaaccaactgggtgaggctgctgatttgctaataaagctgttttcctcttctctgccttttgcttcctctggagtccagctgccttttctgtttcccctcttgtatccatggcttattgctctgagcaaggaccttcagcttggagagaggaagagtagcaataatagaaacgaacctttctgcaaaggtattgaaagtttctaaaatggccagaccacatgctggggggaagggatggtagagctgttgcagtgactcgcgtcataaaatagaaactccaggcaactgcagctgtgaaaagattgtgttaaagaaacaggatgactgtggtttactgcgagcatcaattttcctgttgagcattttttacaggaagttgaagaacaaagccaaattcatcttaattagttctaatggttttcagatcttaaatacatccagctaagtttgcatcatggaggagtatctaaagaatagaatcaagaataattgagtaggaatcccaaaacgacatgctttttaaaattcaccgtcttagcagcaatttgagtttgctcgatgattttatttttgcagggtgacttggagtggattcactgtctttgtaatgaatgcccttgcagttattttttatggttgtaataactcaatatgaatttaaaaaccttttctcaggaaaacacttttgtgttacatgtattataaattttgttctgttaatatttttttgtcaaacaattgtgtgtatatgtgtatgtgtgacacagagagagagagggagagagagagagatgtacatgtacttataagctagaaggacatgtatcaaaataacaaagagttacctctggttattacccccaaccctttttcatataaaaattaattattattcagtgcttcctttagtggttaaatacaacttcagtgcttttttttttcatctttgtatatttttgtattctctacaatataaaagaaaaaaaagaaatcttgaagaaaacaacaacaaacaaaaaactaacctgaagatgccaaaagcactcaagaaatacatagatgaaaatgagttaagagcattatatataaagtaaaatataaatgagttcaggcatggtggctcatgcctattatcatagcatcttgggaggctgatgcgggtggatcacgtgaggtcaggagttcaagaccagcctggccaacatggtgaaaccccatctctaccaagaatacaaaaattagccaagtgtgatggcacacgcctgtaatcccagctactcgggaggctgaggcaggagaattgtttgaacccaggaggtggaggttgcagtgagccaagatcgtaccactgcactccagcctgggcaacagagccagactctgtctcaaaaaaaaaaaaaaaatcaataaataaatgtaaataaaaatagaaaataatgagggcaagagagcagttggatttttgaatctatccagttatattatttctgataccctcccccacccccagcaaataaaatattcctctattgattcaatctttttggggaaaagaagtttaatattccaccattcattttaagtatgatagtatttaagggttacttttagcaacatttatagagcaaaatgctttatatttttgaatagtccaaattaatgataaatgtaattggataaagctgcttcttatcttctctaatagaacccctgcccacttgggattagagaccggcctttggaggattgtcaactgtgttcactggggactattaggaatcactccccacctcatgtcattctgtagtgtgggccctaggcagtgcaatctagaattaattgtaagttggctatgaaactaagaaacagcttatttaaataactaccccactttcttgatcccaaggaaggcaatcattttacattcagggatgagtctgctttcctagatgagcacattgaagaagaaaccctgagtttcctggggcacgtctggactgaactgtgagctatggttgacctctagttggccatgccattgaggagaatgtgtcccctgtactgttgggagtgggctgagcagttctctttctctcacagtgctcgttgtagcgaacattgcatgtttaacaagtgagtcgaggctgcaagatgccctagttgatctgggatcagtgaatgttgtctaaatgtaagtgttaaaccatgatgttgacctaatagcattctagtaagacaaacgatgccagccatttcattcacagaatgaactaggaagtccagaatttctaaatgttggggtggtgtgtgtgtgtgtgtgtgtgtgtgtgtgtgtaagcaacaaagaagaaacagtaattaaatttttaaagtcatttatgcaaattatttcactctgttctctcaacccataaagccagttccttacgaaagggttattgctagatccctccccttacttcagctattttcacctaaaatttcattatttttgaatgattcattcacttattaaataaacctttggcagtcacttacatactctagggttctggctgatttttaaattttttaacgtatgacaatccagaaatatcttgctgagaaatcagttgatggatagtttattcaaaggccattatcttattgtttccacaatggataatagacaaacgtatgttgttaaaaccatgtgtattaatttgctaggactgccataataaaataccacagcctgggtagatcaaataacagaaatttgttttctcccagctctggaagctggaagtccaagatcaagatgtgggcaggtttggtgtgttctgaagcctctttccttggtttgccaccttctcactgcgtcttcacttgaagactttcctctgtgtgagcacatgcctgatgtctcttcctctttgtatgaggacaccagtcaaattggattaagatctcacccaatggcctcattttagcttaatcacctctttaaagaccctatctccaaatacagttgccttctgaggtcctgagggtcaggaattcagcatatcacttttgcaggggacatagttcagaccgtaatactgtatgtgaaaacaaaagccttttctgtcccttgagttttctttgtgtttgtagaagtcaacacaccaagtaaagattttagaaagtctggcttttctatcatgaaagttacttaacattgaaattattcttaaaaagaaattaattctgaaaagtgtgacttcttaaaagttcattgcttgggttggggtggggtaggagggcaaggcccagcaagtgggtaggcatgtgatccgacactactgagagcccaactagtctgggaagccggacacaggcacagcagattctgatgcaggagatgactgaccacactgggaaactgctgctgagtcccttcccttcttgggtctctcctgcacccgaatcagctgcctttcctgccatgctcccatctccaagggaagaaccaaatgctgggaggcccagtcatcagtcagcctcattcccacccaggcagatccacccacagccactgagcaaagctgtggcccctcagactagcctccaggtccatccctcctctgccaggcactcagcagcttgtaccagcaggacccatcctcaccctctgaaggacagagctaagccctgtccactgacagctttgctcccccaggccatgctgaaagccttgcacacaccatttcatttaatctgctcagcaacttcccatttaacagatgggaaaaacaaattcccatctgaatctgccaggtggcagagcaaggattcagaaccaaatttgcctgaccaaggtctcatgttctccctttttcattctataaacccactggtaaagcccaaaggactcctttttttaaaaaatttaattttaatttgtttttattttattttattttatttttagagataaagggctcactttgtagcccaagctagtcttaaactcctgggctcaagcagtcctcccaccttgaccacccaaagtgttgggattataggcataagtcaccactcccagtcccaaagggacccttttgtgtctacgtttaaatgcataaaataaaatacagagaattacaaaggaaactaatttattaaaatatgtacttctttattaatggtttaaacaacaagatctagcaatggatctaaacgttgccagcatgttgaaaattgttggtgtgtagttgtaatatgatgtgaaaatatcacgtgaaaactatgggtgaaagaatatcagatattatggtttgtggcctgcattcataatcaaaggaaatgctacatttcagttagtgcttagtagaaataatatgtacttttttttcatacaagttcatgaacccttgaattctatccacagactctgggtgtgaggatccaggcaggaatgcctggtctgttaggatccgtgctctagggccaaggccttcagtaagatctggctgtggctctgatgtgggctgtcaagtccatgagaggagggaagccctcctctcccagggccttggggctctacttctctggggaagttggaggctgccaggaaagtaagttccagtctgcaacactagcaagcccctctgaaatagggctgattcttttgcccagatctcacagtgcggtggggtgatgctgggagcccttcaagtggcaagcactcggcttgtttgtgtgatacacagttctttcactgcatatatatttagtaagaaccctactttgtgccaggtattggcaagaccccatggagtccataggctggtggaaagacagccaagaagtgggcctggtgtggccggtgggcccagtgttggggcacacgagcttggtctttgatccaggggctgagtgaggtggcagtattggagtctggggtttctcacacacttcccttgaggccccagcctggagaagtccagaccgtgcccagcagttgttcagctagaagggaggagagaggacatggcagcctccctcatctgtgttaccattgagattggaaagggacagttaatctggaggggagtgagagatggggccagggaaagcaagccatgcaaacaagttcgcagaggaagagaggaaagagcacttagttctgcatcaccctctaaaaagtgagagccctcacccgtagaccctctccccactgtccatctgaagtggccaggaaggaaaggcagcacttctttcaatacctcagaccctttaatagcatcttgctccctgaaccttgtttttgcctgctaatttctgcaatctggccttggctctggccccagccatgactgttgccatttctcccacactagccctctggaccatgaagttaacacgccctccctggagctgtcatccagaagttaatatacaagtcagttagtgcacagacagtactaaaacagcagcaacagagaattgtaaaataattaaggaggcctttcagggtggcagcccctgaaagggtccccattccacagtctgccccctaagctgtgcaggacagaagttcaatttgatctctgttacgagagccgaactcatgacaaccatacccataagaggttcctgttagttgaccagaatatccaccctttcctagatattaggatcacagaatgacagaaagttaatcggtgaacgtggagtcagacaaaatagtcttgagggatttttcatcaaccaagcacgtggatgcactgttcccacagcccatctcttgggcccaccgggcagaccaggctatcccccttccttggtaagcctttcccaactctgatcataccattgatttggctccagcatctttcgcagtagtcaggcctgaatcagatccctttcgttcctgctggtcctaggagacgtctgactccaaggcctctgaatgtgccgctggagatgccccttgatggaggaccccctaacacaggcacccagtcctgctcacaatgcccatgtggccctatgggtgactaattgatgtcatgccagaaagagcaatttaagaaacagactttaaaagaatccttgcctgagacagtctcttactgaaaacagattccagcctagttaacaggtgagctgtggcactaattcgcctgcctgaaagtgtttatcagaccattaaaagggcagtgagtgagtgaggcagtgttatccagcagaagagcaggaagcaaaaggacatgactgaatgaattgcttcagggtgttttagggagtgatttaatttctctgagtctatcaaatgagcacagcgatgctggcttccgctgtcttaggagtcagagaccacgcaaggatagagccctggatccagcagattctccatacatgagagctgctgttgctgctgtggaatttaaaattttcattttctagaccgcccactttgaatgggactcttccgaactgtcttaattcttgtttcccggcggctgtgacaagtccagcagtgtcttttttagcttctccagtccatttctgttcacagaaagcaagccatttagcattatctcaatagaaagtatttgtttaggtttcagttttccacattaacttgtagtggttgaactaaatgaatattttaaattctaagaaattgttttttgcaattaagggactattgggagtttaaaaagcctgacacagtggctcacacctgtaatcccagcactatgggaggctaaggcaggaggatcgcatgaggccaggagttcaaaactagcctgggcaacatagcaagacccatcacaacaaaaataaaagataaaaataaattagccaggcgtggtggcatatgcctgcagtcctagctaagctactcaggagtgaggcaggaggattgcttaggcccaggaatttgaggcaacagtaagctatgattatgccactgcattccagcctgtgtgacagagcaagacctcatctccaaaaaaaaatttaaaaaaattttttaaagaaatataattctgcagtttaaaatttgggacacatgtcctgtagaaataatgttattcaggtggccagtgacccagactgcccgctggcttaaggctcgatctctacatagggctttagtgcgtatgaatcacccagggatcttgttaaaatgctgaaacgaattcagctgggggcaaaagggactgggagttgacatttctaacagcttctgggtggtgcccacgctgcctatccaggaccacagtttgtgtagcaaggatggggtgggagaagctggcattgcttagggatgagaacagtgggtgaggcgttgtcctagacagggcagagggagcaggggttctagtgaggcgaaggaacaggactgcaaggattagaggaaatggggagagggctcctggctggtgtaactcaccaggcacttcctggccatcgtctctcctggccctggtgtttgccaggctgccctctccgccctgccccctcacccacctggggtccctaaactttcctacccagctacggaatctggtcttccctttgttttcagagcaagcacactctgcagaaaggctcttcttttttattttatttatatataattttttacccaaacaaagctaagacaggctcttctaaatgaaatgcatttctggtaaacagcctgggagtcctaggtctgacttctcatgcccgctctgttttcacttagatcctctgaggaaatgctaaggagcacagagatagggatggctggtctttgagtgctccaaacataaggttgaccccccacacgtccaccccgcctcagctgctgctccctgctttccacctgacattctccatgccctctccctggaggactaggaactttgagggcgggactagaagtagattcattttcatattcctgcagtgcacacacagacttggcgaatgtcaggaagaatgggaggagaaagccagagggggtgggagagcatgaaaggattgtcatggaaattagcgaagaggagaagccacttgaagtgaatttgttttcagtgaaacttggccaggatacatcctagcagttgtgtgagaccttcctgcttaactgggcccacctgggtcggtcatggcctactgtagtgggtgggggaatggagccgagtaaggcactggatgtggcctccattctctccaagcacctcgggtcagaagcccctctgccgggatccttccagaacagtaatgttttagcagtgaggtgtaaaggtaagcccatctcttctaagagttgagctaggtggagctgtcactttggtgggaaagtgaagacagattaggacagtattactaagattacatctaatacatgatcgcattcttgtttttccagatttatcagcaagactgttgaacgcataactgcccaagatgcctgtccctccccctccagcacccccgccgcccccgacgtttgcactggtgagtgtctcctccccaaacactttctatgcataaagcaagccaaatgaagccaaaacctggcgtgcatgtgtttgtattaaatgtgtttgcattctggctcacatgtgatacaacaggctttcccagtgcccagggtaagccaaatcctgaaacccagcaaatacaaacaacacgaagggttttgtttgtttaaggtctcgtgtgatggatagtacaagggtggaatgtggctgatgaggtgttttctgccgcatctgcgcagggacatgtgctggcccaagatagggtttgcaggatcagttctgagaccagtgtgcactgttttcattcagatgaactcaatgtctggcctttaacttctgggctggacggtctagaaacccaggtctctgcctgcagtgcattccattaaagtgtcttccggtctcactcctttctttttttctgccttttcccctcttcttcccaatctgtttttgacaaatatctccctccaccacctctgccatacacattcacatcctcctttaaatctatacttgcatttaggcatttagatgtttatttcctgaaagaatttcttcagtggattcatcctggtcttttttttttttttgagtctcgctctgtcacccaggctggagtgcaatggcacgatctcagctcaccgcaacttccacctcccgttcaagtgattctcctgcctcagcctcccaagtagctgggactaaaggcaagcaccaccatgcccagctaatttttgtatttttagtatggacggggtttcaccatgttggccaggcttgtcttgaactcctaacctcagttgatccacccacctcggcctcccaaagtgctgggattacaggcgtgagccactgtgcccggctcatcctgctcctttgatagacctctttggggaagttagtgtgccctcttcaggaatttggcaactctccacttggtcatatggaaaggccccaagatacgctctgttacaaagccctctccagcttgtgaagccttcactgaggaggagcctcacactgatggttccttcattttcaccattttcacatggggaaactgaggcttggagagaaagtttcttgccccaggtttccatgagacacatttatataactcatctgaggttgaaacctagtgagaagaactgcctattaattagcttattgttactcagagtgtggccttccaactgctttttaagagtccccaaagtgatgaggacaaaagttgaaagtaagcatttagaagcatttctagcaatttgacagtagttttctgtttctaagattggatgttgtgtgtcttttttaaaaaactaattcatttttctaataattcattgttattttacaaaagcgtcagttcctgatgaaaatatttttcaaaagactggtccttggccaggcgtgcactttggaaggataacttgagcccaggagttcgagaccagcctgggcaacatggcgagacccccatatctacaaaaaaaatgttaaaaattagccagccagacatggcggtgcgtgcttatagtcccagctactctggaggcagagatgggaggattgtttgagcccaggaggtcaaggctgcagtgagctgtgattgcactactgcactccagcctgggtgatagagcaagactctgtcgcaaaaaaacaaaaaacaaaaaaaaagttggtccttcacatgggtaagtttgagaacctccaatctggcttacatagcaggattcatttatccatgtttccccaaaagtgtgggctatagtgaactgacttaataaaaaatattaaataaataacacaggtggtatgagaagatgacaaaaatcatgaatcttataccagaatgcttgaagtttgggaaaccttgcttatcttatcaactcatttctatccgttgttacctaattcaaagcaagattttggataaatagaatatagagatgaagaaagggaaaaggtgggttggtggccatcatagaacactgcccttgtgaaacaacataattaagggccctgaacatgagagaagttagcacccagggaggtcagctgtcaaaataaattttgaggcagaacaggaggctactgaaggttgctgacccaaaactgttaagagatccagtgtgacacatcacttaacctctctaggcctcagagttttttcatccttaaaatgaagacagcaggtaatgttaagagctcttttccaggacatccaaagtatgttaagttgaaaacaaacaagttgcagaacaatagaggagaatcccattagcaaaagcaaactgtgtatgcagagagcatttctggaaggacagcagagaaacttttaacaagcatgcttcagcggtgtgttggggctggatggggaggggcattttagagcccacatttatccttctatcagcttgtagggaaggctcttgactgccagggtttgaatcccagctcctcctcaactaactaggtgcctggggcaaatgatttaaactccctatacctcagtttccttgtctgtaaaatggaaataataactcacagggttgataagggctaaatgaagtaatacacataaggtgctgaaaacagtgcctggcacagagtatatgttaactattattatcataagcaagtaatacttcatcatttagttatttcaagatgcttccaactttaccactgcaattctggttagcctacttcagggtttttctgagttcttcctttgcctctaactctgctaataaaaggctgagttaggccaggagcagtagctcgtgcctgtaatcccaactactcaggaggctgaggcaggaggatcacttgagcccaagagttcgaggctgtattgcatgatgatcacacctgtgaatagccacagcactccagcctaggcaacataatgagactctgtctctaaaaaaaaattgttttttaaaggctgggtaaggtattgagccatacatttccccagcttttcctcctgtggccctaactggcaaatctgaaatcatatccctgtcagaagggctggggccagcctagaaaggacctgtgggtttggggcagccagactctccctgagacagacaagacctagccagtttccaagtgtgatagacacaggcacacaggcaggtgcctacatctaagtccatttgctggtctcttagtgtccccaactccctgaaggaacaagatcccaatttcatagtaggtagggatctttcctaggaattctggaaatataagaaaataatcagacatgttaaagcagcatttttgtccattccacaatttccatgagctaagctttcatcagaattaaacatcagaaacacctcatgccaacaggacatgagggaacttttgaagtaatgaaaatattctatatcttgattgtgacggtggtttcacaactgtatatgtttgtcaaaactcatagagctgtaactaaaaagggtgatttcactatatgtaaattacaccttaataaatctgacttaaaaagagaaaaaaagcatctttggcaatatacacagagggaattattttctagaactttagtgggtttaaaaaacatacagctgactctttttgctagagacagtttttcccttgcactggggtagttctaaaagatgggaaaaggaagttattcttcagggtaccctctagtgaatgacgtctggtaatgtcctgcagaatcctcccagacttaaaattcttttctcgtgtctagtcatctcaccctaacctggccctgttagtttcagtcagattgtggtctgaattttcagagactttaatcaaggactgactcttcctcccttaaaaatgaacataatttattgctgcatctgcttccaaacgtctggatcttaaaaagaaagatatggggtctaaaacttgtcgagaatttacaacctatcaccaagaaccttaacaacaagcttcccgtacccaacctttcccagccgagtgttacaatgcatgattttaacccaagagatgactacttgtttgtatggctccctttcaggccaatacagagaagcctaccttgaataagacagagcaggctgggagaaatgctctcctttctgatatcagcaaagggaagaaactaaagaagacggtcaccaatgacagaagtgcaccaatactggacagtaagtaaaaaaaggctatctaccatggagaggaacagtttatggcctaataatcaaccctaccctcaccactcaatttttattttattttattttttggttaacaacagctgcaaagctagcaaaataagggactgtatcactccctgtaggccgcagctttggcttgggttcccctctaatgctgcaagaagccagtataataattctttgtccaagacatacacagcagcaattctctgcattattcacaacactttctggagattaacccattgctcctggcaccacagatgaggaggcagcataaaatatggaaagagccctagccttggaatcaaaagctgtgggttcaagacctggcacatccatcctgtaccatctccaagccttgttttcttcattttaaaatggagatgataatacatgttctattgacctcacaagtttgtcatgagcttcaaatgagataatgcctgtaaaatgttttgttgtctggaaagtgtaattcaagtgtaagatacaattattaggagcttagagagaaagaaaatgaggtcacaacttcagttatcaacccacctaagtctgaggtactttctggaacaaagctacttattaacatttacaacaggacaaaaaataatccatgactagaattctactggcaattaataagtagatcttaagcctgtctcctcacattcctagacccttcctttgcctgccagatgtccccaagattcatcctagactacagatcccatttggacggaacaggaaatagactgaccttccaaaatcaccagatggatctttgtcaacaagtgaataatgaggcagaatctttgcaaagtaaaggattagaagtgcttcagggaactttctgggagaaatacctaatgagtagagaaggaagaagaaggatcagagttaggtggactactggtttgggaggaaaaaggaaaagtgaaagacctagataaggcctttgaatgttgttctgttaccgggcaaagtgctgcgagtgagaatgcactgctttcaaaaaggaactatggccgggcgcagtggctcgcacctgtaattccagcacttttagaggctgaggcgggtggatcacttgaggccaggagttcaagaccagccttgacaacattgtaaaaccccatctctactaaaaatacaaaaattagccaggtgtggtggcacatgcctgtagtcccagctactcgggaggctgaggcacaagaatcacttgaaccaaggaggtggaagttacggtgagctgagattgtgccactgcactccagcctgggcaacagagcaagactctgtctcaaaaaaaaaaaaggaactaaggtatttaactcttgacacagtctgacttgtaagtcaaaatgcccacaaaacgaatgtggttataatatattccctctaatccctcagccctccaagccctccaatagccatctgaatcatggtccctggtatgaggccagaggagctgacctctaggacagaggcctgtggttctcctcactgcaagagggagcctagggctctgttgaaggaggctggacagtctagacctattcctgaatccactagtggaaaccttgaagaattgtattcttcaatgtccacttctcttatttaatggaaatagtgttagtccttctctcttccatgatgtttaataatgtgctttccttgatggaaggaagatacagtccagtgcaggcccttgtccacacactcaactggacacctatactgctgtcacaagctctttgcaagcagcagtgtttatccacagttttgtatctgtttgcatgtgaaacttccctgggctgtatgtcaaaatgttgaccatggttatgtgtgataactcagccctgtcctacagtttaattactgaaaaaataatctgaaagcttaatcctcagctttagcttctctttctgaaagatggacagatgttgcaggttaagaacactaatgggccaggcacagtggctcacacctgtaatcccagcactttgggaggctgaggcaagtcgatcacctgaggctgggatcacctgaggcatggagaaaccccatctctattaaaaatacaaaattagccgggtgtggtggcgcatgcctgtaatcccagctatttggaaggctgaggcaggagaatcgcttgaacccaggaggcagaggttgcagtgagccaagatcgtgccattgtactccagcctgggcaacaagcgtgaaactccatctcaaaaaaacaaaaaaaagaacagtaatgggtgatgtctgatagtgcaggagtccctctaaagtttcagtaccatgtaaacgtgtcctgtgaagtgcagtattccaaaatgtgtcattcatcaatgaatagtgtttgaatgacaagggcgatgttaatagcaaaatttttaaattttatatggaaacaattttgcatacacttctagaaattgttagtcttatatgatttatcctgttaggtgaagtaattcttgtcagttattatcagattatttcttccacagcagagctaccataagcatctcagaaagctccacatctagaaaagatacagaactaacacaaatttatgataaacctaatccagaaaatggaaataaaaatgaataaaagtggaactcagaaagcagataaaataagagattcaaagcatattttctaaaattaaagtagtgtaataaagttatctgctaaaatgttttaagatattaaagaaagtacttttctaagaaaagcatatatttattcaggaaacctcaatgagcaagggaaaagataaaaactttattaaattactttctctccaaaaagttttggagccagattattttattagcaaattctttcaaattttaagaaacagctaattcaaatgctgtataagtcattccccaatatattaagagatggaaggctgtctaataattgtaatgaaattggcatgatcctaatgtcaaaacttgacaaaggcagcacataaaaaaagaaagctgtacattagtggttttcaactgagggtgatttttgcattccaggggatatgtggcaatgtctgaagacatttttagtcactactttgggggacagggagggctgctactgacatctagtgggtagaggccagggatgctgtaaacattctgtaaagaacaggacaggacagccacccacaaaaaagaattatctgtcccaaaatgtttataattaagaaaccctattatggaccacttatcatcatagataagagaacactaaaataccaaaaaacaaatctaaatcaatcagatgttacaagaataattcaccaacaccagggtttatcccccttttttttttttggagacagggtcttgtcttgtcacccaggctggagtaatggtatgaacacagctcactgcatccttgacctcccaagctcaagggatcctcccacctcagcctcccaactagctgggactacaggcatgcaccaccacatttggctcattttttgtagagatgggaatctcaccatattgctcagactggtcctgaactcctgagctcaagcaatccacccgccttggcctcccaaagtgttgggattacaggtgtgagccgttgcacctggcctatcccatttttaatgttagaaagtctatccatcatatcaaataaaaaagaccatcaaaaagcctcagtagatcttgaataggcatttgataaaatttcatgctataataaattcttgtaaacctaaaatagaaggatccacagactgaatatttagaaagggaaaaaacctatttcaaaccaataattcatattaactttgaaatatcagagggattctcattaatatcagaacatgattgcctttagaaacgttaataatttacattgttatggaaatttacccatcaaagtaattacttatataaaacagaaataagacatacaactcttagagaagaggaggctttaaactgtcattatttgaagaccatgtgcatactagaaaatgcaagataatacatttttagtaaattttatttagaaaacatagcaaagtggcttattagatattaaatacaatttcctggtgccaaaaataaccaattacaaaatataacaggaaaaacatccctttcacaatttcagcaaacaaaaatacatttgaagtaaccctaacaaaaagcatgtgtaatgtatatcataaaaactaaaaaactttgccaaaaaatccagaagacataaataaatgggaaaatataccacatctccaaatggaaagtctaaatatcataaaagtatcagttctcccagattaatttgtagatttcatatactatttatcaaaaactcaacatagttttttgggaagaggactttaaataatgtttaagctcataaatacaaacatgcatacatacataaattaagagataatttttttaaagagggtataagcatggcttaaacacaactaatttgcacttctttggacaaataccattgcattagtatcagttttctatgcctttcagagtgataagatactgtggctcaaagacaatggaaagtaacccagaagactagacagaatactcagtaatctttttgtttgtttgtttgtttgcctcccatcaaaatctttcacaattttttgcagataaattcaaaataaaacaagatctttataccctctcaaattgcaaagaatgtttaaattactaaagcctactattgggcttcatgatattaaaaaattaatagcaatctaaagggccatcaaatgagtagttaaataaattttaatgtaatacattcatgttctacaatacaatagaatcctttaaactcatgttttcaaagagtatgacacaagaagtgctaacaaagtgttaaatgaaaaaagcaggcttaatactgcttagtgaatttgttcttaattttaagaaaaaacacataaaatgaaaaatactgatgggaaaaagtataactcaattgtggatatttgcttagtgttttttttttttttttttttgctggagtgcagtggtgcaatcatagctcactgcagcctcagtgggttcaagtgatcctctcactcagcctcttaagtagctgggactacaggtgtgcaccaccatgcctggctacattttgttgttgttgtttattttcgtagagacgaggtctcactttgttgcccagggtggtctcaaacttctggggcctaagctatcctccagtctcagcctcccaaagtgctggtattataggtgtgagccactgtgcctagcctggatatttgtatatttgtgaaattatgagatattttattttcttttctttttaactctttcctttcttctcgccttttatggcatctcctcctcccttgcgaccctctttctttgaagatcctttttactgagacagggtctcactgtcacccaggctggagtgcagtggcacagtcttggctccctgcagtcttgacctccctggctcaagcgatcctcccacctcagcctcccaaagtgctgagattacatgtgtgagccactgcacccagcctgaagatccttctatttgccaaatcttaggatacggaacaaacagatactgacccatgtggcagccagtcaagtggggagtgtggggacaaatcatcctttattttcgtttcttccaccactgggcttgggactgcctggagcgggcagttctgactgagctgagggaactcttaaaatcctgcattttaatgaagaaatcccagttgtccactggaggccgagagccggccagctccctgttgtactgttgttttatggtttacctgggccagaccagggggcatagtctgtcgggtgtctcttcttctacagaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatggtaaggagagtttccctgtctctgagtgactgaagacaaggcagagtttggcagtttggaggctggtcatagcctctaaggctcttcgcccttattaaaatattgtacattgttttaaatattaccactgttttataagagactcaatttaggctttattattattattaaccaggatcagacagctacacagaactatgaaattttcacccagtgtctttgggggtaacctgtacattttttttttttttacttttctaaagggttagctggagtgggaagaaaagggaggagcaaatagaacttgctggccctggaaatctgcctggtgacctgacagattcagctttctttgtgaggtagcccagctgtctagtagagtaaatacttgtgagccgcttttcaaacacgatggagcacatcttgtggaatatgattacaaatctcactaaatctgaaaaagtgttttgcatgacagatatttggtatttcagtgccagtggttctcaggagtctctgcagggagccatggacatgagtccttcaggattgtctatgaacctgatggtagaaaaaaactgaacttgctcatgaatgcctagataaaaaactttgcagagggcatgaggctctctcccagctactacagaaactcaagaaattttaccataaaactgcttttgtaatgttgatcatgttataataattttcatttttagaccttttataagatgtcccctgggaaagaatgaaactctcacatttacatgaatatggaatcactgaatcctcagggttagcctactattttatcactgaatggtccaaatctagagagaaactcagtcacatgagaggttctatcttgccagaccaccatttaaatttgaatttaaatttatttaaaactcaccaaaaggatttaaggcagctgataaatgtatacatttagtactttaacaacaggtgaagaaattaaggcaaaagacaaagaaaaataaaataataaaatgggccaggcatggtggctcacacctataattccagcactttcacaggtcaaggcaggcagatggctgaagcccaaaaattcaagaacagcctgggcaacatggcaaaatcctgtctctactaaaaaaaaacaaaaagtcagtgggcatggtggctcttgcctgtagtcgcagctacccaggaggcggaggtgggaggattgcctgagcccaggaagttgaagctgcaatgagccgtgattgcaccactgcactccagcctgggcaacagaggaggcactgtctcaaaaaaaaaaaaaaaaagaagaagaaagttctctcttaagttcatgatactccactgtatacatctgtccaaatgcttcttcctgtgccttagataaaatcggaaccccttctgtcctgcagggctccttgtgactaacccctgctggccactcaggctccacttcccatggatctctcccattctcactgtgccccgggcacatgggcccgtttttgaacttgaagctctttcccacctcagggcctctgcacctgctggccaaccctgcccaaagtgctggtcttcctcatctttccgtggctgactccttcttgtcaggcctcagctcacatgtcacattctcagaagagctgtccccagccactccatgtaccctggcctcgccaagcactcttgatctcatcggcctattttagtgtctttttagtacatataattatctgaaagtatttatttcctggtttattgtttatctccccccacaagaatgtaaactacaggaatgcagaatcttttctattctgtttactcctctgtctctagtctctagattaatggcaggcgcatagcaagtgctcaaaattatttggtacacttattaactcataaatgggtagattttttttttttttttttcagaattaccttgagttccaagagattctgggatggtggtttgaaattttccatctctttggttccccctttagtttctcccttgttgaaccagagcagttatgggattattctgtcctgccaatactgaagcagaggttgacgtggtaccaaaaaaaagttgtgtagttgcctgcttctttgtagatgaattccatccactggtgtcaactcttacaattaaactttactgatggttctttttcctttcttagttttttcttattgcagtcataactcttttcttataatttccccttacatttttccactttttttggggcatttctcttcatagggactagataagccctcacatttggagatttacattgggataattaattttttcacctaagacagctgacttagtttcaaaactgagaggtacaagggctgggagacagagatggtgatgaggaaaaatgaaaatcatgattctaccaatgccatcttgttcttgtcctctcataatgaataggcatctcaccagaactctcgcccacttcatcctggctcttgcctatacataatgctaagagatatttgcagaatccttttgaaagctcataggctgtagaagttgggactcgcaggtaaatagagctatggtcgattttctgctcccaagaaggaccaacaaaacccaatttatataaataatagtttcctgtattttatagccctctgaggaagggacttccagtcactgggaacagactctagctctctgatttcttcagggttcctgatttcctaactgatgtttgttttcctgttcttcagattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggtatgacaagacgtggagtgagttgcttccaaaacccagcctgcccaaatgtaccaataatcctgtcagtcaagatagtctaacaaaagcaggcataagtaaactcagactgctttgtgcttttaagtggcacacgacacgtgtgatcgtgacctcgtgtaaaccccgggggaaagtgggaccaatatttctgttggtgttttagagatgaggacactgagtagctaataaagttaaatggtcacgagctagttaataaagaagaggcaagaactttcatcttccatctctgaagtgtacttgccagtccactaccctgcctccctagagagaatttcggcggtcttaattgggaaaataagtccccacctcccgcaggagggctctgttattccaacaagaggggaagttcttcaagagctaatgaacttctcctgtacttctctcttcattcgccaggctttgaggccatttccctattcattaaagactaatgtttaaaaagtccattttgctctttgtaatctctggtacataaatcccttggagaatcaaataaaggtatagactatctttacaaaaatactcaggcataaactcaaaatttgcctgctgtcacatggcttgaagagcctgctgaagcccatctgagacccttccaatgcccccatccacagttgagaaaccttgatctgagggacaaactttcagagtatgaaaggaaatgtgaggattgcctagagtttgccctctccgaattataataggcatttttagtagaatatgctcacttgatgcgttttatagtggttatggatgaactcagtagaaccacccacttttaaaattgaatctcatcgtacagaccttattatgtctggaaatggggcatttttttcctttacgcagagataagagacctttgaccctgtgacctcaggaacctcataatcaccattctttaaacttgctcacgtactggaatcatctgcggagctttaaaaaccaccaatgcctgggtcccttcccggagtctctggcataattggtctggggtgcagactgggaatcaggatatttaaaagctccctggtgattatagtgtgcagcagaatgtgagaaccacaccttgaaaccattgtgccatggccctaccaaatggatgagtcagcagattaaatcttccccaaaatatgacaggcattgacatataacatttattatttcttttgattacgtaagtcatacttgtttattatagaaatactgaaaaatataaagaaaattaaaattaatccttctaccaccactatccagaaataatcattgataacattcttttaatgtgtcctttcagtctttttaaaatgcatgtttttacaaacttggtatcccactacatatattgtttgctaatttgctttttatttaacagtatctcattaatgtttgctgatatgattattctacagcctgacttgtaacagctacctaatattaaatcctacaaatgtaccttgatttatttaaccaatcccctcacttggtcatatgggccatctctagatttttcctgttgcagataatgcagtgatatatttttgtagcaaaatatgtgtacacatctctgtatttcctttggattaattcctataagtggaatatctgggtcagtgagtgtgcatagtaaactatggatttcaataggtactgccaaattgccttccaggaatttcctaccaatttacattcccacaaggagcatatgagagttcatcaaaggccctgtgtattctgagttgtttggcttcagtgttatggggagtgggccttggaatctaatagatttggagtcagatcctggctcctccactcagtcttctgatgagcttttcaagcttccaaaacctctgaggccttgtctcctatccctgtacctctcagagttgttataagaattaaatgagacaagcatgtatagtggttatcttatttcctggcatatagttatattcaataaatgatcatttctgttattctgccagtggaaaatagaaatctgttttcttttctattgtgcctgccaggatttggagcagggtgccacaaggttggagagttaggaacatgaacatgaccatttactttaaaaagaaaatgagatgaagttacgtagtacagggccccataatattggaagttgagtttgcatgtagtgacagttgtgtggtggtatcaccaatgaagttaaaaccacagcaaatgagacacttttcctcagtaaatcaactcttgctgcctgggactccagcaatgacaagcagatagggtaataaataaccactcccaggtgaggcactgaagactccttgagagaccaatcagggctgggcagtgcctcccacctctgtaaaatgttggagccaagactttctgtcagggatatctgcagtgggcaggttgttcagtttaaggttcctaattggattctgaatctatagctaataagatatttatttatagcaccttaagacattgtattcacataaaatgtcagcatcttacaagcggaacacactgctgaagagcaggcataattactaaggccattttgatttacattggaaaatgctcaagtttttggttttgttttttttaatttacttactactcaaatagcccctgcatttggaggataggaaaagcaagatggttttcttttgtattatcaaaaaaatttccttgaatttttcttagaaacttaaaaacttatggttataccatactgctacatttttttaaaaaatggtttcaagtacttacatagtattttttatttgcattttcactagtttttcctggcagcagtgctgtgagacaggtgaccatctggcactcttttacagctaggaaaccaagttccatagggtaccagcttgctcagggtcaagattcacattagcatttatagccatggatgttgattagctgtttgtcactccctgtgtttatctgcctccccaaagaggaagaaccaagaagaaactcttactgctctcaggatgactggtatttggtttcctgatgccacttctgcctggaaacagatcatatacatcacagaaacatgcttctgtaattaacaacaaaactatgcatttaaagaactttgttcttctgaagacctaaaataatttcataactatcttattctttttaaaaaaattctttcatcatgtcacagtaattagttcaatagctctttaaaggattataaaatgtttttttaaatatacggttgtccgtgtaaacagattttcacctgttttcaatttcactgtgccatctccaatctgagtgctaattcaaagccaaaacacccatttagctatcagtatgcacttgttttgcatatacatgtgtacacatgtgcaatttttgtgtttctgtgtgtttactcatttctcagccaaatatcctagaaaatcaccctaattaaagggcatgtgtccagcaagtcctcatcagctgtacaccaatggtgaccacggtaatggaatgtggatgtaaggttctgcactaagtgtctttttttgctccaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaaggtgaggtgtggtcccagctccctgggctatagggcagcaactaaatggtaaatctgtttgtatatgtggtttgcttgtttgcgtttaatttcttgttccatcattatcacactccattgcactgatctaactatctaaccattctaaggcccaccatgatttcaaattaaaaatagtaatcccccttccccacttcccaaaaaggcggatcatttttccctgatctgttctttgtttgggtctcattttagttaactttccagagattccaggattctgaaaagaatctttttatagcttcttattatgtacatttctaaacagttcactgtaggtaagaggcctgacggcctgcagatactaagttgcctatctctgccattgttatcaatggggaaaaaggtgtcccataccttagcccccagctcctaagagggactggctggatcctaatcactctcactaaaaccactttgctttgatttgcaggcctgtatatatgtcagtgtactaattcgtgacctttgtagcacttccagcttttctgtaaacttctaggcataaaaactagcactgatgtctgtggttctctctttcattctgtgcctttcgttacgtaagtcttcatagcacattgtctgtcactgaagatactgcttgtttctcttcccagatgagtgggaaagcagattctacttccatccgatttccgatttgccacctccagagccatatgtacaaacgaccaaaagttatcccagcaaactggcaagaaacgaaagccggagtgagtatttctgccaaggtttttgaagattcacgcttgagtagcctgagtgacactcgggctatatagaaagtccaggcttcttgcctggagtggggtagagaaccctttggagccatctacattctagtaaattccccttccacaggcagtgaggaaattgcagatgcccagaatgcatatgagaaacagttattttaatgtgtcattacaagctcaaaataccgtggtttgctagtattaaattttattattttacttctttggacgtcttcctctgttttcatcttcctgagacagcacaagtagagccatcttctattccttctagttttgaaattggcataatgtctgattaattataacaaaaactccctttaactgccttgatcttttaaacgtattgtaatcatagctttacagagcattacatgaaaatgtaaatatatccataatctctccacataatagatattttcattttaccagattctcatccaattttttatccatataattctgtttttttatgtagttataatgacgatgtacagttttttggcggggtttacataacattgcttagtaaatagtgcccatgttatcacatggtttttatttcagcatatagtaatttaccattaccatggacatttaaattatttctgttgttctgctaatgtaggtaatgctaccataaagaactaaattgcttttcctccattgaagaagaatgtcaacaagaaaggaaaaatagacaaactggaattttataacagtaaatgtataggaagtgttacagctctttgagaatttgtctagcaggctttccagggttttgctggaaagcctctgaaatttacttttaaaaaaacacaatagctgggcatggtggctcacgcctgtaatcccagcactttgggaggctgaggtgggcggatcacgaggtcaggagttcgagaccagcctgaccaacatggtgaaaccccatctctactaaaaatataaaaatacaaaaattagctgggcatggtggtgtgtgcctgtaatcccagctactcaggaggctgaggcaggagaatcactagaacccgggatgcagaggttgcactgagctgagattgcgccattgcactccagcctgggcgacagagcgagacttcatctcaaaaaaaataaaaataaaaaaaaatgtatacaacgaagaaagaattagcatgaaatatgcatatgtcatccatgaggctgaggttcgtggcagccttagcctcagagccaaattcccaaaccagaaatagagaaaacttaagcaaacaagtcaaatatgtcacaacacccctagcgatggccccactccctaacagagcaccttacatgtactcaaagcctactgattctttcctaacacagtttaaagtaatttttggttggttggttccaaaccttataggagattaataacagctaaagttaagactggtgagaagcaaaatcactgacatgggagagaagtgacagatggcagtcccaggtcagaggaggagacaggaacatggctgtgctgtgtgtcacagcgcaggacaacaccagatgtttctgttgggttgaatttctattgggttaaatggaattaaattaattgagtcaaactgtgctttgtgcctctgtagaaaaatttaaagagttagaaaatataggaaaatttccatggacaaatgctagaagaaaacagaatactactgcttaaaaggaaaactttaattcctgaaaagatttgtttctgtggaagactgcattcatagacaatacctaatgaagaagtatagctataataaaattattatacaagagttgatgattgaaatttttagtgaaggccaggcacggtggctcacgcctgtaatcccagcactttgggaggctgaggtgggcagatcacctgaggtcaggagttcgagactagcctgaccaacatggagaaaacctgtctctactaaaaatacaaaattagccgggcataggggcgcatgcgtgtaatcccagctactcaggaggctgaggcaggagaattgcttgaactcaggaggtggaggttgcggtgagcagaagtcgccattgcacttgagcctgggcaacgagagcgaaactccatctcaaaaaaaaaaaaaaagtgttagtgaaaagtaagttttcacatgggacagatatctttgaatggtgtgtgtgtgtgtgtgtgtgtgtgtgtgtgtgtgtgcaccagaagaagggcttctgtttgataagagtacagcccttcttccttcttgggcaccaataaatgaattgactttaaggagttgttcatatagactccaaatatttttcctaacttattatttgcttcttattctaaatattatttctatttttaaattggtaatagaccatcttccctgtaccctctagatctttaatggaatagctaagcatatatcttctcccatcctcctttaagacttgagtaggcaatgtaaggactagaactgtgtcctgctcactattgcaccttccttgaggggcacagagcctgaaacataaagggcattttcaagtatttctttttaaaaattttcttatagagacaggatatctctatgtcacccaggctggtcttgagcttctggcctcaagtagtcccctgccttaacctcccaaagcactggattataggcatgagctaccatgcctcgcctaaaagtagtttttaaattggtgaattaatttccacagtctaccaaaatttttttgtagatttgccttaaatatttccagcattaggcatgtttaatattttataatgataatggatcatctaacaaaaataaataaggcaccgtcgagtaccaagttttcctctgctctgcagcagcctcagcctccaagcccacagcctgagagcgcacccagacagccctgagcagtaccgaatgcacttggagtgccctctaattacagctttggacaaggccagccctcattctactaaccacttgtggcgggtcagttgatggtcaaggccccatgataggtgtctggtttacatccagatgagtcttttctcagatgcctgcccaagaaaatatttggttgggatggtgagaggaagaggtgcttctttcagtgttttctcctaactcccttccttgctcagaaatttggttctttctcagaaatccctaagtggaccagtagggtccctatcaagatgcctacttgaggaatctgccagttccagcccactgagtctcagagcagtggttagagcagacctacctgattgacacatgccccagttagacctgttcacaacatctgagcacctgacctcatgccaaacacctgttaaatcctcaacaaatgtttgtgtagtaaatgaattttttttatgtgaatgggttttaagcctagttacagtggactgatagcccatgaatagcttggttttggtttttattttgtttttgagacagggtctcactctgtcacccaggctggagtgcagtggcgcaatcttggctcattgcagcctcgacctctcaggttcaggtgatcctcccaccacagcctcccaggtagctgggactatgggacaggcgcacaccaacatgcccggctaatttttgtggagacagggttttgctatgttgcccagactggtctcaaactcctgagctcaagccatcatccctcctcaacctctcaaagtgctggggttacaggcgtgagccactgcaactgggccgtgaataacttttaaaagaacacatcgacagagtacttgaaaaggtgttcaacatcactaacttttatgaaactgcaaataaaactatagtgagatacaactttacacccattagaatggctactgtcagaaaagctttctaatttttaattagaagatacctaaatgcccaacaaaagggaattgactaggtagactgtagtgtagtcatattttggaatgcagactgtcattaataatctttgcaaagagtaatgcctttgaaagatgttcaaactgactatatgatcttatttctggaagaaaacggggaactgtttctaagtaaaaaatatacacataattggttatctctgggtgctggaggaatgggtgagttctttgtttttactcatccatattttctaaatctataataagcacacactgtgataagaagaaaatgattttttttaactttgtgcaagtacttgggagccagtgatggatcacccaccatgatgtttattcagaacattacttgcttgttttcacctctcacttctcatccacaacatacgccagttagctgacagccctggtcatagggatgaggtagtgggtacccgtgcaaccatccccgagtttccacgatgagaacatcagctttctaaccaaaattatattttgtctgttttttcaccaaggtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataaggtataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagt

SEQ ID NO: 17154 - DNA, 25769 bp, Human
gtctcccgtcctcattttcagagcaacattaggagcataatcagagtttaaacttggaagtggctatctcaggaaccttcaggatataagtgttttgtacagaaaaagagaaaagcagcatttggattcagagggcgagttttcattgtgtagcattagagctatcttttaactggttaatggcatctgtttcttgtagtaagagagaaatgggacattcgaaagcacctttggggcatgactaggtagggagaaatctggtgggggcgagggggacctaaagaactacagaaagccagctctgtgccgtgtgtcgtcccctttctttaatattccagtatacattaatcatacatgttagtaggaaactttccaagcagcacagtagtgcttgaaaaggggaagtattacacatttctttttgttttgtcatacaaaagcattttttaaaagcccccaaaactactgtcttagtttcatagatactataatgtacacaaaaagaatataatccctaataaaggattcctttacattgattacatttagcttcgtgaaaattttagcatttctttttttactttaggccattaaaaaaattctggcgactatacttaggaacctctgcaaaaggggcatggcccaacaaaagcaattttctcgcttcctttgtaagaacctaggtgactcgggtaatgaatagcatttcgatatgggaaacccgtggctcttcaaggaaggtcacctaatcccgtgggactcccctttccttatctgtaaatgactagatgattcatccattctatcattcagaaaattatgaacatccattatgcccaggcattacgctcagcattacagctcttaacaaatttatcattttatagtctttatcagtcaactcacatttattagttgttatataccaggctgtgaactagattgagatgcaaaatgaatacaatttaaggtgtgctaaataaaggctaacgggcatgtgggtgaaagagggaatcgctcttacagggttttagggtgaggcttcatagatgtgacatttgggagcaaggacatgccaggcacagcaagtcgtcggcagtgctaaactggaacccaggcggctggtggggcgacccagtgtgaaggaagcgggatctcgaaggtgaggtgctgtccgggcttttcagccgaacggacggtaactcatccagtccgcagcaccgaggatgggcgaggcgagcccagggaacagactcccgcgaagctcggggcggaaggtgtctgggctagggctggagcagtgcaatgggaaggagagggcggattccggacaattttgaggcagaatgatagcaaaaggcccgtgaatgcgtgacgagctccacagaagagctgacttgtttttccagagttgcagcactccctcgtctcctcccaccctcctcgtcagccgtcacacttcacacttcctctctggggacacagagaatcattagagctcgaacgtggctcttcgctgtccggaacttccctgccccgcaccacccgctaggctaaggacgctgcagaatcccgtcctcctatcattaaacaagcaggacagccgcccgcgcgcgtcccggaggcacctgcaagagcgcgcgggcgcgcgggcgctcgggcccggcaaacgccgcttccgggtcacgtggcccggcttccggttcgcacctcccctcagcgaagaaacctccaatcggctgccttggactcagcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccgtaagtccctgggggcgaaagggggcgccggggatgggggagagggggagggaggactgggcgcgccccccgccaccccgcgcgcgccccgacgaccccaccccgagcctgcccggcccgccactgggtcgccgcgcccgcaactcacttctctccgtgtccgcgccctccgcaccactccgcgccgcgcccggggatgtgggggccagtcccgggctccgcgacagcctcgcggcacctgtggttcgggaatcgcctcaagttttgcggggcgctttcgggaggggccgggggcggtggcggccgaggactcttggcgccccctgcgcggcggcggatgccattgtctgctccgctccttgcctgtcacctctcccgggcttggtcagtgatggagtgtggccacgggagtgggggggaggcaccggcgacggccggacccgaggaacgctggccccgagcccgcgccgcggctgagcccattgtttttaatgccagtctcgaggaattgtggtgccctgtgatttgcggcaaaatcaaagcgttggtttttaacacgagggaaggaatactcgtgctttgcaaccgggtttcgtcccatgttaggacataatttattttaaggagaatacattgttttttcgtcctgcaaagtggtagggcggatacaggaccctgctccagacagccttgagcccatactcttcgcaggcaaaccctcaccctttctggtcaccaagatctaggaatacgaggtccattcttttccaagttctggtaacgggtttgcagtaaatgcccagttgatgcttcacttcctgcccccttcgaatgccgctatcttcaggacttgcacgggaggcactttggtatcacctaataatgtccttatattttgttcccctgacgcattttaagtgaggtaataagaccattttaactttactaaagttgaattgccacgtcatacatttctagatatcttgttgatacctttttgggtggttacaaaaagcgacgataatttcttaccgaaatttagggcccatttttattctacattggttctgtaaatttcccctccccgtgttcaaattcaagatggtgtggtgaatcttgagaatcatgcttgaatcttatttgcagtaacgctgttaaaggaacttaacagtgattaaaagaaaaaaggatacctatgtgaattctgcctttaaattacctttgtagaaacaatacttctgtttgcagttgagatgaccaattggattacaaaaagcttggcgttaaaaatgaaacatgcagactaatcaacacatttgcagatcacaaataaatacatacaaattagtttaagtataaaacacactagaattcagcatccattccatctgtagatactattttttattttaaatgaagtatttcatgtaatgtttcaatgctgaatcttatttaataagtgtaaatcttattgtggccttttaaacgtttgttttctttttcataatacattaactcagttctagattttgtacatatttaagttggaatgctttaaaagtcagatgaaaacatacttttttattaatgaaaatttgtatttatgggatttttcagttaatattttggatcattctgttttgcttaaaatatgccatcataaactgaggagaacattccaagacataagctactgtctgcaagtaattcaccctggaactagaacggcctcaggatgaaaaatagcaggtcttctgtttctttcaaaagtacccaaaccagatgatgtctaccattctcttttgatgcatatagagagtgcgcaatgtatagcacaggtagaaaatagtttcttaaattgaaagagtgatctttatttttcttcaaaaatttcacttcagcttattacccatttttcttttttctcctgcacactccccttcaaacttaatgtggaacaaggtgggattggaaggtttgcatctagaggaagatctgtccaaaagaatttcttgctattttaattggcatagaaatattgatggctactaatcatttgtcatgtaaatgccccatcccccaaaacttctctgtgaaacacataatcttaactttattgattcaaagtattacatgtaatcttgattttatttatcttaacagatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaaggtataatttttgtttgtcagaaaggtgaaatagaatcaaatgttaggtcatttaggaaattgcagacttcagtgatgacatttataaataacgattaataaagatttagatgaaataggtttaaggtaaagctttgtgtttttaaaataactagtgttttgattgataattactgaggctgaaatgataaaggcagggaaatcctttgaaaactagttatataattaaaggcataaatgattattcatgcttaatcatctttatagaagagtttaatgaattcatttcattgcaggggaaagtagggtcagtattttaaattgtgtgagtaattctctgaatttagacaagtacagatagagtctaattctttttccccgaaaatctataaagtaatgactaatatttgacatgccttttatctgatttttagaatcttactcacgtgtaaataccttgactatgtagactatttcaatcacatagatgttttaaaaactttgtgtatacatgagatgtgtttgtaagtagtgtttattaacttttaagtacccttgttgctatggtgggggtgcaattaaatatgacagataatttttccaaggacagattttttaaaaatttgatgttacaaaatgactcatagattggcttttaacactaaaatttttttaatgctatacgtctttattttataaatatctgaaaccctgaataccctaaaataaatttctcaagattgttctaagtaggttaaaagaaataaactttcttcttttacagaacattttttgaggggacatttacttcattccccatttgtttctttttgaataatttgctgaatttaagataagagcatttctgcatataaaaagttctcttgtgtggggagtatacatggaagtaacagtatgggatacaatgagggtgggagagaagtctggttttcttctcagcttccctttattgcactccaaatatgggttggatattttgtcagggagatggctgggaagaaatggagattacaagacataagtttcttaaatactgaggactcctctttattattgaatgatctttggtgattttgtatctttgggtgattttgtatccagtgtttcgtttggtcttattaaagattatagaaaagtcatatcatttgagaggtgagagatgttttacagtgatctagtcaggtgattttgttttgttttgttttgttttaagctttttgccccatgggtagaaccttaaataaaatgagtggaagtgaggctgctccttgtgaaatcaggaatgaggatcctgtatcctggctcacttggcctttacccctctgcacaggagacagttcttgagtttgaaaactgccgttgttgatcaaacttcaattttataaagaatgcaaatttgggagaagtgacttgtctagggccatatgccagttagtgattgacatggggctgcaactcagatcttaagcttagaggcaaagattttaaacagggctggaaaaagatcaggtttacatatcttaaaagattgaactgagacaatggatgagggcaggaggggctgagactggcacctgcaggatcagtaggagactatgtgagatcctgaacccaggcgctagaaaggagggctgtcactaaatagccattatcaaataggtaggtttgataagacttggtcacctctagaagtgggaagaatatgggaggtcgaggcaggagaatcgcttgagcccaggagttcaagtccagccctggcaacttagtgagaccccgccgtctctacaattaaaaaaaaaaaaaaaaattagctgggcgtggtggcatgcacctgtattcctagctgctctggaggctgaggtgggaggattgattgtgcctgggagttcaagcctgcactgagccctgattgggccactgcactccagcctaggtgacagagtgagaccctcaacgacaacaacaaagcggagagagcagcgaaggaaagggaggagtggggtgatctccacatttctggtttgctgatggggtacaaggtgagctagataactcggcttattttggggtgagttgatttggggatgtctatgtgactttcattaagagaagcctgattttctggtgggatgtggttggtgtaagtatggaagtctggggaaaataagacaaagtattagatcaccagcattcaagtggcaggcaaaggagatgaagaagggaccttcagagtggaatgagaaatttcaccaatgccagatgttgcataaagttcaatgaaagtgaggaaggaatctggtagattttacagtgagcatttcatataatgccctttgccagaacattttcagtggaatagtggagatagaactctcgatgtaatggggcgaagtgtgaagaggtggagaaatttaaatagcatgtgtagactattttggggaactttgctgtgaaggacaggagacgaggtggtaaccactcatagacataggagtgggggacaaggtttttaaaaaagaaggtgtgagaggcttaagcttatttctagataggggaaggagtcccccgtgtggaggaggaaaataccagcaagggattcaatcccaggaatgggctgttatgggaagaaaggaaagcactgcttggtgttcatgcacatgtcactcagtctgtccgtgttgagccactactttttcttttgaaagctacaaagggtatctaatccaactctgatacttatatcaagcacctttaaataaaaggtggactttaaaaaaaacagctttattgagatatcagtcatatacaaaaggtggaatttatcagttctttctctatacgttcccccttccatttcatactgaaaacctcatctactctaccacttacggacatattttttgttggtataaacaggtggtttgttttccctactgctggaagcgaagagctttttaagcaggagaattactgcttagcgcctgagaaattctggactgggacttctgctgttcatatcagcaagtgatttttgttgtttttgttaaattatctcatctacattcttcatcctgagtatttggcatacaaattcccccttttgagaggggaatgatggataagaataatattagctgaaaagacagactgaaaatctggggacttaagttctgttccctttgtaacgttagctagttttatgactttaaacaagtcactttgtttccttatctctaaatgctcttgaagatcccttcaagacagaatactgtgcttttttgattcctgttttgtgtagcattttgtggaagagtcactggattaaggtcttttaaaattaatttaaaaacatatatatctccaaattactagcttgataatttgttaaagaatacttactgattttctttactaacaaaagaatttttaatgacataccagtgggtattgagaacacttcagctacattcacccacagtcagctgatatttagctgatatttagctgactgcggagaagtcatgtgttttgaatataagaataggcactttcagatgttctctgagtgccagtaattagagtaagccttaatccactgtgctaaaaataaccaaacatacctttcttcttactagtctattattaattttacttcagatttagacttacaaataggcactaagagaacaaaatgagctcattattgatttttttaaaaccatttggtcctaaatataggaagtacacttcaggttctcttggtaatcttttactaaatcagtatggcatattttacttctcttcaaagctcttaaaatattgtttcgagcacattttaatttttgccaggtatgggattacgttaatgcaattgctggctatagtttttaatgtaaaacttgggctctagagtcaaattgctgttcctaggcaggttactcaaacctgggtctcttatcaatgcaaataataatggtatctcatggatacggttgttgtgaggattagagtggtaaaatatgcaaaagccttagctaacatttaatgtctcatgtagggcgaggattcagtgaatggtacttaattattatgtttctgtttttttcctgccctaagctttctggaaagaggtacattattatcctgatagctatctgttcacctacaccaaagaattcattaatttgattattctttttccattccgagtgaaagtaaacattactggctggggcttagacacattgtttctgatgatttttaaattaatgcttccaagtgattcatgcagtttaggacctttgactagtgtttaagtgctttttatttgtaagtaaagaggcagtactgtggataaggagcgaggatggtacgagcattagcttgtttaatagtagcatgaggaaatcttaaataaaaggaattttacttgaaactgttagtaaactttgtataataaattatttagcattctgttcctatcagctagtcatatctggtttttaatctaccatttttatgtcagtccctttaatgtttagttttcttaaatcagggaatcttatgtgtcatttatcagtttcctcaaattcaaagttctatttaatgagcatgggttagggaggatggagagttggaatactctattctcttttaaatagacaaacaaaaacagtaacgatgggaaagagagggagcactttgttaaagttggcattgatgccctgttttgtcttccatgacttattcccttcacaatgatgataaatgaacacatgtgaatacctcctctcaataagactgcagtagctccaccattttaaataacttactgagtgtggaagtcaggtagagtagacatgcacaaactcatgatatatatgccaagtgagtttgtatgatacagtggaaaaaggcctggagttaaggtcaaaagatcaggtttcttatcccagtactagcacttgtaggcgctgtactcttaagcctcatttttttttttgtctttttttaatctgtgatcaaggatgaaagatagtacttgctgttgaaaacatcaaataagatgaaatggttttaataatgaaattaatgctgttgtgtgaatactagttattttcatactaaggagcaagaattcattgagtctcaaaacaggttgtgttattctgtatacagtattattttacattaatgctacgagcagtaactgcccattgtgttttctaaaaatcatttaagtgatcttcagtgaaaattataatctccactgaaatgttctgtgtttagcctatcttaggtttttattttctttcttttcaaaagccttaagtacatgtaaaccattttaaaatgcccttttaatcctcctcaaaggacttgctatgcctcagggttgaagttttgcttccttgggtcaagcataacatgattccatatgctagaatcctaatttgaaggagaatataagtttcccaaccttattccctcttctagggtaaataaactacacttcagttcaacagtgtagaacttggtaaatttgagaacaggcctctgtttcccttaagtgataggaactttctgttctctttctctaacttctgtaataacgtggagctgttgttcttttcgtatggtttattctgcaatcctagaaacctttttaaaaacaattctattctgttagaagtcaagagcatagttacccttgggggtgggaggttgtgactgggagagggtagcagaggagtttcagggttcagtagtgttcagcttcttgatgtgggtgctgatatatagttgagttcactttgaaaatttattgagcttgtaggacttaaggtcttctctgtgtatatattatacatattccaataaaatatcccaaaatattgacctcaccttggcattatcctcaacaagtcctccttcagttggaaggtttgttttcttctctgtacttacagtttgaattaatctgctatatattttgttttaattaagtaaacttaggaaaaacctgggtctgctatgttttaaaatgcttatagaaaagaacctgaaaggaagaagggcaaaatcacttattctaagtggtatgattattttgattttttctttatacttgcctatgcttttcaaaatttctgttatgcgtttattacttttgtagtctatgagaaaaatctgtactgtcgtgaaagaagaaataaactgtataaacttggggcttttcataataggatatgaaaatatatttagaaaacatcattataggataacagtttttttcacatttgtactttgttacagatatgctagtctgtatttttgctgtgctattgaggatcaggacaatgaactaattaccctggaaataattcatcgttatgtggaattacttgacaagtatttcggcagtgtgagtagtattttattttaggaaattgaatgccatagtatattttggaaccttttctctaacaagtttattatttggttgtcttggggattctaaccgcgggagagggtgggaatgactatttattagtagaaattattaagttgtccatattgggaacatgcagagcccagtcttatttagcttgtaggaatatgttttcaagtacttgagatttggaaattaagcttacttaaaccagtgatacttagtcatttttagaaagagttaagattgattcactctagttcgattttattcactacctgatagtgaataagcatcttctgcttctgcaagttttaacaattttttcttttcttttttcttttttttttccttttcaggtctgtgaactagatatcatctttaattttgagaaggcttattttattttggatgagtttcttttgggaggggaagttcaggaaacatccaagaaaaatgtccttaaagcaattgagcaggctgatctactgcaggaggtaagctacttattctcttcactaggcactagcatgttttgctcttgctggggaagtctcattcatcattcttacagtttcagaaagtactctgaagcatgcttgtcatgtagtgtccatccatgtgcagtttattgactggaatatgtgtcagtcacgtcaactcagttatctatggatggatggttcagtttggagatggtctatcggtcaggcctcttcccaatggccctttttggaccctaaaacactggagtctaaacctttagaggacagactatttgaagaagggaaaagattggctgaaagtagcagtaagttgagaactctccatctattgcttcaaattgtttaagataaccccctttttcattagtgtagataatcaggagttgactatgagattatgacattttaattccaaattggctcatatttttacctcatgtccattaaatgcaaaagtagccaagcaaatgatagtgttttctaattatactttttgtagaaacttccaggttttttttgttagcaaaactaaacagtatttgcatttctctttgctcttcttaaataacaaaccatgttctgtcaaactgcattcttgtcttacctccatatccccagatgtgtaactcccttttctttctaattaccatagtcatcttgggttaattgtgcagttgatgctgatgtaccttctatttctgaagcttaacatttcatagataaggctacctttttccaaaaacttaatgataccttaattcagataccaaattgaattatgctttagagctaattgtgatttttatcatatggaaagcttacagcatgagaagtgattagtaaatattgaaaaatgaaatgtgttttcactaaagtagttgttaagtgtgtgtttgcatgtatgtaaaagtcttgaatatttttggctcactggttcattttccagaagcattgaaaatatgattttgtatttccagtttattttagtcccttctttgttacatacatgtttatcagtttgttcttgtctttttttagtcaccaaaggtgactttcagtcccattttttagccttggaggcattcagttttaagggagtgaaataaggggagaagagtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaattttaatatttttcctggagagtaattttttgtttgtttgtttgagatggagtttcgctcttgttgcccaggctggagtgcaatgacacgatcttggctcactgcaacctctgcctcccgggctcaagcgattctcctgcctcagcctcccgagtagctgggattacaggcttgcactaccatgcctggctagttttgtacttttagtagagacagggtttcaccatgttggtcaggctggtctcgaactcctgacctcaaatgatccgtcccccttggcctcccaaagtgctgggattaaaggtgtaagccactgcacccagctgtgcctggatttttaaatgctactgggaaattgctatgggccttagaatatgacagcaatgttaagtttaccttagagcatatattcagtatttaatgtactaggggataagaacattattgcagatccacatttatttgtgtgtgtatatgtacatatgtatatatattcccctatgggagtattttaatagttaatattgtccttctgtttgaagtactatttttatgtctttttttttttttttttgagatggagtttcgcttatcacccaggctggagtgcagtggtgcaatttcggctctctgcaacctccgcttcctgtgttcaagcaatcctcctgcctcagcctcccaagtagctgggactacaggtgcacaccaccatgcccagctaatttttgtatttttagtaaagacaggctttcaccatgttggccaggatggtctcaaactcctgacaggtgatccacccacctcggcctcccaaagtgctgggattacaggcgtaagccaccgcatccagcctatttttatgtctttaattggggaaagtaagtgcaaagagaaaagcataggatgagtatggttggtcccatgtaaaattttccttacccccttgtaacctttgtttaaaataaagaaatgagtactgttaattacagttccttgtctttagaagaaagctgtggtcctgtttctcttctatgactacttttacattgctttgtacacaaacgaaactgagtaccacattgagacattgtctatttagcagtctgagtgaaccatttttcttagccatgtaggtcttggggaagcagtaggtggtggtccattctgaatttagagtgagaatacatcgtaggttaaggccattatgaagccaagctcaagtctgtgtggagcagtaaggcttcaggttattctgttctcttcatcaacatactctgagaagaaatgcaggaatggcaagatgcatgtttcctaaaaatagattcatttatatttttgatgcatgatacaagtttacatctgtgggagagtatttgaatattatgttcataaaatagcaagtggaataagagaaaaagcactccacaaactgctggaaaactttttgttttggataccatgacaacaaaaataattatgatggtaactaacgcttgagtgcttgtatgtgaggccctgggctcagcagtttgctttaagcatcctgtgctaatcctcaagacaccctgtgaaaggttagaggtagcctaatgagaaagtggaatctcagtgaggttccatgactggtctgaggccacctggttagcaactggcaaaaccaggattctaaacccagatctactaggcttcacagctgtgtaaaatcttaaccactgtgcacttcccctaaccccagttatgtattgtcttggtatatatattttaaacgttctgttttagatatgaacttctttgtttctcagtcatatagtgagaaattcataattctcccagaggtttttctgtgtggaaaagagtagatttcctaagacagtgccatctttgacttcttagactgcaaatttttattgtccagattatcagcagttggaattttttattggatatgtagatataaataatatttttcaacctatttcttgttggattgatcaaaatgcctggatttataataacttttttggtcttatagtttggggtatagcattcacttaatcaatttcatgaaatgattttgcttccaaaattgtaaatatagctgtgaagatctaaattcagacttacatttgtagtagaagtcctaattggtcaattttaatctactttttcatgtgtcattatttttctgtttagtgtcaggtcttttacttgaattgattatttctaagcaccaaagatgactttgaacttatcatgtacttatctgttggcttaaaggtgtatacacatctcaatgattttgatttttttttaatttgtgaaatatacatttctatccttaagaatgcttattttcttcagaaaaattaaaaaaaaatttctcttacccaatttgtataaacacatagtttaaggtagtccttcattttatagccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaattggcccgttatccattttttaatgtttggctgtcttaacatgccactggtactaaagatgattcttaaattattaaagtacaacatgctgaaattgctaaattgatattctttgcaatacttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatgataaagagcagtctaaggctttagtccctttgatccccaacttatttattggtaactactaaatttaccatttttgtggcatggataaaatggagtgctatgcaaatactgttgcacgtgagatgatttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgttggtattttttctcactaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtgatttcttttaaaaaatgaagcttttgtaacttaaaattattttaataagtactttttgaagtattgaataacatatcttttaatatgaagttttggactttttaaaggtcagctcttgatataattaagaatatttgggctgagcacggtggcccaagcttgtaatcccagcactttgggaggccggggcagttggattgcttgagcccagaagttcgagaccagcctgggcaatgtggtgaaaccccatccttacaaaaagtgaaaaaaaaaaagactagctgggcatggtggtgtgtgtctgtagtccaagctaattgggaggctgaggtgagaggattgattgagccctggaggtccaggctatagtgagccatgatcatgctactatataccagcctgggtggccacagaacgaaactttgccgaaaggaaggaaggaaggagggagggagggagggaaaacagaaaaaagaaagaatatttgggcatgctagtccaacttgagaatatcttaaattgttttaaaaaaagagatgcttccaaatatgtacaagaatgtcatttaacagcaaaaagcattttgatataaatcctcttagatttgcttaaataagacaaactcgtgtaactcctttgtaattactactgttcatgttaaaaccttcaagcctcttttaaagttaacaagactatagtcttttattgccagcgtactttagtttttttataggtaaacttaatcagggtttattataacaaattctggacaaatgaagtttgattacattaatgcttgaaatggaagtgcttgaaaggaagggcagaaagcaggacaaatgttgcctttcattttacatttaataagaaacaatttggccaggcatggtggctcacgcctgtaatcccagcactttggaaggctgaggcaagcggatcacttgaggccaggagttcaagaccaacctggccaacatggtaaaaccccatctctacaaaaaatacaaaaattagctgggcgtggtggtgcacacctgtagtcccagatacctggggggctgaggcacaagaatggcttgaacccaggaagcggaggctgcagtgatccgaaatcaggccactgcactccagcctgggcgacagagtgagactctgtctcaaaaataaataaataaataaaataataatttggccagtgtccttactctctggttctcaggttgtagtcattttgctttatgtgtttttgagccttttttcttttcatacttttcaaaattttgaggattttccgcttgctatttctattctattcttttcttaaatgctgatcctgacctagtaatttgatttcatgagccctagggttggaacctgcacagggacctgcaaagggaatagtctgtggtgtcggtggtgattttttttttaattaaaaaatactttctgaaaaatgtcacatttgagtccttttttcacctactgacattttcttttgtttcctctgagggcctttttttaaaaataaaaattcccattctggaaaaattagcaaatacaggcaaacacactagaatataatcttacccaccaactagagccaattagattaactcagtggttcccatggagtgggagtggtgcagttgtgcccctctaggggacattgggtaatgtttggacacatttttggttgtcacaattgggggtgcagtgctaccggcatccagtaggtgaagaccaaggatgctgctgagaattctgcagtgcacaggacagcccccttagaacgcggaattatctggcctcaaatgtcagttgtgcccaggttaagaagccttggtttaatttaacactatggagtaaagattccatttacatttatagactgctatatcttttcaatattatatgtagaccacagtataaataagtggctaaaaattaatcaaaaatgcaaaaaatcaagaaaggataaatgtgcttaagaacatacaaatagctataaaaatcattcctaggccaggcgcggtggctcacgcctgtaatcccagcactttgggaggccgaggtgggtggatcacaaggtcaggagatcgagaccaacctggacaacatggtgaaaccctgtctctactaaaaatacaaaaattagctgggcgtggtggtgcgtgcctgtaatcccagctacttgggaggctgaggcaggagaatcgcttgaaccagggagtcggaggttgcagtgaagcgagataacgccactgcactctagcctggcgacagagtaagactccgtctcaaaaaaaaaaaaaaaaaaaagtcatctctatgattcaccaaaattacctctacataatgaccagttactggggagataatctatggttgactttagaatccaccctacagcaaggcttgtaggatgtcactctataatttaatttcctcaacaacagccaaatctgttaacttctattaaggtaattgagtttttatgtggaaactgaattgagtataccctgcagacagaacacctttgaattttctgccaatctccccagccactttagggatttgttaatttcttaaaggaggaatagttcaaatgaccagaatttacatatatagacttttgttgcatatatagactttttgttgttgttgttctctggcatcctgttagccttaaaggttttacttagtgaagatatttagtagcatttgagtatttgaaattctgtgattccaagaaatcttttacctttgaaaaaccctaatttagggtattccaaggcaaatacaatacagcatgtcctaaaacatgcttaaaatatttctttgcagtctaaaattatatttgctagctgggcacagtggcacacttccataatcccggctacttggaaggctgaagtggaaggatcccttgagctcagaagtttgagaccagcctgggcaacatagtgagacccctcactcttaaacaaattatatttgctaagttaattattctgcttttttttgtttgtatatttgttttgagacagggtctcactctgtcaccaaggctggaatgcagtggcaccaccatggctcacttgcagccttgaactcctgggctcaagtgatcctcccacctcagcctccggagtagctgggattacaggtgcacaccaccatgcccagctaattttttaaaaattttcagtagaaatggggtctcgccatgttgtcagggctggtcttgaactccgaggctcatgcagtcctcccaccttggcctcccaaagtgctgggattacaggcgtgagccactgcacctggcctctgcttttttattttaaaagcacaactaactggtagataaagtgatttgtctttagtatttgataactaatgggttttagagtgttatttataagatgtagtaaattatcctcatcattatttttaagacaaatttataagacaagtgtaatagaaatagatcaacagcacaatagaaaaagatggtagaaaacatgaatacgtaattcacagatgaaagcaaaacaaatggtccttttattaagggaatgcaaagttaaaaatcaactagacccttttttgtttgtttcttcttggattggcaaagaggagcacttaaaagctgtattttgttttggaggattagtttggttatgtctactaatgactaaatgtgtacatacattttgacccattagttacacttcaaagaattttatccaacaaaaatgtactgagacacattgcttagtataataagccattgaagcttacccaaatattcatcaatgagaaataggttaagaaaattatagtacaaccatacatgaaactgatgtagctgtaaaagaaatgagatcgatttttttttgtaatgatatggaaggatactcaaagtatatcaagtgagaaaagatctaggaacaggatattattattattattattttattttttgtagggacagggtctcaccatgttgcccaggcttaggagcaggatattagctaactcgtgttacttctgaaaatctttgaagctccccctgctcttttttccagaagtgtaaaaacaagcatgtatttagtattacacatttttaaaaaatgaaaaaatgctgctgtgtgaatgaaagagtatacatcgtgttgctccagatggtaaaactagagtagaatttactaaaataaagtttcagcacgtaaagtaaagcacttctctgctcttggccattttagacactaaccatctggagcaaccatgtaactcttgccactcatagctaacttaatgtaaaaaaaaaaaatcgcttgactttcttagcacttcacaaatgcttgtaagactgacaccaggagccctgtcatctaaaaggcactttatagagtgctttcaattcttctgttttttcattcattgctcaaaatagatcgtagtgagataagatagtctctggccttcttggtctttggcacaaggaagagggttccagagttgagagtaaggactttgcatcctttgccatagaatttgattaggggccataaaaaggaccattgtgttctagaatgtgaaggactaagcataccactttatagtgcaaggaataagtgaagaagtccttttataagaaaaactgcagtagagcaataacttgaaattacacttatttatatttacttttcattaaatgtaaattattttcttttaccacattgtactactagaaagagaatcaggagtttaggcattcagtcatagatattcgataccattgatttacttaagcacttctcatgtcaacaagacttaagcctgcagataattcctattttatcagtgttcgttatagcttccctgttggttttacttgtgagtcataagcctagtatggtgaatatctaggaaatttcacggtaacagggcttgtcttaggttttgagaacaggtgtaacttgacttctctctgctgtttgtcatcctacacttcccactacatctggtcctttttgtagggtgttgagaacaacatttttcttcatgcaggggaaagtggaagtgcatgttttctaagaaggacaaataggaatagaataaaagaaaaagtatattggggctgggcatagtggttcactatgtaatcccagcactttgggaggctgaggcgggtggatcatgaggtcaggagttcgagaccagcctggccaagatggtgaaaccccatctctactaaaaaaaaaaaaaaaatacaaaaattagccgggcacagtggtgggtgcctgtaatcccagctactcaggaagctgaggcaggagaatcgcttgaacccgtgaggtggagattgcagtgagctgagatcaagccactgccttctagcctgggcgacagagcaagactctgtctcaaaaaaaaaaaattatatatatatatatatatatatatatattttggaagggagaatgggagtggaatcaaaaacattggtctcggatgagaagagtctttctcattggttatgtggtgataatggggtaaagctgtagactttttttttctttaattcatgagtaagatgagcaaaattgaggaagtgtcattttcttggccttgagaaatgacatcatctaaaggagaatcgttgggactggggagaaggggaggggtgtatagcttgaggacagtgtgaggagttggcagtagacttggtggggagcaaattagtgaggagcaaaaaagatttcctgggattgaaagcccgtttcaggttgaaataatacattgtcatccttattcaaagaataggtctccagagaacctgtactaaggacaatacatggtttatagttgtacaatacaactggattaaaaaattttttctcactgttttcattctgacctttattcccacttaattgaaatcactggggttttagtgttttaagaaacggatagtttgctgagtattatatgtgactatttcctacgggtgcccaggggaagaacaagatagtaggcctaggcctgcacagggtcccttgtgtgctatgacagactttactctcaccctccctaattcctaattgatataatttttatgtgactcacaagaggtactggtggtaagaggtataaactggaatttataattgaatctactttctttgtatctgaaagaaaaatattttggttaattatgggcatataatttagctaaaaaattaccttaaatgttaagtggtccttaaggcatttataacagaactttttcagaccctagaagtctaaactgggaaattatttaaaacgttattaaagcaatttaaaatggtaaaaataatacatttatttttgtgcattttagagtttcttttcttcttgaaggatgtttttccagtgaagaggggtttctccctatgaagagtattctcacatttaatagatggtaatttcttacttaagtacagtaatatggatcaatggctataaagaatagtttggcttatcatcaacccttttctttcctaaaagcagtaaaaggtgtgtcagggtataagtggtggaaatgcctgggtggtcacattgagaattgttcctgtagaattgctggtgtagttcatagtaagtctcctggggaggaatggttgcatactccgccctgtttgggaaaccacctcttctcttttaatgagcgtaagctctcgatggttggtttttacatggtatgatagaaaattaagagagaaaagaaaaagatgataaactataatataaaggctcaaagaactggtattatttaggcaaaaggttatttgacagattggtattatttaggcaaaaggttatttgacagacttaaacttttcttgttctctctccagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttactaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaatatttcaaagtttcaaattgaataaatattaaaatgaggatactttaaagacactcaaataagcaattttaaacttgctttctggtggggatataatccctttgagagtccgaaagatgatgggccgtcaccccaggaaaatttgtacatcattttgtttctaatttcagggaactctcagagcccctagaagtccttctgtagacactcaaatctggagagtttgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaagggaaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaaggaaagcaaacagaaacttaagttttagttatctttactgtgaactaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgtattttcattctatatgtgatcttgatacagctcattcctctctgcaactgatttaatctcatcttgataaaatatgacctagaagtgttttgagtaatattaaatcttaaacatatacatattattaatgaaccatctgtgatttatcttataagaggaaaacatgacaatcattaaaatgtttaccaaagaaaatatagctgaagtgctaggtcaaaataagcagtgccataatatatagtgtggtttggtcttcaaatattgaggttaaaaaaagaaactattttgtgtgattatcttacaatctgtatgagctaatgtgttctaatgtatcacataaaagtatatgtgaaaatattacaagaaactaaaattaatttgtaccattatataatatttaaggttaa

SEQ ID NO: 17155 - DNA, 43986 bp, Human
cactaaacccacgtgtttcatttaggaacttacctgtgtagaaatttatttccgcttttattacagtaacatttcaaccttttcttcagatactcgtgtgctgtcctctttcttgcctgttttttctcctattgtgtgcaaggagtgagtggatctaggtttcctggaatgtgggaggagcttttctgaaatttctgcactgattttttttttttaccctcatctcactttcatttaaaattctttattattattacttatatttgtgagctgctttatttttttaaaaggagagtatattttgattcacatcaagggaagtaagagtccacctctttttgatgcagtgtaactaaatctgtcatcttcactgaggcacaaggccctctgtcacattttatctatgcctccactattgcttttagactgttgactacaagttagttaagagcctatactctagaatcagaatacatagatccatgttctgattccatcatttgttagctgagtgagatatagcaatttacttaaacttagtttcataattcataaaatggtgataaaatatttgcctataggtttcttgtgatgctcaaatgagatattataacacaaagcactttgaatagttacttataattgtttttttcctattctacaataatatacacaactttggaataaggaaaagcagtggacatttttttaaaggcttgattattgcaatgtcacctgaacctggaagacttgtttttctgggtgaagaaatattttctctgtgtcagagtttcacaatcatcgtcaggtaggcccttgaaccctgccatttaaagtgctcctctctttgatctgtggcactcatacatacactctggcaatgaggacactgagctcgcttctgaaatttgacaagataaccactaaaatctctttgaattctatgttgttgtgatcccatggctacagaggatcaggagttgacatagatactctttggatttcataccatgtggaggctttcttacttccacgtgaccttgactgagttttgaataggtaagtgaaggagaaggaggcactcaaagaagtcagccacagaaccagtgtgagaaataggaaatgagcttttttaagttttgcaaaggcagatcaggagagttgacctgtggagtggagagtagtcataattttaaaaaatggccatggaaattaaaactgatcagaaatggctgggcacagtggctcacgcctgtaatcctagcactttgggaggccgagttgggcagatcacaaggtcaggagatagagaccgtcctgactaacacggtgaaaccccgtctctattaaaaatacaaaaacttagctgggcgtggtggtgggcacctgtagtcccagctactcgggaggctgaggcaggagaatggcgtgaacctgggaggcagagcttgcagtgagccgagatcgcgccactgtgctccagcctgggcgacagaccgagactcagtctcaaaaaaaaaaaaaaaaaaaaaactgatcagaaatatgaattccataaagacaagggcaaagtcatgtatttggaagggaaaatgttgcccaagtagagagtttctgggaatatgatcttgaaataaaaataaatgtgagataacctattaatgaaattgtctgaaaaccatacaaacaccaacattatcttcatgatccctagttctagacctctttggtcactgtaaaattataacattttccgtgtatctttaacagctttctaggaaaatattaaccaaaagtaccggttttgatttggccataaagtgacaggagaggtaaggttctctaggattaaagaataacgtattcttatttgattcactttaaaaaattattctaaaatctgttacatatctgtcctctccaggatgaactttatattggctcagcagattgtttactgtgttcttcttctttttctttttttggtctttcctgctcagcgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatggtgagttctcatggctctattgggctatttgttgcctcttaaagattagattactgcccgtgaaactgaaaagggaaatcaaaaaaaatgctctgagttgtgagattggatgtttgcctccatatccctgattttggagtcccagataactaaacttaattgaccctggggttcattcagaaaattgttacaaaataattcactggtctcaatccagatgcttggaaacaagagaatattctttataaagttaccaccataattctcatcacagtcaggatttcaaagcatttcatggaaatgccataagttattgagttaataatttcctttagcctacaatatcaataggaatatctaaagattctctacaaatgatatattaactgaaaaatgcaactggaggcttagtgaaagaactagtaattaagctaatcagggcttgggtgaggctggacttgggaattcctttcctctttgtcacagacctccaagggactccaaaaggtcacagaatccaggcagagccctccaaaacaaaaacaaaaacaaacaacaaaaaaactatgattaaaccagttctgacaaatatcagaatgctctgggaaagccagatgctttaacaagtgcaaggatttaggaatttcttctctcacagatcccaaaacagtatccttaagtggtgatccttatgtcaagctgtgagaatatacctcaaaataatagaaggcatccaaacttgatcagtatagtgtcataaagctgctgatgtagaagtgtggagaagtccatcagatagagatatggaaaaaaaagcttggttaaaacaggtttccaaagttctctccctttctctgccattgtggtatgtgtggttgaccatttctcatcatgttttcttacaagactttcaggatcaagcaattcctcgccaaaaaacaaaatcaaggacacgttgtagctatttcttggtgagttaccagaagctgtgaagagagagcatgaggcccatacttttttttttttttgaagggtctcgctctgttgcccaggctggaatggagtggcatgatcatgattcattgcagcttgacctcctgggctcaaatgatcctctcgcatcatttaacatttttttttgtagagatgagatctcactttgtctcccaggctggtcttgaactcctgggctcaagtgatcctcttgcctcaggctcccaaagtgctgggatgacaggcatgagccactgcacctagcctaccacacttactctttgcgtggtctctagagcttcttcagcccccctgctgccagggtccctagggtcttgggcatgccccatttctgaacctattcctgtctccagggatagagtcacagtgaactcagaccagggtaattctaaactgctattctgtatatacccaaggaaatttcatccctgtctctaatgagtctgtcccatgccccttaatacacatgaacacctacacacaggtacaagtcggggaagatcactgtgcagcacataaaataaaattcaggggcgagcactttttttcccatgagataaagttaggaaaaaataaaaatgttcatacagattaaaaattttaaatgttaaaatattaaacccccaatctaaaataaagaaaaaataatttcttaaatcctaagcttgagttatggaattcacattcttataatttacattacctattttgttaaatggaagacttttttttttaatatgcaagtacctgggcatatttagaaagtaaccaaggcagcttttgtctttgaacctgatgcggttttgacagctctatctggaaattgagccagcatatgggagccaagggtgaaagttttcctgggagatttgggctccaaggtactggatagatgctaaagattccattcagtttttcattttctgtcttcatggaactctcacacctacaggggaagaaatggtttagaggttactaaaagtatatagcctggtttaggtgatagtgagctatagaaaaagagaaaataagttgtcaatactttaaatctcaaacaacttcttacaaaaggattttaatagtttaaatacaattatcacaagttgggtaaagacaaccagacctatggcctgataaatcatgtatttaatttatgcatatagttagggccaaaaagagcagagtatctttttgaatgttttaaaatataatctaggattttatgcctacagtccttgaaattacaaaggatctctctcaagttgggaatatgctatccattgcagttacggatgggatttagagactgttttaatttcttgtgattatctcaaacaacgtgttccttactcccaaaactcccttgtatggctacagaaactgttgcagttttagttgcttctcccctgcctttgcccagaggtagtgtggaatgccaccaattttatctgtaatggttcctttcaagcctggggctatgtaagctgctatatatgcttcattccattcatcattcagtctaaatatagctatcaaccactaaattatctgataggtatgcatgaactgactgattctttgcataactactaagctatctgttttatttaggcttgggagccctagggtaaggatacggaataaattgtaaatgatattaaaagaatagcttggcaaggaataatacctcctcaggggccaaaatgcaaggcaacacaaagtgattttttttggtgatataattataacacatgtagtatggtagtgataactaaaataaaattggatagcctcaaaattcctacatgtagtatgataaacaatgttctaagactgaggcctttgggaggtagtgagttatttcctatagatagagagtaaaattattcctataatttggtatgaaagttttaccagaaattttgcttcacagtaaatcatctggattgggtgaagccaggtagggattgagaagtgagtcaggtgggttgcatagatgagtttgtgctgcagaccaaactcctcttcccatagctcacttcttcccactcctgcatgttagagagaagactagaatgtgtcaaatacaacctataggataatagttcagagcattagcttcggaagtaaacactaggttgatgccctggttcttctaatttctagctgtgtgacctagggaaagttacctgctgtgtgcctcatttcccttatttgtaaagttgagacaataacaactccctcacaaggttgttgtgaagattaatgaaaaagcagtttctgagaggttgtgagtgttcagtaaagaaagaaattgctttcctttttttttttttttgagacagattctcattctgtcattcaggctggagtgcagtggcgtgatcatggctcactgcgcctcgacttccccaagctcaggcaatcttcccacctcagcctcctgagtagctgggactacaggtgcgagccaccacacctggctagtttttgtattatttgcagagatggggtctcgccttgttgcccaggcttgtctcaaacttctgggctcaagcgatcttcccacctcaacctcccaaagtgctgggattacaggcatgaaccactacacacagcctattttccattttcactgccattattttctctgtctcttgtgtggctcattactgccacttctgtgcaccatttccatcatgtcacatgcgtagtcaaaaccctcagtgactgcctaattctcagagggtaaaagtgaaattccttggcctggaaagtgcaatcatgcctgaagttctacctgtgggagctgtactagttatctattgtgtaaaaagttaccacaagcttagcagattaaaacaacacatatttaatatcccacagtatctgtgggctaggagtccaggcacagttcagctggatcttctgcttctaagtctcatatggttgcattcaaggtgctggctagagctatggtctcttctgaggcttgactggggatggatatacttccaagccaatgcaattactcagaggccgtctttaattatttgccatgtggccttttccatagggtagctcacaacgtggcatcttgctgcaacaagtcagcaaaggagagagtcttctatcaagattaaagttaaaatcttatgtaacgtaaacatgacatcctgtcacctgtgttgtatgctattggttgaaagtaaatcacgggtctgctcatacttatggggaggggatcacacaagggtgtgaccaccaaaggcagagatcatgggagcattcttagagtctgtctgccacagggccaggatcaaatgctggtggctgattgccagctccactgtttatttctctcagccgctttctgtatgtacaaaaaaggagagagagtgattttctacctcatagtgttgttaagaaaatcaaatgaggtaaattattttgcaaagtattctctactcatctgactcctacctactttcaggtctgtcttaagttgcaacttctgcatgagggcttggccaagtatggtcacctgcatgaatttcctctttcttgtaacagaaactgcttggcccactcataatttatacattattatatactcttatgtttcattaatgaaacatttataatgcatatcttatctgtctgataaaatggaaagcaatctaaggacaatgacttttcccctatacataacaaaatataaaataaatcataacataataaataataaataaataataaaataactaacatttgttgaatgattaggatgtgttaggcactcttgtaagcatttcatttttttgttacttcttcaaatccttacaacagtccttggaggtaagtcctattattactttcattttgcagataagacaactgtggctcagagaggctaaggtacttgagtccaggagcagaattcttactttcctcaaacgttatctcttttgtgtggtctagggcagtacaatataccaagtagttgctcattttggtctttggtaaatggaaatgaatttgtaagttgagaaaagactacactacagtagtttggagaagtccactttccaactgatgttcaagattcaggagggggggaaatgtgtcctggcatcatcacttgcttgatgatttcttttgctggtagaaaatcaccatggctaccaatggccattttctgggaagccttttttgggaatcctaacttaagatcaaaatccctgggctaagtcacggcagctaggaggttactgtgaaccggttctcatttcttatggtttccattgttattagggggctgtattctcattaagtccactctgagctctactggattctctttttagagcactcgtctttgaattcttggccaactcatctatgtcacagcactaaggctataaattccagggccccacaatgtggattatctgtgagaattcatttccagttctggggacaagacccttgggaaaaccaggcaataggccagagagagacagagagagagagagtggtcaaaagtggcctggtcactcttaacctaaaccttgaccttcagcggagtagaggactaaatcactcaggaaatattaaatgtttcaccagatattatttggactatatcttctgttctatctcttcaagcaatgccattccaacttcaattttcttttctgtcatttcagaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacgggtacgtttgtgaacattttagcattgatcccaagagttgaaatatttgggaaatattaaacattaatatcacccacagcagctgcctttatttgaaaaaatagtaatgctgatgttagaaaaatctctctctatgcctaggtaaggtgtccatataatttattattcaaactggaatctttgagagtgaaagacactggtaattattatattcaaacacagagttaaactgagattgtccctggcactgtggtgtgtatggacaccccctagtgttaggtcaccttcctgaaggatcaggcagcctgaagaatacagttagtttatgtcagtggttctcaactgggggtgatttagccctccggggatatttgacaatgtctggagacgtttttggttgccacaaatggggatactgttgacatctagtgggtagggatgctgcagaacatttcacaatgcatgggatggcccccaacaacaaagaatgatcttgtccacaatgtcaacagcaaacttttttttctgtaaaggaacagatgacagtaaatattttaggttttgtgtatttaggtattgtctgtgttgcaactagtcaactgtgctgttgtatcaggaaatcagctgtagctaatatataaatgaacaagtatggctgtgttcaaataaaactttacaaaaacaggcagcagacaggatttggtctgcagaacacagtttgcagacctctgatatagcctattgaaatatttttaacctaaaatatttagctatttaaaaagaaagtcttctttctcagttgcttgtcctctggaactttgtatgttctaatctgtgaatataaaaataaaaatgcatcaaaaaggcaaagataaaaccatgtgaaatgtatctttctacaagttaacatttatttttctgcattctttgggtccaattatccaactaattatcaatgcactttactttatccattctatgtttctccattttttcccccaacaaggacactataagaaaccttgcccattcgcatatagacaatctggtctagcctaggtggaacctagaaattctattttttaaaaaatccccagataattctaatgtgtagccaggactgaaaaccactgaaatgcatgtaagagcttaaagtgtttgggaagaggagggactcaaggttgcttagatttgatggagaggaagccgtggagattgaagaagagctggagagagaccatgaggggttttgtgccatggtaaggaatttaggtttgttcctttggactatgggatcgtgtggaagttttaaacataggatctatttcatgttttaggatgactctcaaggcagaaccaaagggaaataggagaaggagaaacagatcctttaatccagtgcttcttaaatcaatctgagggagagaaccatttccttccttccttccttccttccttcctttcttctcttcttccttccctccttctctcctccctcccgtctttcctttctccctcctttattcctttatttccaatacattgcagatcaatacttgcttaagttcattgattacatgcttagatgtcatggaaatatcaaattgttctccaaagtttataaacttttattctcttaattcctgtacttatcacagaatggaaacaaactgtcacttgcactggtccacggattacacctggagtagcactgcttcactatatcaccttcactttatctgcagggtaaagtttaaaaactttggtatggcatagacggtccctcgtgatctggcccctgcttgtctctccattctcatgtctttcatttcccctaatgaacaccattgctccagtttcattcaacatctcactgtcccctgagaatgccttgtcttttccaacctccttccatcttttagactcttccctctacctcccttctctacatgaccagtgcctacttcttctccaagacacagctcttatcttcccttctctttggacccattcttgaatctcctggttattagttattaatttctccctgctcctatactaccgcatcactttttggtgacagttatagcacttgtcattctgttatgtattaatagttattgatttcatggctgcctcactgtcctatgactttatggtctttgacttgttcacttcagaattgtcagagtgtaggacatattccaggttcaataaatgctgaatgaaacaaaaaatgcacctctctgtgtatgtgtggataagaaaacttctttgggttttggtagatctggttatttcaattactccatatatatttattatgtgcttatagtactttgtgctagtcgacagtggggaaacttaactgggctattccttctccacatacagaaagatacatggcaaagaagtaaattgctgtattttgagtaatcaaaaaatcatgtggtcaaaaggatatctttatattagcattctcttcagcaaaatttccattgttaacattgtttattatctttaatttgcagttgaacacaattctaaatacaatgagcaccatctacagtactggaaaagtttgtaacccagataatccacaagaatgcttattacttgaaccaggtaggctactaatttttagtagtgattatgaaatttacttttctctcagattttaaaaatgattgcagatatgtgtgtttcaacacatagatgctcttttaacttttagtaaaactttcttgtaaattgtatcacatttacttaatttgatcaagtcagtaagtaagtcatttcagtggtttattttctctgcagacatattttggaactataagggcaaggacatgaatgaatcatgagattttatttaaccactttatgacctgatgtctgccaaccttacttttaattctttaaagttcatgtagttctttacaaataaaatttttacaaaggcatcttttcttgtctttgtgtgctttgggataacaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcgtaagtttgctgatctgtagaggtcctgaagctctctgtgtggccacggggctatttcttctgcattaccaagcctgccctttgatatcagggatacccctcaattaacaatcatgtcctcaacaattcagattacctgttttcaaaagaaattactggggaaaaagaaaaggtgcactggcattctacaattcaagaagctcaagaatgagactcaactacaaggcctaaagtaaattatccaggaattatgaattataagtaatctaggaagatctcaggcccctaaaagttcccgagggagtctggggattaagggggggaatcccatttctcaggatgaaagacagagtcactgccttttgtctaaagcccccacagttcactttcaaaggtcatttgtgtgtctaccttagggtgataccccagaaagaaaaaatatcagattagtttaggctggaaatgtattattttctgcagttgtaattatatctcagattatgtggtcataaaaaatcttaacataggaaggaatttccatatctcttaacttattctcttccctgaatagtgagctgaagtcatggaatcatgattcacattttgctttgatgatttactgcccactgaggttgagtaaggaagaatttttttcccgcatttgttgttttaacatttctttcactgccacttaaattcagtattcttaagccttaggcaagctggagacaatagcttatcaccatttttaaaacaatatcctgcatgtcctttcatccaaatatttatttctctcctcatcttcctgatcattaattgccaatgtgaatgtaaaaataaaaattattaaattatgtttacaaactttattagctaatatcctaacacaagcttgtgttttctgatggtgagatactaaaggaagcacatagaaacatgctattgatacatataatttgcaaacaaacacaggttcactgtggcaaagtctaagatgagttgggtctgatctaaaaataaaaggccatgaacaaaagaagaatttaaaaacttagagatccagtcacatattttaaagctaaagatacaaactgatgtatcaagagagtacacacccagggttaagagactaggaatgtgcttctttcgcttaccagctgtgtgatcttggacaagtgatttaaccactctaagcacaggttgttggtgggaatataaactggtgaagctgttatggaaaaatagtatgaggattcctaaataaattaaaaatagaattaccgtatgatccagcaatccctcttctgggtatatacctaaattagatgaaattaccacttcataaagatatctacactgccatgttcactgcagcattattcgcaatagccaagatagggaaacaacctaagtgtttgtcaagggatgaatgaataaagaaaccgtggtgggtatatggaatgggatattattcagccttaaaaaagaggagatcctgtcatttgcctcaacatggatagacctggaggacattatgctaagtgaaataatccagacataaaaagaaaaatatggcatcatctcactcaaaagtggattctacaaaaaaatcaaatatacagagatagagtaatagtgattaccaggggtgaggtggagcggggtgggatatggggagaagtgggttaaaggatacaaagtagcagatatgcaggatgaacaagtctaaagatctaatgtacaacataaggactgtagttagtaataatgttttgtattcaggatttttgcaaaatgagtagattttagctgctcttccatgggggggataatgcttaactatgtgagatgatggatatgttaatttgttttactatagtaaccattttattatataagtatctcataacatcatgttgtacaccttaaatatacacaataaaatttatttaaaaataaacataggctgttactctgcacagtgggagttataataatgacaatcttgtatggttcttgtgcttattaaataaaataatacatttaaactcctggcacagagcaagtgcttaaacagagattacttaatgttattattcatttgcatccctttgagttgatgtttatcacaataaaaatgtgataagcctttaaatttcttttaacctcccagcaaggctaatctatgtattttgtgctttctctctttctttcccttatgttcttccctttctctttaaaaaaaaaaacaaacagattatgaggactatggggattattggagaggagactatgaagtaaatggggtagatggctatgactacagccgcggccagttgattgaagatgtggaacatacctttgaagaggtaagcaaggaactgtacacacaaacagttgtggggcagtgtatgggaaagagggacagtgactaaaggcattctggctcattcttaacacattggtcagccattcccaggcctcataaagttatggaatattagagtttgaaagattttagagaataataggacagcccctacagatgatcagaattgcgctgctttcctccttctttcagtcactgaccattaattaccaatagaaagactataagaatgaaatattataagaacaaatggtcctttagattataagtaggaatgatcttcttgagctacctggggctggcactgtcttcctgtgttagcagagctatggactttgctttcttcctcaggacaattgatactattactttgagtaagctagtcttcatagggaagagagagttttgtgaacagaaatgtcccatggatgtttttccttcattttggccccatgcctcccctttacgtgaaccttcaaacttctgatgtgagttaccttgtcacagccatagtttggcagagctatcaaaaatggaagtaagacaaacaactccccaaaaaggaaatgggaagaagacttgaataagtacatcatcaaagaaattacacaaatggcaaataggcaaataaaaagttattagggaaatgcaaattaaagctatgatgaaaatccactccacacccaccaggatagctatgattaaaaagatggacaataccaagtattggggagaatgtggagacactggagccctcttacagtgcaggaagaaatgtaaaatggggcagtcactttggaaaacagtttggcgatttcttaaaaagttaaacacacacttaccatgactcttaggtttctatatgaaataaatgaaaacatgtgtccttatccatagaaagacatacacaaatgttcatagcagcaatattcataatagccccaaactggaaaacccagctgtccttcaactagtgaatgaataaacagactctgatatactcaaagtagccggagataggagtggaactgactacaagaaaccttttgtggttatagaaatattaaaaaactagatagtggtgatggtttcccggtagttttaatttattgaaactcatggaactacacacttgaaaatgggtggcttttatagtatgtaaattatacctcaatgtaaaaacaaaggaagtaggtaacaatcttaaaaatgaatatatattttttgcatctgcttttattttgggacctgtgttctcccaagtatgtttattggtttatgcagtggagttatcatcaagttctaggaagaaggaatacttttaaattttccagaaatttgagagaagaagaattataatttggggaaattctacttgtttaaagaatctcctatttctagtgttgtggaatggaaattagaattggttactctttgtcttaaactttcttcctgggcttttcagattaaaccattatatgaacatcttcatgcctatgtgagggcaaagttgatgaatgcctatccttcctatatcagtccaattggatgcctccctgctcatttgcttggtaagaagccccatgaattcttcgtgtacttggctctttgttatttctaacaataaaattgcctttttgagtgagccttaacataaaacttttgaaaaattctgtaagtggttagtaacattgtagaaatcgcattttgaaagcattttcttcaaccaaaagtctattttaaacaattctctattgtattactttttttgtacataaagagttattattttggctgcaattcaaatgataaaggggttatttaagataactagagaaagaattacaggctcaaatgagagtggaaatggggaaaataatttttagtattcaagttgattggctaagctcttaaggtggaatttgagattttagtatcatattgtcagagcttggttggctgggggtggtcaggggtaacagaaggttatagcttgagcgaaagcttcctaagttcattctagacttcaccaattactcttgctgaaaagtgcttggcttggaatcgtataagtgaagaatgaatgaaagtgaccatcttcccctctcccaccgcagcagctgaggccaaataaaatataaatatttgaaaatttcatgccatgcatatatagcatttctactgtagtcaaactaagttgctggaagctaatctcctccacagccatacctcgtgtctgtcagcaggagagaatgcggagaaaggacctgtggaggcttttaactctaaagtaatatggaaatccttcctacaatgtcaatggcaagcattatttagtaattcagtttctgcttaaacctgtctggtgtgatgggataatttcttcattccaatatagactaatttactgctacatggaaccaatgtaatacaattctaccttatgtggaacttaagcaacacccctctgatgccttccattcattagccctatttccatgctatgaggttacccagaatgtcaattcctattctacaagatgaccttccagatattcataaagaaccatcatataagatacagcatagtacctggtgcaatacattttagtgactattattgttattgtcatgtttaccctattttcttttgtcaagttaaatatcttatacattatcaaccattccttaaaacctcacttttctataattgttctcctttcaatgagctgtactttgtcaatgtccctcctcaattatcatgcttagagatgaacagttactccagatgaggtttgaccaacataaagaaagacatggtaccatgactacctttgttctagacactatacttctattgatttagctcaagttcacatttatgctttagaagccaggtcatactgtttgttggctcatttttggtcttttacatgtggactgtgctttagcctgatgtcacatatatgtttttatgatggataggtttttctttaaaatttaagcataggacttcacatgtatcactactaaattttatgttttaaaatataagtttagggagtacttttatttttttcagagtctcgctctgtcgcctaggctggagtgcagtggctgatctcagctcaccgcaacctctgcctcctgggttcaagcgattctcctgcttcagcctcctgagtagctgggattacaggctcaagccgccatgcccagctaatttttgtatttttagtagagacagggcttcaccatgttggccaggctggtctcgaactcctgatctcaagtgatctgcctgcttcagctctgcaaagtgctgggattacaggagtactcttcatgaagtttgttgccccatttttttggcaccaggattctggtcctgctcttggattgactttttctagatacatcttcttttttatggtccctggccttggaatacaacttaacatttgtttgagatgtttacaaagtcaccaagttaagtacacgaatataggaataaaagtggaatttagttaccagttagtagaagttcctgaatgatgatcttatatgatctcttttgaagccaacactaggaattactaacagcttaatttgtaatattttgtaccatggatggtagattatagaaatctctttctaatttacagtgtcaatgatggtccatatatttaataaattatgtctacatttctgctgtgttgtcatatactaacagattcttttttaaatataggtgatatgtggggtagattttggacaaatctgtactctttgacagttccctttggacagaaaccaaacatagatgttactgatgcaatggtggaccaggtaggaaaaagagcccttaaaaactaaatctaaattctcaacttcatttatttttatgtcatccttctatttttatttttatgtgaaaccatgtaaataaaaaatttaagctaattgaaatttatttcttatgtagctatagtttcatggaaaagcagtttacaatggcctcagataacttgaattgcaggtgtagtattgatctcattgaaaggtatttgaaatggagattacctgagttttccattaagcggtaagatgtagaattgtcaactggttggtatcactcattccaaagtttgtcattgctaagtaaccagccagtaatctctatggatagtaaaaacaagaatattatgaggggatttttgcatatttaaaaaattattagtgttaaaaatattacaagaatctttaaaacaattttaagtaacatctttattactactttggtttaattatttaaatgtgctaggttcctcaaaacacaagtaagtacatagcccatggacccaataaagcaactacacaatcgagactacaaagcaaccagctaacaacagcatgacaggaacgcttcacctaacagacagagagtggcaaattggagagaaaaacaaaacctaaccttctactgtcttcgagattcatctcacgtgtaatgacacccatgggctcaaagtaaagtgatgcagaaagatctatcatgcaaatagaaaacaaaaaagagcagggggctgctattcttgtatcagataaaacagactttaaaccaacaacagtaaaaaaggacaaagagggtcattacataatgataaagggttcaatttaacaagaagacttaattatcctaaatatatatgcacccaacattggagtatccagattcataaacatagcacttttagacctaggaaaagacttagacatccagaaaataatagtgggggacttcatcaccccactgacagtgttatacagatcattgaggcagaaaactaacaaagaaattctggaaattctggacttaaacttgacacttgaccaattgaacctaagagacatctatagaatattccacccaacagctatggaatatacattcttctcatctgtatacgaaacatactctaagactggcaacatgctcagtcataaagcaagtcttaataaattcaaaaaattaaaattatgccaaacatattctcagaccacagtagaataaaaatagaaatcaataccaggaggaactctcaaaaccatgaaataacctggaaactgaacaacttattgctgaatgacttttgagtaaacaatgaaattaaggcagatatcaaaaaattctttgaaacaaatgaaaacagagacacagcataccaacaacatatctgggatgtggcaaaagcaatgttaagaggaatgtttatagtgctaaatgcctacatcaagaacctagaaagatatcaaattaataatctaacaccacacttaaaggaactagaaaaacaagaacaaactagttccaaagctagaaaaaaagagataactaaaatcagggcagaattaatgaaattgagacctaaaaaatcatacaaaggatcaacaaaatgaaaagtcagttttttaaaaggataaacaagatggaaagacctctagctagattaacagagaaagagagaagatccaaataagcacaatcagaaatgacaaaggtgacattgcaactgatcccacagaagtacaaaccttcctattgagtactatgttcatatctggttgataggaccaatagaaacccaacgtcagtatcacacaatatacccttgtaacaaacctgcacatgtactccctgaatttaaaattaaaattaaaattaaaattaaaaaattatcaggccgggcacggtggctcacagctgtaatcccagcactttgggaggccgaggtgggtggatcacgaggtcaggagatcgagaccagcctggccaacatggtgaaaccccgtctctactaaaaatacaaaaaaaaaaaaaaaattagctgggcatagtggtgtgcgcctgtagtcccagctatttaggaggctgaggcaggagaatcacttgaactcgggaggcagaggttgcagtgagccgagatcatgccactgcactccagcctgggtgacaaagtgagactctgtctcaaaaaaaaaaattctctgtgttcccttctgttgatgaaatggtattatagttataattatgtatatttgttcattcaactaaaattctacgtttctgagtagaatatctaatcatatttctatttgccttataaaatttattcagataattgcaccataatttactatttgtgcattgctgaacctttgcttgttaatagttttacatctgtaagaagcaatgcaatgaacatcttcacatacataacatactcctgggaaaagtccactgcagaataaaaagtgaaactgcaagggcctctaaactcttgtagctgttgtagctccactttgaagttgagcagcagtatagggccatcttgatgtagatttttagtctttctaaagggtttttacacccgtctcttctattgtcatctctgactcaggataggtattgtgacagctccatgctataggtgaggaaactgaggctcaggtaaatgatttgcccaaagtcacaaatcacacagcctcattctttctgttttttttgtaccaattaaccatcctcacctgcccctgccaccttcccactactctttccagcctctggtaaccatccttccactctgtatgtccatgagttcaactcttttgatttttagatgccataaataagtgagaacaagtaatgtttgtctttctgtgcctggcttatttcacttaatataatgaccttcggttccatctacgttgttgcaaatggcaggatttcgtttttttatggctgaatagtattccaatttgtatgtgtaccacattttctttatccattcatctactgatggacacttaggttgtttccaaatcttggttattgtgaatagtgctgcaacaaacatgggagtgcagatatctcttcaaaatactgatttcctttcttttgggtatatacccagcagtggaattgttggatcatatggtagctctatttttacttttttgaggaacctccaaactgttttccatagtggttgtactaacttacattccttccaacagtgtaggagggttcccttttctccacaccctcatcagcatttgttattgcctgtcttttggatataaaccaaaaaatttttcataaatataatttgggtggctgcacattattctatttttcaaaggtatcattatttatttaaccattctgatgttcgtttcaactttttctctattaaaaataattctcaatgtaattgttgaatctaatttctgataattttttaggttagttccttagagacagcattactgagacaaagagaagaatttcaaatgctatccgtgtgtgttatcaaattaccttttggaaaggttatgccaatgtatatatccaacagaaataatgctgctattttaaaaatgacattagcacttttttccattttaaaattttattgtaaattgacatttattattgtatatatttatggggtacaaggtgatttcatgatttatgaatacaatgaaaaataaataaagctaattaacatatcaattacttcacatactttttttgcagtgagaacatttgaaatttactctcttagcaatttcaaaatgtacaatgttctattattaactatatttactatgctgtgcagtagatctcaaaaaaataaaaccaacttattcatcctgtttgagactttgtacgctttgaccatcatctccccgttgcccccaccccatagcctctgtaaccaccattctactctctgcttctaccagttccattgttttagattccacacataagtgagaacatgtggtatttgtttttcggtgcctggcttatttaatttaagaatgctgttgttttgatgctggaattaatactgttctcttttcccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggtagtggggctgatacttacacaactgatactaaatgggagacaacagaggcaggctgaagtttaacttgaattctttctctgcttttctgagcacagaaaagataagttaattctccttgaactaaggctgggagtccaggagagcacatttgggttttcccaggaaaagaggattgccagcaggctctaacttgaacctgtggacaatctgctttcttggaaatatcatgcatccattggcgttgtatggtaatggggatggttgcacccatatcaggaaagatttggtgctaagatttttggaagatggacatatgaatcacacattgatcttcccctccatgtttcactcttgtgaatgagacagaataggtgaataaatacgcttggatcgaagggagaaagtggtacatgtcgtaagagagacacagggcatgctctatggagaactggaagaaaactgaccacatttgcaataggagataggatcagaccgtgctttacaagtgggatttgaattaggtttggaaagacaagaaggattcagatacacagagtcgggaggaggacccaagctgtgagaacagcaggatcaaatacagagaggcaggacctgacctgcatactgaagtcggcaagttaggctagaatgagaaataagtgaaggagagtttgtgtaatgtggcagaatgagcacaggcttcagaatcctaggtgtgtcacttaatgactatgcaaccttggacaaggtatttaactttctttggtttcagtttccttattttataaagtagaatagtaattcccaggttgcaggcttgtgagagccttaggttggattccctagcttgaaaaggagatcgttttacaagtgcttcattgaggagagctctgaggcagaggggaatgagggaagcaggctgggacaaaggagggaggtaagtaagaatgtgatctttactggaaacttggcctcagccttatcccatgaagctctctggagcataacttgagccacagactaggccacacctcaagacaagggggctagccttttatatcaggcagtctttggctgtggactgccccagagtatgggggagcataacccccatttagccaaaggcagtgaagggagcagctgtaggcccttatcagctgtgactcaggcagctaggggatggtggataaagtcttggcaggcccgcaccagcattgactagggtagggattggatctacagtccttttctgtaaagggccagatagtaaatagtttaagctttgcagatctctgttacaactactcagctctgcccttgtgacatgaaaacagccatagacaatacacaaaccaatggatgtggctgtgtgccaataaaaatttatttataaaaacaatggctggccagcaggccatagtttactgatgccagtactagagtgaggcttaaaaatgagaaagtataagtaagttttcaagcacagaatcttacatacagtaggcagtaaatatatagtagttatttttataattatttcaaaagagaatagagagaaaccaaattagaaaagtaggttggggttgtgaaaggaaaatagatttactgagcatgagatgaatacataactgaatatttccttaccttccccctttctcttgcaatgtgtgaattaccatgccctcccactatcctctccagctcacttttctcctataaatgttgaagccctcaaaattatttttggagaaaggcacaaaccacagactgtttctataaattctgtgttcttttcttctgggcatgttcttaaccttggcaaaataaacttgtgaattgattgagacctatctcaaatagtttttggtttacagggtcatattggtgtataaaaggtggctgagtttattcttgagcaatgaggaggcctcgcaggatattggagggggtggtgacatgatccaagtggtatgaaatacatttaggaatctactgatgtatgacccctacacccatctgaatgaaaatgctcttgctaagttaaaaaggaccaccatctcattgccaaatgcagttcttatcccactgggctatagcagcattagacaagatttacaagttgtctttcaaatgctttttttttttaaccgacttccacattgtcattcttttccagatttccttgacctctctgattgtactttctccgtctcccctgaataatcttcctctccccactccttaggtacttggaccttctaaaggtttatctttggtcctcttttcttgcattctatacctgttccatggcccatcatatctatttcccaacttacatgctaatgattcccaagtttcaatttgcagccccttctactatttctctatcctggcaataccaaacagcgtgcagtgtcctgaatgccacatttccacccccctgcccctaagcctttctcattgagcactagaacgtcaacttccatgtcatctaccgggcaaactcctgcacattgattaaggtccaaattgctcattgtatcctcagtcatgcccttcttggtgcttctagggaactgtgcctacattcactcatttttacgctcaaggctgtgtgtactgatcacttatagagtacttgcctcagagttcttgtagcggagaactctgcttatctgtcttcctgttagtctatgagcaagagaacaggattcagctgtgcccattgctttatattgagcaactagtattgtctctaggacataagaggtgggtactcaagattcactggtgaataaatcttggaaagatgattcatgctaccaaaaccccatacaactccactgtaatggttaaatgaaagtcagtgagattcattttcatcttgtccattttcatgcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatggtatggacattttctcatggcttgttttggaggttctttaatctgatatgggaaaaggtatttattatcttatgtaggaaatatttactttttgccacataaggtatgaggtatttatgggtaactggaaattactactggtgaaaaaatttaagtatatatcagaacatgtcaacttttggttttgtattattgaaaagggaataagagaggtaactgaatgaatggacttgggatcctgtgaaatatctaacagaagtttttttcttaaagatgatgaaacagtctcacagaactgaaatggcttgtccaattagtgtcagcattctaactagacccctctggttctaggtaaaaacttcccaaaactttagagttggaatatattctaaaaaccattttatagaggagtaaactgaagacaagagagggaaagtagcccgaagtcaaaacgcaatgtagtggcggaaccagaacaagagccctaatctaaagtcttttccataatattatgcaaagcaaagtgtagctttaaattttggaattcttaaagaacaggtgtttaatatcaagattagaagggattgaaacattttgttcatcctgctgaagcgtgaatttcccctgtaacatccccttagatctgtgctatccttcaacatttctgcctgaggcagcccatttccttttagatgccttggacttgatggaacatgacaaatgttcaggagatccaatttcttcagtgaggatgccatggcttttgattcttcctcataaatggaggacaaatagagcctaataccttcttctcttctgtatattctctcccctatttttagttatttgtgacataaagatcagctcctctgtctggagcatttggtcgatgaggtcaaggtcatgagctccatccttgagtagacaattcactttgccttgatctctggttccagatacttggtgatcccacaagggcctgggagtgagccagtgtaaagcctatcatcatgtttgaaatagttactgtaagcacagtcctagtggattacagaccagtagcagcatcctcccatgaagacagtaacaaacaaaggtagttaacagtaaccatacctgcttcctaattttaaaatatcattaattcaagtcaatgaacagatattttattatttttaaatattccctgacagcaggtaaaaatggttgatgactatgtttcttaagatgatattagatcagtgatgaaataatctgtacaacaaaccccatgacacgagtttacctatataataaacctggacacatacccctaaacctaaaataaaagctttttttgtttttttttataaaaaagatagtattagacatggttaaaccaccggtttggaaaactcctgctttttttcttgactctgcccctgatttgtgaataatgttaaataaattcctttattccttccattcctccctccctctttctctttctttcttcttccaaacatatttatcgagcacatactgtgtgcaagacatttttctagacactggagacacagtgatgtgaaaagtagataacatcccctgcttacatttcaatgcatttccttcatacactagagatgaactccactgcctctttatgtcactaataaaggataaaatgaaataacatgatttgttaaagcattttaaattcttggtaaggaagatatccttacatttaaagtacattgtacttttcaccatccagtggatagtgccctccaggagggctcttttgtttcatttcccctccctggtttacaggcttttcactgaatctgtttagtatttgtttatttaacaaagactcacagaaggcatcacgtagcagacatgggactaagttatacagtcttaaatgagacattaacagtcactgacttcatggagctttccagaataaacagtgtgactgggaaagtggatgaaatagctctaatgaactctgataagaggtatttaagggaggaaactgaaactaatgaagaaaatgaggattagaagtaactttgggttttatttacctgttctgttccagggcttcaacctactccaaatcccttagctgagaaaataaatatatacatatcattatgaatactgtcaatttttctcatgtatccttatagtaagtacatcttgaggaataatattttgaggttaggaaaattctctttaacacaaaacatccactgtcatcttcatcgtaatatttatccttttctattttactttcagaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagtaagtcaatgaatatgcaatcagtaaaatgttttctaatgagtttgctgtgtatttaaaagcatttgactggcgtgtacacacacacacagaggcacacattaactaactactttttgtatttttagtttgttatattttatattttagtctccatttggataccatctcctcagataaaatttccttgggtcaggtgacactacttcatactctatattcttaagtattggcttactcattaaactatgatattatgttgaaagtgatcaatttattcattttacatattcttttatccagccttttaaacaaaacggtgaccccacattttaggcaaagcactggggatccaatgttaataatttcaggtatggtcctcaaccccaaaaaacgtttagtttatggcaggatgtggaaaattaaaccactgcaatttgtagtgttgtgatgggagggtacagggtccgttagcgtccaggggagatccaaagcccaactgggggtgtcagatgaggagaggcatttaagccctgagaaaggtgtgggtgtagaggggaacacagagaattccaagctagagagaacctgacacatttgggcaacagtgaccatttccatggttgcagcactacgttacttattgctgtgtcacaagtgcctcacactgtgcctgtcacatgcaagtatgaaataaataggtttttggaggaaggaattataagagaaaaagaaaaagaaggaaaaaaagaaaggagagagggagggagagaatggaaacaagaaagaaatctatcttctttttaccatcatagaccctggtcaattatttctttctttatttttcttatattttctttttgaagtgaagaactcatgtgtaacaagcagttccacatgcacaggtttaaaacagtacacttcttctgtcaagattctctctgttaacataaatcgtacttgggaggaaagacgcagcacctataagaactgttgccagtgtttaaatattactgaagttatgtctacaatgatcctgcaattttaaaggaaaaatgtattccatttaatcaaagccaaatacatgattttgctacctttttttctggttggattaatcttttgacccctcttagcttattttaaaggcacatggaatcagatccttagagtgattcattaatgcatcaattgttcctttgttcagtaaatataaattaattctttctgtagtgtcaggcaccatgtttgacactggaattagagagaagaccaagacacagccccaccctctaggagctcaagtctctagggcaggaagttactatagttgaataactacaaaacggggagataaatggcaaaggaggcacaactagagaaggctaaaggagattgaggggttaattctgccagaaggtggatgggatcagggccaggcttcacagaggagggaacacttgagctaggtaggcgtggagaataagtaagatttcaattttattaaattctctctgccaggagtacatgaagtgtggtgcctgagaggaattattagggctttcactgtacatttttggccatgcaatgcactttatgaatgttattaaattagtcttttgaagacatagctattttccaagggtatattctggctgaattaattaaaactaagagataactacataatgagctttactgtctgattttttaaaaatttttatttattttttatttttgtaggtgatttttttttacattgtttctatttcacccaacaaccatttctaatgtaaataccattgattggctggacacggtggcacctgtaattccagcattttgggaggccgaggtgggcagatcacttgaggccaggagttcgagaccagcctggccaacatggtgaaaccctgtctctattaaaaatacacaaattagttagatgtggtggtgcacacctataaaccaagctacttgggaggctgagatgggagaatcgcttgaacctgggaggcggaggttgcagtgagccaagatcgtgccactgcactacagcctgggtgacggagtgagaccctgtctcaaaaaaaaaaaaaaaaaatttgattgatgaaactgcactagttatgcccacctgcttgtgatgcttgtgatgggtgatccacagctaatgtattgttttcttttctccccaaaggcgagagatagttggggtggtggaacctgtgccccatgatgaaacatactgtgaccccgcatctctgttccatgtttctaatgattactcattcattcggtaaattacagttttcttgtttctgtttaacttctagggtttgtggacagctgtgctaataacgacaaaaagtagggataaatgaagtgataattataatttttctatttccacccataactaccaagctcaatacagatgctccttgctttacaatggggttacatcccaataaactcatcataagttgaaaataccttaagaatgcgctgaatacacctaacctatggtacaccaaagcatagcctagtctaccctaaacatgctcagaacactcacattagcctactgttgggcaaaatcatctaacacaaaccttattttataataaagtgttcaatatctcatgtaattatttaatactgtgctgaaagtgaaaaactttgggtacttaccattaacatatacagctgaaagcgctattgtaaagtcgaaaaatcaaaagtccaaccgttgtaagttgggaactgtctgtatagatgatcaatttcaattcaatttaaactaacacaatttattgggttaaattaaacttgtgtaagatcttgtccccgtcatcagcaatcaatagtatcattgggagaaataaaaagtagttttgtcttcttgttactggcagtttattgtacattgtgatagagaatttttaacttgaagtccaaaaacatatgttcttcacctactaaccccagtccttgaatttgctggagctcagtttatttgtaaaatgaaaataatattatcgacctgttataaggatggatttgcatcatttatgtgaaagggctattaatctgtaaaacacaaaacaaatgttagctaacatttaacagagtaatattgccatgtttatcaacagatacataaaacacaaataggttatgatgagtgtagagttcatgtctggagaaagagatttcagagatttgatcagtatctctttggttacttgggctccagatttaaatatatgccctaatctataactctaagacagtaagtaaacacgggactgcttttttgttgctttgtctcctgtgcagatattacacaaggaccctttaccaattccagtttcaagaagcactttgtcaagcagctaaacatgaaggccctctgcacaaatgtgacatctcaaactctacagaagctggacagaaactgttgtaagaaatacctcaaaatgttgaacctctcctagtattcagtattactcatttccatgcctaggtttgtatttgatttctttgttctaaaaagaaaattttatggcctcaaaatgtcctcatttacaaaccaaacatttaatttgtggtcagacaggaacctagaccatacaacaattgggtgggccacctcttttctccctatcataactacagccctctcttcctggtaattggaaggaaagagcggtttagggtggaatatatctgttaatatgcattcttttcttatctgccagaagcaaatttagccaagtcaaagagaagaaaccatagatcatagatgtaaatatatgtacatctggaacccctcaaaaggccctgaaccccctttttttgtgtagcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatgtgagtacacccagttgacaagtttcacacccattccttgtctacttcgtctagtctcctttggccccagtctcatgaggacttgtgacacagctgagaatgtttctttctctatagtacctgcttctttctctgctatggtgacagctgccattttatgggagaaaaatcacaactgttgagcacctatgtatgagacatagtgaaagcaactgtacagacaaacacacacagatgcatgcacatgtgtgcatacacatacaagagtgtgtactctttcaagtctgttttattagtctcatctttaaaatacatattataactgtctccaaccaactgtactcgaatcctgctttccaaagacaaatactttttttaaaacaattttaatgctattatctcttctttctggcagtcactttcatatttctaaataattttcttatattgctattttgttattgctcagttttaaaccttcgttttggtctactcttccacttccatttcttgctcttccaataaggccttataatgatttttagtaaaacagttatcaatgtttacatcactatgcctgaagagccaagtaatgtattattttgtgtcctttcttatgtggcttgttgtttgtctcaaagtttctacttgcctgaatttttcggcttacctaatttgctatctacgttgtatttgtttttctcccaaatatttcaacatatctattcttttcagtctcattttttttccctagagacttccctcttggagtcttatattctcctttcccaacatttgttgttctcctgggttgaatccactgcttcctagattccatgtcttctttcttggattacctcttgtttttctggagcatagcctcccacagactgtccaagcaggggcacaaggggtaggaggatcaactgttctccaaagtggttttaaccacaccctgacttccattcctcttcttttcagcccagtattattttcccaccctcacctgtgcttgaattccaaacctcttttggattttttggctctttgtgggtctgtgcctcctctgtgtacaaattaggtcatggcttcctgtccctgagaaagcagttacccctgtctcatcatttctcgttttccaaaagcctgttgatacctttaaaagatccctttactatcactttagtgggatctttggaggaaaaggaaataagcacatgtgggcaatctgttgtctgtaaccagcagtctgctatttctctttaatcagatgcagaccaaagcatcaaagtgaggataagcctaaaatcagctcttggagataaagcagtgagtattctggacagtgaattgattatttttgagtgcacagtcttcacttaaataggacacaataaacccatttcagtgtgaactgaaagaagagaggccatgtggttcttttcaaaactataagttccagattctggcctttgcctttgggtttttaaagtaacctattccttattggataagctattcctacttcttattgccttgaaggtgttatgaacttcaatgagaaaatatctgtatcaatccttaaatatcagataccaatcctttcaattgactctcgtcaccattacttttattctagaaagagaatatggttatattttgaaaggtagtttgtttttagaagcggtacagttaggtttttttagtttgttttgttttagtcaatcacctgtatcctggcttcactcagagtgtggcccatggtccagcagcatttgaatcacctggaagcttgttaaaaatgcgtaatttcaagcctagccctggaccacttaatcagaatctgcattttagcaagcctccaggtgatttgtacgtacaatcaagactgggaagctctaatttagaacactgcttctcaaacttggctgcacagtggaatcacatgggaagtttaaaaaatattaatgcctaggttatacacctccagagattctgatttaattgttctggggtatggagtcaagagttgggcatcaagagtgtttaaagctccccaggtgattctagtcacagcaaagtttgagaaccacttatttagggaaatgcattttgggggtaacaaaatattttacaggaaattatgttatttacaccttaatgtgaattatttacttagctattgctctgtcgttaacacctgtctcagatgatccagtctgaggaagtggtagctttgattgggaaagaggagaggaaagagtagtctcgggtagatggggctcaaaagcctgagagtgggtatgacaccctgaaggctttgcagggttagaagtcaatctgggactattggataaaatggtccaagatgctacagcaaattgttgtctgcattggatagatccaaagattgtgtttctacccccttacctttcctgaaaagttaaacattgtccaagattcaataacacttttagtataattttcatagttaagacatcaaaacataaataactcaggagtaaaaagatgaacattcaagaaagaaaaaatgaaaatggaagtgcatttctttccaatcattaagagttcaagttcctatttcataataatcattgggtgattgtgggactatttctctgtcatatttttattagctcttccttggcttaatacattttaattagtctcggcagatcaggatattttcaattatcttttttcttgacatttatactcatcctctttccatgcagtgagggttggtaaatagtgttcagggggtttgattctgtaatgttctgaggccaattcactgagcaacaatctgttttgatgaaacgagatcatatatttagtgcatctacacaacagggtcagaatatctgctcagttcaaactatttcatggtgaattccaatggatctatggcattattttgagaactcagcctttaaaatcttttatattttatatttatagagatagtagccagactgttattagtaacaatattaataatattattactattaaaggaactcctctaaacctcggtgaaaccaagctgaagtgaatgtaacaattcttttgtgaaatattataattttttaaagggaaaggagaaacatacaactagtgccattcattgattcctactgccagctactggaggaaagagtgaatgctttcttttaagtctttaaaagctatgcaaacataagctatttgtttagcactggaaaacaagaacaaacagattagcttgctgtttacaaagtgttatttttcatttgaacgtcaagtttttcttttacacttatagataagtacatttctgagaacgtaccataaaaatagtaaaaactgattttgtccacaaggtacagacattttgctacaaaacccacaacttttgtttgactcccatcggtaaacctacactcaaggtgttaatttcagtttacatcaaactaaagtaaaaggacccgtgaacccaatggttcctaaagcatggttgcctgaccagcagcattaccaccacctgggagtttgttagagatgtaaattattgggtttcatctcgggcttcctgaatcagacgctctaggggtggacccagcactcagtgttgtaactaacccttcaggtgatacggatgcacacttacattgaaggtcactgacttaatgaatagcaagaatctctggaatattaagaataattcttgaggagtatcagattataaatgtgtcttacgagtccctctgagcagtgtctttcttctgaatttgcagtatgaatggaacgacaatgaaatgtacctgttccgatcatctgttgcatatgctatgaggcagtactttttaaaagtaaaaaatcagatgattctttttgggtgagttgatttgctgggttctcaaattactccaactaggatttctcttactcttgagtctgaggagatactctgcctaaacttttcttcaagtgaaattgataaaaatctcctagtaacttatacttctttggtattgtggaatttgggtgactccatagagggctgatcgtgccttatttgactggtaaattgcaagagtattgttcttactaaacagctgtcactctcttctcagaatgctctcatacaccctcagcactgaaagaaaaaaaaggcagaacttcctgccttcattgacctatattctagtatgtatgttgtgtatgtgtctatgtgtgtaatatgtaagtgaaatatagagttacaaggtactaagtgctaggagaaaaatataaaagggtctggggagggctggtgtgtgtgtgtgtgtgttgggcagggggtaggtcaattttaaccaaaatggtcagaaaagacgtcactaatacttgaacaagtatatgaagcaggagagagagagcgagagagcgagagagcgagagcgagagccagcaatgcagacaatggggaaagtgtctcagctgggggaaacagcaggtgcagaccctgaggaaggaatatcctcagcctgttaaaggaacagcaaggaggccagtgtggctggagcagattagaagacaagtggagacatggccaggacgatgttagggcatagaggaaggagggagagacaaaaggtcatgtgggccttgaaggccattctaaggactttggcttttattctgagttagatgagtagtcactcaagggctatgagccacatgatctaccttattttgtgctaggatcgcttgacagctgtgagagcacagtcctgtcacatcatatggtagaccccactcattaccttcatccatgggtgcaacacgacgttttctgctgggtaggaccaggttgtgggtgtaaatccgtgtgtggtactcagccatttctgcccaccacattgtttgccacaatcctgggccaccgattattccttgttgattctcctgctgttttcagtttggaaattttctataattgaaaaagatgtgggttttatataaaggcagaacaaatagtgccaaaacttgatatcacaatttttatgtagttgatttcatgtgctttgggcagcattaatgttttttttgacaattacatcctctcattgtttgccctcccccatgtctctctatcctgtgattctctctctaatctccttttcaccagcaggggaagtcttcattctcttgattgtgtcctctgtgccacaagtgaagatgtttgttttgtttctctacagggaggaggatgtgcgagtggctaatttgaaaccaagaatctcctttaatttctttgtcactgcacctaaaaatgtgtctgatatcattcctagaactgaagttgaaaaggccatcaggtgacattttactttcatctaagggtgagggggttaccaaatacaacaacaataaccagtattttgtgtgttcttcctgtgtgccaagcattattctgagtcatttacatgtgttacctcatgctacaaactccacgtaattccagaaggatcccacagcaggggaataatcttgatttgagttccgccagatgtaggctcttacaaaagggaagaaaaactatagattacatgttatcaagcaagttaccactatgggcaactagagctcagtcctgctgggaaatgtggagagactgtgtagaatgtgcacctgaattgtcccatcagagggctgaggaagctggggtatttatttaccacctcccatcagttattggctgagaactgcttccaggtggcattaattccccagcatttcagccctgcaggcagggcagatcttgtggtctgagaatgctctctggtaaaggggagcaggtgctggttgaagaaagtctggctagaactcatggaaaatagtaagtgcagaagggacgtggacaggtattgccatcatttgctctcaggactttgatgtaggattcatttaactgcccaaatcctgaaacaaggtaggcaagtacaggattccttacatattgcttggcctctatgctaggtgagggacttgcaatgaatgtttagaagaaacagtttgtccaatttgcctcaattgtttcccacaacagacagcaggagcgaagaatggattgaccttgcagatggtttcctgtcattataaaaaggcttaatatacctactgcttctgggcagctcactaggtggccctctcgagctgcgtcagagtcctgtttaacttcggaagcagatctaagacctgctgggcagggtgtgcctagaaaatctggcttggttggagtgtatgacccaactgtgcccagagactcactcacttcctccagaagacttgtgtctgtcttgggaaaaacttctggctgagatctttatgaaaaagctcagccttcctggatactcagctgcaagctacaggggacctcagactctctgtttccaggatgactcttttcagatcttttctggctgaggttgccaggggttacctgactaattctgcgttgatctctctctctctctctggtggactctgacctcctgacctgggctatacccaagggtaggaagatgagatgccagacactttggtctttgatccagaatgttctccatatcattgtttttttttttctttaaacaatctttatccttttgcctccataaaagtaagccatttcccatcccagtgctgaagaaactggcaaaggtccctttcttatgtgcctccccagtgctacctccaaatgccaataccttttatttggaaaatattactatagagacttggtcataggacctgattcatttgtataatagaagaggtgtatccaattatccgtttccattatttgatataaagtcattgtagatgtactctgacagaagggaaattcttgccaaatatgataactttgcccttaaacacagcagtcacaaatgaataaataccaaccatttatacatttccacacttacaactcaattttccaatggagctgttgatgaacctaatctaggttgcaaggcatgaaagatgcataattgtcaaagacttatatctttaattagacctatttactttgctcttatgattttaggtgtatattccttttttttttttttgaaacggagtcttgctctgtcacctaggctagagggcagtggcacaatctcggctcactgcaacctctgcctcccgggttcaagcgattctcctgcctcagcctcccaagtagctgggactacagacatgcgccaccatgcctggctaggtgtatattcttatgataagctctattatatcctttcaggaacaatgatataaacagtaaataactacacacaattttattttgtctaagtgtcccctttgctgttttttgcttttgcaaataggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagtaagtggcctttcctagacttaactatccaaaaatagaaagatttagagaacagtaactggaaaattttcagtaagtggtagattgtatagaccaattacttagttggacaattttgcaactaaatactctgatgcattccctagaaatttaatagatcagcagttcatcttcctagtaagcccacacagtaagtatctggcctgggatttattagcatgccctagtaaactccatcccagccacagtgtcatttccctcctacaaagaggcactgcaaactcagcaggtatgggtgggctcagggaatggttttcactgctctcactgctgaatccttttcagtctaaaagtggggactggattgctggagactggattgctgatgggtttgaaccgtgaaattgttcaagaatgggctgtgagatttctttgaaactgctactcttggttttttgtttgtttgtttgtttgtttgtttgagacagagtcttgctctgtcacccaggctggagtgcagtggtgcaaccatagttcactgcaacctcgatttcccaggctcaagtgatcgtcccacctcagcttcctgagtagctgggactacaggggtgtgccaccacacccagctaatttttgtattttttgtggagacagggttttgtcatgttgcccaagcttttcttgaactcctgagttcaagcaatccgcctgcctcgccctccagtgctgggattacaggcgtgagccaccgtgccctgcccaaactgctactctttactcagctttatttctcaccgggtagctcagactctatgtcattctcttagttcatggttaggcacgttctaatttgttcctgaactgaagatcaaagttcattgaggatttaaattaccagagacctgatttctagtcttgctttgctactagatgtttttcttctgtccttaagaaattgactcttgctgggcttatggaatgaaggttaatattttatagcacctaacaaaactctatgcacacctcagcttgtttaaacatattcttgattgaatctctatatttgctagtctattttgctcaattttcttcactatagagatttttcgtttctccaaaatagctccatctaaaatattaggcattcaatgtgtaatacattcatatggttaaaattaaaaaatacaaaggtgaacatgaagagtcttccttattaccttttgcctccaagttatcttcccaaagccaaacaaaattatcagttccttggagatacacacacacacacacacacacacacacacacacacacacagtcttttttcttttttctcagacatatatatatatatatatatatatatatatatctcctttttagtatacaaatatatacttttttagtgtgtatatttgtgtgtatgtgcatatgtatatctcatttcttagtatacaaatgttagcaggctataaacaatgttctgcatattttgttttccacttaatggtttttttaaatttttatttatataggtgtgatccaccacacccagcccacttaatgtgttttagagatcattacacattagttgcacaaaaaacttctccttttttctggcagtataatttcccatttcacgaatggattgtaattttgataaacagtcatctattgatgaacttttatgttgtttccaaacatttgtgtttacttaaaaaaagtgatggcttaatataggtaatttcctgagtatgccaatatacccttaagatgaatcctagcagtgggaaagctgggtgaaagcatacgtgcaattgctaattttgataaatattgccaaattgccctcaatagcggctgtaccaatttatactcacatcaacagtttatgaaacttcctgttcctccctcccagcctccttaacacagattcccctgaaactttttgattttcatcagtccgattgattttaacataagtatattaaggcaaccttgctctatttaacaggaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactccttgtgcttacttatgtgctggggcttctttacgttttgtctgcttttcagttctatgaacaaagttatcatctgagtgtctggggctcctggccttccaaatgtctcgtgatgtattgcaaattctcagattgctttattgtacaaagtaattgtaaaactagtcccaaaaaagttgtgtacagagtgtatacaccatcaggttaggaaccaaacctgatgctgcttttatatttctcacagtcactaccccagtgtgagcacagcatttcttagatacctgaagactggttaaaactagattaaatagattaacatatctaaactctatgcattaactcattctatgtggtgaccagcataatgttacaatgactttgtacttcataaattctctatggtaattgtggatcagttagccaagtgaagggaagatgactttcataatctgtaaaataacctcaaaataagggtcatttgaggctctttgatgtcttaattatctgatacccaggtagcagagatagagttctttgttattttacgagatacaatcaacatttcgcatcaccatctgcaccatcctgccattcactgggcccacagcttggggcaacatacaatataatttactccttggctaagcaaccatttcatagacagttttttcttttatcttgcatatgtcccatcttctctaatatatcatgaaaatcttctgtcaagctactgctatctaaacatcctttgtagttgccacaagatctttatgaagttcataaacttggttcagcacagtgcaagaataatttctgcaggaaccaatttcatcatctaacaccttcaaaagagcctccccagacatggcaaaggacccatgtgcatgtgacatagtgtccaactgtaacacagaaagaaaaacctgcttatttccgtaacttaattttggggttttctccagaacagtcctcactgtgcccaccaggtaacgcttgtggtccttctcctgtgtagcagcatcctctgaaaggatggagactctacaaagagggaccggtgcctgggcctaggatggaagctggcaaacaatggcccatgggccaaatcctgcccaccacatttttttgttttgttttgttttgttttattctgttctgttttgagacggagtcttgctcggtcgcccaggctggagtgcagtggcgcgatcttggctcactgcaacctctgcaccctgggttcaagtgattatcctgcctcagcctcccgagtagctgggactacaagtgtgagccaccacacccagctaattttttgtattttttagtagagatgcagtttcaccatttggccaggctggtctcaaactcctgacctcaggtgatctgcctgactcggcctcccaaagtgctgggattacaggcctgagtcattgtgcccggccaccccaccacctgtttttgtctggcctgtgaactaagagtgatttttacatttttaagtggttgaaaaaaattagaataagatttcatgataaatgaaaatgatatgaaattcaaatttcagtgtccataataaagttttattggaacccagccacacccattcattttcatattgtctagggctgctttcatgctacagagcagagctgagtagttgaagtagagacggcatggcccacaaagccatttacagacaaactttgccaaaccctgggctatacggaagcaaggattaaatgaaactgcaaatgcaaaaggtccattgtggagctcacagaccagagaaacatagtgatcaggccagaaatggcaggtgctagcttcctcttctctggtgtctctcaatgaactattcttcctaatttgagagcctcctccctccacatttaggtaaagatggggccttaggtccaatctctcctcctcataaacccactctcaagatagaataaaaactgagaaactcaacttgctaaatctactgtgttgga

SEQ ID NO: 17156 - DNA, 21938 bp, Human
  misc_feature (1)...(21938): n = A,T,C or G
tcctcacctcccattctactcttcggcagaagcatctcagtgttggaaagataaggatttcttcctaaaaaggaaggattacactatatcagagtctgaagatacagttttcatttgcaacgcaagggaattcctttgaatctctaccttatgatttccctgcaaacccactccgatggggctggagagtgctctctcactcagatgaatctctcaggggttgtccagcaggtgtttgccaacttgaagagctacctactatcacagacctataaaagtacgcctgtggacagactgaaaacaaacaaacaaaacacacacacaaacacacaaaacaaccgcacactgggagaagttctaggcaatttccttgcaaataactgctttgaaaattactgttttaaattggcagaacactaaggactttgaacagatcatcccttttactcaatgttttcataaccttgaagtgaaggtggagggagcagtacgttttaaggtgccaggattacactacggggtcagtgctcccggatatgaactttctttttcagaccgaccttgggacctacagctttgtaagttactcatacaactccatcaaatgttacaggtaggtcagaggacattcaggttgtttaagcctctataaatgactcaggcagcaacaatttacaacgtctttgtttctgctatgcagtgccctcctgctagagatggcaaaaatgtggggagggcttcagagcattctaagcctggtatttctggctggaatttttaaatctcactacaatcctgacaagagaccacgaccttaatctcccacggcatgactggttagtcttgatcgtaagccatataatcaacacccaaatgtgcataacacatctaaataatgtcaaaactacactatataccacgcaggggaccagaaatcaatctttacctcaaaaggataagcttccaggatgcaataacatccccttccacccttttctacatccctaaaacagtaatattcacggtaacagcaaagcggaaatcagcttttcctgaacatgtactgaattctagtcacattcacacacgttaattcatttaattccagccacaaggtaggcagcctctgttaacattttacaattgtgagaacgcagagatctgggactggctcaaggtgacacactgcagcaaggagtcagaatttgaatccgaagcagtgtccttccccctcgcaacagctgcggcgttacaaacacaggtcagccacggagaaattaatgacccacagccatccttgcagctctgcgccataactggggagacaagctggttcccgtgactcttcagtctgttttcacccaagtgcatgactgcgggagcaaagcgaccacgtgagcatcccccccccacccccccgcttcccccaggcgagggacagtgccaggccaaggacaagtcacaggtgcaacaacgtgccagaactggatccggagccccagggcgcaagatctcccgcagcgtcacccggcagagggacgggtgtggccaccgggcgcggcaggtcctgcgtgcgctgaaagtgcggctggaggcgcggacggctttccggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggtgagtagtggcgccgcctcgtaaaggctctttcttctccccggggccgggcgcggacgccgtggcgctggaggcggacgccgtgggcggcgcggctggcttctctcttcgccgctggccgcctccactccgcccgtctgcccgcccgcgggcctttttggcggtccccgggcggcgcgcgcgggaacggcccttttccgattttcgcgcggagggcgcgcgcgggctggcagcgcaggggctgggctgggcgcgcgcgggccgcggaggacccggagccacgtgcctctccttctcgcgcgtcctactggggatgggggtctggagtagccggcagaggctattgcgggaccccgggcgcgtgggtagagcggggtgccccactggccccccaggggcacgcagctattgttatttcccccctcccccgcaggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggtaagttctttttatgttttgtcctcttcgtggtgggtgagcaaatttgtatcatgggtggttccatttttgtgcataacctttccgattaacctttctgaatgtgccacttacataatggaattttgatatttacttaataaaactttactatgtttcaggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattggtatgtttaattccaaacggcttcttaattttcgttttcgtcatatgttaccatggcattaggtatgggaggatgtgttctaacgtcgagggacagacccaagaattttgaactcttaaacatttaaagtggtttttggtttctgattttcattatttgatattttttcttaatgtgttctattccagtgatgtcttggttcgtgtccccactgctttctggaattatgtctggaattttattcttcctggttcgtgcattcatcctccataaggtaacctttctcccccgtatgaagacctttcatggagcacacccaatcgatttcaaacccagtggtacttttgcagatgtgattggtgtataggtatgcggccttggaaaattttaaaaagctctttgttctgtgcatttcttgtatgttgtggagttctctgaaagcgagtttttaatactcaagagggcagtcaggaaggaaaaattgaatactatgatgtgccaagaagtaggagaaactgggagcaaaaaaataaggaaatttattttgcgtggttttgtgtagctgtatacacattatttgtttaaaccactgttatattcaggctaatataatacgtaaacttggagttcaagacagtgtcccctgtggcttttttaactaagctgccagttaaatgggtctctgccgtgctgattatcataaccagtttataagcttctagatgaggactctgcctcccatagtgacttgactccaatttctcagaatagttgaaaagaaccagttaaaggtagtttttggcccgccccccaaaaaaacttcaggcagccatttaatttcctgtccatttgaaaatcccttttaagtgacccagtttgcatttcttttatcaagaagtcttgctggctgcaaaataaatgttgacaagggattatgttggcataggactgagttacagtgaggataaatgcatttttctcaggaaacaaagttgtcctttttctaaggtgaatggctcttaacaatccattgtaagttcttaaaagtgttcctaaactgtagaaatctgagggagatagcataaatcccagcaggtaagaatgtattcagacccacttgtctggtctagttgtaagcttctctagggaaagatttgtctcttctctgtagaaattctatgactagtaaagtgattcactaatcactgttttccatagccagaatctggcagaatatagcagtttaacactttgaaaacttgaaatatctttagcctggtataatatgagagtaaacagttcattgatatttatggactcctaagtttggtactgttttattcagcagacaggtacgataagcatctaccttcccactccctacaactgtagtgtatgatactgggatgcttaaattagaggctcaccagtagtcatggaccagatttttttgttttttttagagttttcattagaactgtatatcttgctacttagcagagagtcagaagcattagtaggatctcctgttgtgaattcctgcttggtaaaggtttatgctggccctgtgttgattattgagtagcagatcattttgtttttggagagggtttgtgtgtttcacctccacaaaacacttattccccggaaggggaatggtggtgctctgaggtgcaaagagggattctcaggtgcccagaacctctcatttgaggaatgcatacccccacggtgttattgagggctgaagttagatacggtaactgatttcttaattgtatatttcctatatgggtatgggaatgggcatgatcaaatgatgaagaatgattggcatagtgtttaaaacaatattgactttgaggatcttcccccactctgtgcacgtgcacacacacactcttgcaggccaatccctcagtaacaggagttttcagttgagtatgaatatttctgcttccttttaggagttaaatttcaagaaaatatccttagactggtaagcttttggtatcttaactgctaaaatctgaatatttgaccattaagatatattccaactcttaaatgtctatcttgaaaattaagattaacatgacctttttttttaatttcaaaaaattgcttttaaacattttctattctctgaatgtttgttccaagcatgttggggataggtgggaacagacagaatggaggtgaggtacttctatttaggactggcatcgcacagaaggaatatgcttcagtgctcctgttgagtatttttaaattctagtcaaagaaaatagggcttttggcattctcattagttagaaatatatttaggatgtcttcccttttctttagacaaaaccagaatatccaatatgtaaaagtgaactattctggtgaagatggggggttttgtgaagacctttcctgtcccacatgactagacgatgaggcattcacattatttccaggtgaagttttacttgtgtgttaggtggatctctacaatgatgagacctttcttgttttaccttcttcctagactctctggaacttttgatttttttttaaccatgaacctgtatttcacaataaactattggtatagtagtgtcattcataccctaccccatccccaacaactttgcgtagagaatacctcagatttgtttacctcagggaatacttaattgggctatgctatacaggataataaatacacaggctgctacttcagactagtcaattacaatttgatttatggataatcatattacgaaatatctttgaaaatctattgagaagtccccacataatgtctttaaaacccaggaaatttttgggggtgggagtcttgggttgggttttttggagccttttttttttttttttgagacggagtctcactctgttgcccaggctggaatgcagtggcacgatctgggcttactgcaacctccgcctctcgggctcaagcaattctcctgcctcagcctcctgagtagctgggattacaggcgccaccacacccggctagtatttttgtatttttggtagagacggggtttcaccacgttggtcaagctggtcttgaactcctgacctcaggtgctctgtccgtcttggcctcccaaagtgctgggattacaggcttgagccactgcacctggctttttttttttcttaagcgaagtctcgcctgtcacccaggctggagtacggtgacttaattgtagctcactgcagccttgacctcccaggctcaagtgatcctcctgcctcagcctccagagtagctgggactatgggtgtgtgccaccacatctggctaactttttatattttatagaggtggagtcttgctctgttgcttaagttggtcttgaacttctgggctcaagccatcccctgcctcatcctcccaaagtgctaggattacagacagacatgagccaccaccacacctgacctgcattttcttaagactagtctttagaataaaaatacacaccttagtttcctaatcttgttgactgccctcagagtttgaccaccgttgagttagttattcaaggatgcttaacagttcttgatttctgtatgctattgtttttgttttggctatttcactatctgttaacattctctattaaactatagataagagttaaattttagagtggttttcaatgagtgctcatctctgctaatttgaaatggtacctttactttacacatgggtctgagctttcccttgtttcactggtcttaagctactaactttccagtgtattgattattgttggaagctgtagggttttactttctgtttttcctccccaagattttccactggaattgtgatcaagataacattaaaccttttaggctaaggtctttataaagtttttagccttcccatatatgtattcagatctttgctcccaatttttttttttttctgagatggagtcttactctgttgcccaggctggagtgaggtggcccagtctccactgactgcaacctctgtctcccaggttcaagtgattctcctgagtcagcctccagagtagctgggactacagatgcttgccaccacatccgggctaatttttttggtatttttagtagagacagggtttcaccgtattacccaggatggtctcgatctcctgacctcatgattgtcctgcctcggcctcccaaagtgctgggattacaggtgtgagccaccgcgcccagcctcctcccattctttcggtgtttgacttgggtgttctcctatagaattaatacatactaggtatggtagaattcttatttttagtcactggccttactgttccttaaacatttcaagtttttgccttagggcctttgcatttgctgatatctctgtctggaacattcagcgcccaaataatcaggtggtttgccccttctgtacccatagttaatgtacacagcttgctagcttactacatttatgtcatgcttattccttgaccctccccacccaaatggtgcccccccttccatcactctcctcttacccttctttatttctcttcacagcatttgtcagtactttacattattccatactagaaggtgagtgtcagttctattagaacaggaacttggtcttattccctcctatatttcggtgcccagaatagcacttggcacacagtcttttgagtgagtggatgaccttgtgcacaatcagttattatcattgaacttcggtaaagcattaattgtggcatctttgtcagatgtttagataagatggttggcgtacgcatagtctgcatgttgtatttttagtctttgaagatatgaagtcaggtaagcaacatcctaacatagtctatttcttgacatctcttacaaacgtagagtatagcctatcctcaggtgtgtgctgaagtttatattagggcttttgggtaccttagaatgtgggtattgcaatctttattcaggatgttatcagtcactggtacagttagtcttgttattaaaagaaaaaagaaaaaaaaacaggtagaagttggaattagccttcgtaggaagaattccagatgcaaatgcaggaaaaactctgttgtccttggaaactactctggagagagttattggcactataattcccaaacctaccctgttaaaagattctgtggaaatgggttaacctttataccttttaagatattgatcttaatgatgttttacaggcagatccagttcctaatggtttgcgagctttgccagttttctatgcctgcacagttggaataaacctcttttccatcatgtatactggagcaccgtgtaagtacctatcaaaatatttaaatgtgaatttaaagttgtttacaaaacttgcattaaatgcccaatttacccctttttgctttacagggctgaaatctcctagaaggtggctggcctgcgcccatttcagaaggctgcaggctagtgtacgctgagttaacctagatagtttttcaaccaaagagacctgctcagattctaaatcactacagacctttcctctttagtcttcacaggatccactgataatatgatcatctccttccctttctcctgtctatgctaaaaatgctggaattaatactgacctcaactactgaagtcattagttatatctgatcttcagtaatcagtcatttaggactggtttgctggatattctcatttttctctcccaaatggagatactattgtttctaagtactaaacttccatgaatctgcttgaatgagaagagttgggatgtttaccacctgctctaagtgcacttggaagaagaaattcatgcagctaagaggaaaaataatttgtgagaatataaaggttgaaatgttgatgactttcatgtttgggactaaggcaaggcatggattaaattatggcgctacaagtttaatttagcaacaacaaaagattggtaacttgtaactggcaggacagtacagttttggtatctagactcatttggcctgatggtctgtgactacataggcagtgacttttattctttatactgtgacccactggatgaaatacaggacacacatgtatgtatgtagagagaaagataactggaatagtgtcatgaagccacttaatgcttactatgtgctatgcacccatattttcaaattctctctttttttttttcttaacatttgttgtggcccactgaaatgatttcagttttgagtaatgggttgtgacttgctcttaaacctcactgaagtagtaagttgctgacccaaagtagagttagctaaatatttttattatttatttatttttttgagacagttttgctcttgttgcccaggctggagtgcaatggcatgatcttggctcaccacaacctctacctcccgggttcaagcaattctcctgcttcagcctcccaagtaactgggattacaggcgtgcaccaccaagcccggctgattttgtatttttagtagagacggggtttctccatgttggtcaggctggtctccaactcctgacctcaggtggtccgcctgcctcagcctcccaaagtgctgggattacagacatgatcaccgcacctcgccaatattttaattttttaccttattttagattgagggattatatgtgtattttgttagatggagctaagtatttttaatcttgctaattaattcttggaataatcaggaacgaaacagacaactttaagaaaatattgttcttacttagactatactgaactgctatgtgccggtgaagagaagtttgtatgccagatttccattgtaaacagttctttgtgataaactaaaaagtctcccatgatgctcttaacactcattctttatgtggtagaagcaaagctcagagatgagtgaaattagaatcattttaaaaacagaaacttagatattttcgttgtgtcctttatggatcatttgtaagaaaaaccagtctctttcctttttgacttggaatgtagaccaacttaaattgtgatagacagtaatttcatgtatattttagtttgtgtgaccacatgatcaaaattgaaagcagaatttaaaatgaaaagatacatagtcaccatagaattgtagtttggggccgggcgcggtggctcatgcttgtaatcccagcactttgggaggccgaggtgggtggatcatgaggtcaggagttcaagaccagcctggccaagttggtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttggctcactgcaacctcgacctcctgggttcaagtgattctcctgcctcagcctcccaagtagctgggattatagaagcccaccaccacatccagctgatttttttaattttcagtggagacggggtttcaccatgttggccaggctggtcttgaactcgtgacctcaggtgctccacctgtctcagcctcccaaagtgctgggattacaggtgtgagccactgtgcctggccagtgctttacttctgtctttagtacaggctaatggtttggagcctactggcgtgcatatgacagtcagataatgactaatattactcattcttaaaccatgtgaacagtgttgctaggcaagtctttttttaaggtaagacttgtaagtgaaattaccactaaactttgtgtgtgagaaagacaaaactttttttttttttttttttttttttgagacaaagtctgactttgtcacccaggctggagtgcagtggcgcaatctcagctcactgcaacctccgccctgccaggttcaagtgattctcccacctcagcctcccgagtagctgggactacaggcgcccaccaccatgcccggctaatttttttttgtatttttagtagagatggggttttgccatgttgggcaggctggtctcgaactcctgacctcaagtgatctgcctgccacggcctcccaaagtgctgggattacaggcatgagccaccgtgcctggctgaaagacaaagcttttacaactattcttaaattatcaacttttgatagataatatccttgttttctgtatcttgctttgatactgctttcaaggagataatctcattaaagcattttactaaaggccagtatagtgaatgtaatcacttttacacagaattgtgtcagcatgacaaatgtgactactgagacatcattctgttaacattaaaataagtttgtaggtggtaatggaatatgtggcagttaacgatcatgagctaggagagtggaacacttgctgtctttttcatagctagtcataggtccttagcgtgtagtgatctttattatcttccaaggtgaagaaaggaaaaggctcgtatgttgagaagcataggaacttgagtcccgcaggtgttcaagtgggctaggctggtgtgggttttcagatgatcattgagtttttctcccaaatttgtataggcactagcacagtaatcctgtgcacttaaatctggcagcagctgtcaggggtgatgggctggtatggggaacccctcagtccccagaggagggtttacacaatattgcagggggctgttgccctggggttttcaagatgcaccattttatctcctagtgctgggctttgacaaacttcctctgtggggtaccatcctcatctcggtgggatgtgcagttttctgtgcccttatcgtctggttctttgtatgtcccaggatgaagagaaaaattgaacgtaagtaataactaaacagcagaaaagtttaactactaatgttgtgtttattttttatttggccacctgtaaaaatctattagaagagattggcaaaataagagattttaaagggaaatttgaggatatgggtttgttgtccaaactgtttttagaaatggacttacatgacctaagacctgttcttaaaaatggacttacatgacctaagacctagtgataaagagtattcaacctatgctgtagagacaatctggggcattgaatttttttatgttccttgatcagttgccagtgacatgatagataaatagagaaatcatagcctacatttactgagaagtagaaggataccttaatgaaaaataaggggtagatacaagatattttcgtagaggaaatatttaccccaactgcttctgtgtataacttcagattcagacaagcaaagctaagtctaatgtgtacatgttgtatataggctagaatacatgtagacattgtattgcagtatacaatgcaaatacatatacaaacacacattgtgtgtctgctagaattgtagcacagattctagaagtaaacattttcaagtgtcaaggaatcatttaggccattaccacacactcatgtaattaaatactgagtaaattttggttagtatcggacttttttttccttaaaataatcattttctgcccttttcatcgatgtgaaggctgggttagcaagttgaagtttatcgtttcgaagctgagggatgcatagactgcagtggtgttaggaagaacgctgcgtcaccgcagctgaaccgaagagcctccgagaggttctgtgctagtctggctgtgccgagtgcacggtgggaaccaggctttcaggactctctggcctcattttccctctctgggaggagttgagacaagtcttgctttatgttagtcagtctgtagtttgactgaggtgcctggatggataggtcagcatactgagcactggcatgagagaggcagaagatactctggtctgcctgtgggatttacagccatgatgcacatctctttgttttatagaggtggaaattaaagttgtcgtctttagttccctgcattgagctgtgccactttgcttgaattgttggactgaaatttgagagaatcctcttttgaaaagaatagaattgggtacagttcagatttttagtttcagcttatcagccccatggttgagctactttcccctacagaatgagtcagcagggagctaagaagggttcttatatctgtaaagggttgtaaaaataaaaacaaaacaacaatgtgctacagaagcccgtaaaacctaaaatatttacagaaaaattttgggacccctgacatagggtgttctgcattgctggttgttcccaagtgagagttgctggcaaatgataaagcaggcaggaaaaatgttcctgaatgttaattgaagttcacatacattcttgttttgagatgagttttttgggggtggaggaaaggagacgtggaacaaagtagtatggccacaaccaaaccaaaaaagaccccccttttttttcctaggagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgagttggaattcctggtttcacttttgttacctgcagtggtgaggaggcttattgttttggatttgatgctttttgtattgaatgtcaccttggtgatcttgactaggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaaggtcagttgacattgatcttagtgttgctaaccctatttttaaaccatttatccttgtcacaggcctgtgcttgtggtagtggtactcctagcatttacaggaccccaaataatacaaataggatgaggtaatagcagttattgacataataagacagtacagttttattcttcagaggaattacaaagaatgtttatttttgtagatgataaatataaacagatacacttcacagagaaggcttttgtccatcaagatgagattcagttctttggtagtgaattgtgggatgtaagatgtaagatgaaaaacttaaaagtttttcatatagaatgattttgtagtttggtttgtaaactgtttattggaacctgagagttgctttaagctgcctataggaggaaagaggccaccatttgcctggcattccctccatcagagctgtgttcatttttctgttgtgtatgttggggttccatttatgtctttagaaagaaaggcccttttgccagatgagcttgaaagctgtactttagacaacctggtagatcattcagcagattgggtcttgccaagatctagttctgcctgaaaagtcacttctgccctctttgtttcttccagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctaggtaagtaggtggagcaggttctacaaatgtcagtactcatttttttcagagatataacactgtcgagtgctaacacaaatctctaaagtaaccaagtttgtataagttcatgatgttcttattgtcattgttctttttagattttacttgtctggcccttaaacattttggtcagacattttacccatttagctctggtggtctctgaagaaaatgacttttctgagaaagctgtgtatgctaagagcggatagttatgtatacttgccttttatttgtcttgggagctaagactcaatgtttaccaaactcttcaaaataaaagtgcaaattttatttaatagtgggattccagaaaaacgtaaaactggaagcctttgaataaggaaactgggcatctgtggcctgatttaaataaagtagatcttaggggttatagcaaataaagatgtcagtggaggttttgtgactgagtagaacaaagcaggactgtgttaacttgaggtgtagtgttagcttctcaaaaaagtcaaactcacttcctgacaagaatccttttgtgtctgtagtggcttcagtattgaactggcatctgccctcactgtggtgattgcatcaaatattggccttcccatcagtacaacacattgtaaagtaagtgtaatgccaatgtgtgtctttcaaatggttcttctaatatgtagggtttttagttttacttctctgatactttgatttagaaagttttgtgcagttggagtcttgaagagttcataagttatttcttgtgtttattcttatttaagcaattaaatagatattctccccaaataatagaaacattgttttatatacagcttactgtagtttctggctactaacctcttcctttgttactttatcctccctcattgtagtctctttataataattttttttttaatctcaagagtcatttctacttggcaccattatgttttatttatttatgtatgagttggagtcttgctgtgtcacctgggctggagttcagtggcacaatctcggctcattgcaacctccgcctcctgggctcaagtgattcttgtgcttcagcctctcaagtagctgggattataggcacccgccaccatgcctggctaatttttgtatttttagtagacacaggatttcaccatgttggccaagctggtcatgaactcctaacctcaggtgatccacctggctcggcctcccaaagtgctaggattacatgcgtgagccaccgcgcccggccgacagcattatgttctttgcctttggggaagccattcagagcagggtaggtgtatgcttagaaactggcaggtgctttaattctggccaggtgggtttctgctgccatttgtggtggctgaaggcctggttctaacaagtctgtgaggcttgccaaaatgttggcaaagcagtttatttacagaaggcatatttcagggcctctcaggattgaaatactgagaaacaaaacaaatcttaaggttgtttgatgacaatctaataattataggagaaggaagaaactggtttccttaagagcatttaagctggtccatcatggatcctgctgagtcatctgtttgctacccggatgtgtctccagacaattgtttattaggtttaatatcagccactctgtaaataatcttaggaagacttacaatgcaatttgttattaaaagcagtgtataggccaggtgcagtggctcatgcctgtaatcccagcactttgggaggccaaggcaggtggatcacaaggtcaggagtttgagaccagcctggccaacatagtgaaaccccatctctactaaaaatacaaaaaattagctaggcgtggtggtgggtgcctgtaatcccagcacttgggaggctgaggcaggagaatcacatgaaaccaggaggtggaggttgcagtgagccaagattgcgccactgtactccagcctgggcgacagtgcgagactccgtctcaaaaaataaataaataaaagcagtatatattcattaaattttagcagtagctgagaaggggaaaagaaatagttcttgtgtccttttactaccgttagtatagattatgattggattttcaaattgccttcattttcccagcttaacctgttgtaaaccagctttcttggactttgtcttgtccaggggtctggggctccttgtccaaacagtctcaggtgtctgtttgccagaataccactggcacttcaataacctgtttccttggtctgcttctcttctaggtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatttgttctcatggttttctttcatactcgaatcacctgggctcctgatcagttagcctaatatcattcttaggtgatgtgaatatcttaacaagtgagagctactgtccaacttaaagctcccaacccctccctgtatgcttcttgtgtgcccagaatatgcaagacattactccatagggactgtggtggcaacttggcattttcccttttagtagcacagcctgtacactttcatgttagcacacgggtgttttttttgttttgtttttccagttttttcttttgatactttttgtttttttttttgagacggagtctcgctgtgtcaccaggctggagtgcagtggtgtgatctcggctcactgcaacctccacctcctgggttcaagcaattctcctgcctcagcctcctgagtagctgggactacaggcgcccaccaccacatctggctaatttttagtagagacaagctttcagcatgttggccaggctggtctcaaactcctgacctcaagtgatccgcctgtgttggcctcccaaagtgctgggattatagccatgagccactgcgtctggcctactcatggtttttcacagccaaagatttactgttgaatggacagctttattttactattttatgtagattgtttttagctttggtattacggtaaacccttgaacagtgtggaggttggacaccaacccccatgcagtcaaaaaaccatgtataacttttgactccaaaaacttgactaccagtagcctacggttgaccagaagctttagcaataacataaacagttgtgaacacatattttatgtgttatatgtatgtattatatactgtactacgataatgtaagccagagaaaaggaaataaaaccataaggaagatacatttactattcattaagtggaaatggatcataaaggttttcatccttgtcatcttgagttgactgaggaggaaaggaggagttggtcttgctgtctcagggatggcagaggtgaaagtaagtctgtgtataagtggattctgcagttcagactagtgttcaaaggacatcagtacaaggaaagcaaaaatgagtgggaggcaatgtgtagctaagttttgtttaaaagttctcagtatgggattcttcagttctgacccattatatttttgcccctgatcagaagttaatgaaaagtacatttcttggcaaactagattgatagttcctgtcctgagggtttggaacaatacttttgaattttgagtttatttggagcgtttcactagaaaccaacactaagaatcgaacagggtaaggcagtgcctagtctaacctgtgcctgcaaggttaggccactggctgggtacatgccgttgcatcctgctgtcagtttaatggtcttgcagaagactacatttaatcctcatggccttttgtggtagatcttatcctgattttgtacatgatgaaactggcgtggagaacatctgtatttgcccagtattgtcagttagcagagggtgcccgttacttgtagcctttggggctgggtgaaactagctttatgacttgttacttgagggaagggagggtagggggctgttgtaaagggcgaccgagcattaggccttgaactgagggtctgggaggagaccctcagagttctggcactgccttcccttcgtgctgaatgacctcacaaaagcccagatcctttcagagcccagtgattacatggagaagaggaacctccctggcactttcacttggctcaggacagaacagctgagaaaatacttagaccaagcttgtccagctacagacaatttttccagtgtggcccagggaagtgaaaagattgaacacaccaaggatgtgtttctgtaggcagagcaggtagacctggggagaggagcctctagagctagggaagggaccagaggagcggttatatttctactttagttgtctgccatggggcagggacacatggtg

SEQ ID NO: 17157 - DNA, 42348 bp, Human
  misc_feature (1)...(42348): n = A,T,C or G
gcacaatgtctgtcatttaatgggcattcagtacataatagataggtaattgaatgaatggatttagatgcctgggtgttttctttctacttgtattctattccccacatcctctccaaagatttcagcatcatcaagacatattatcctgtgtcttccttctgaagatttaaattatagtgatcaccaaatccatgttgatatgataacaatggttaagaagtttgaatatgttattttctctaagcaatacagttgtatattaatcagaatctcccagagaaagccccttagagcaggcagttccataaaaggaatgtcaggaacttctgcaggctggatgaggacatacactgagtgaacaagtctgtcaactgctctaaagacactgtcaatgccatataaaagctggccttgttcatctagcagatcatgggggtgagacagtccagtgcctctctgcccctacaatatatgaagaaaggggaagaaacacacattgcctcctggtagattaggggaggacttcttgtacatttttagcaaaatctgagttcagacccagcaattagacaaaagggtcagcaaactatggtcgatgggctacatctgcccactgcatgtttttgtaaatgaagttttattgggacacagccatacctattcacttttgcattatctatggctgcttttgcactttgatgaaagagttgagtagttgagacagacactgtttgacccacaaaatctaaaatacatactatctagcccttcctagcaaacatttgccaacccctagaaaacttttaaaaaatgatgctcttcgacttgaaatttttataatcttctgtttattgtcaataggtgctgctgattttcaaaaaatgacttagaatcctcaaataagtatacagccttatatgctgcttagacaccaaagctatgataagatttgtcagttctttgtatcagatgggttcaattcttgacatcagctaatgttataaaaataactacaaaaatggttgtaatagaaccaaatctaagactctttttaataaaaaagatcaccattgctggtgagaaacctatactgaatgggtgagatgccattgcatttatctgaagtttcgtctttataatcaataatcatatacaatcctagtcaagaaactcatcttacagtccttggggattgaacactgtgaaaataaacttttactcttcggatgtgcttggattttgttttaaattaagaactacagaaatatatatcatttctagtggtagaggaaaatattgccacccagaactttctgaatgtctctttctgccctaggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaatcagtgtttttcatttgagatacctaagttactaagcttctgtttaaaaagtcgttttgtgtatgtttgcctttttttgcatgtatggatggatgtttttattatttttgtgcatgtgcaggttttaaaaatcatatttgattgctttctgtgtgtcattggcagcagatgcatgagcatctgaggtcccttcttaagcaatcccactgagatacaaaggtcaaagctatgtgctggggtttcatgttacaggttatctgctttaaaataacggcagccctgaacatttgagtcagttcttaaaactgccctgctattggtagggacgcaacaggattacagccaagacttctctgcattttctgccaaaatctgtgtcagatttaagacacatgcttctgcaagcttccatgaaggttgtgcaaaaaagtttcaatccagagttgggttccagctttctgtagctgtaagcattggtggccacaccacctccttacaaagcaactagaacctgcggcatacattggagagatttttttaattttctggacatgaagtaaatttagagtgctttctaatttcaggtagaagacatgtccaccttctgattatttttggagaacattttgatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaaggtaggtgagctcaatttttaatgtgatgaagttctttttattggctcatacagaggactttctttgccctcactatttttgaaacaatataaaaatgcagaaccatcctagtagtggactggacaggatatatcctgcatttcttggtgactgttctgtttcttagtcttattaaacttctggccatgagtatttgaaaatgctggggtgggggttggttgttttttgaagttatggtagaacatgagcagtctggaatctttttggatggagaagtttctcctcggttgcatatgcagatggcacagtggttttttaatgaaacattgatttgtttttatgactgataactttgtgggccatttattttcaggtctttgtgagcagcagaggttagtttattcgtttggtaaattgaaaattgcagtgctttctatgaacattttctatctgcttttgcaaattaccaattgctgccatccagaaaaatgttttctcagagagtgtttggttttttcgcttcttgaaaggtgtaaaattcaacactaatcaaatctttggttctgtgagcaagcatcaaatagagcttaacgaacagagagtaatgcaaaaaattaaccagaatgttgctgactgctggaacaatacttagcccaattttatgcatttcatggattatatatattttaagcttctattttgaaaatgattcggatgtaattgttttgactgaagtggtgctaaatcattattgatttaggaacttctggccttgaaaagacaattaaatgtgagtttgagtttttgtagctgttgtttaggacgtgcattttcaacaggggtgatatcgcccccagcaggggaaaattggttcgtggagggatgaaaaagttttacccttttgatacatcacgcacagacgtacatacagtacatatggtatgtagtttaaaatacgttatacattcaaattgcatagggggaaagtgtcttcaaaggctcctggctggtgttggtggcctggcgagggtgggggctgatatttaaaaatgttgaacactgagctggaggtgagtgggaagtcaccttgtctggcagccagcacttttctaacttctcaaattccaaatttacatgggagaaatcacagtgtttggctccattttactgccaccagccttgatattggatctcaaggccagattgtaggtaaatgggaatctgactgtaagcataggtaacaggagaaaacggtctgacttgtttgaagcaagtaagacttttccgactgtccagctttttcgtaagttcatgaaacagaaatcctttagatgtgctgggctcctcgagttttaaaatatttccattttccttgtaaaacatcactttatctgatggtataataaaggagactgaattgttggacataagtcatattctttaggttgctcagctctttcaaagagcacaagcaccaagaatgtctcaggtgtcctgggcactgtgaagttttatttatttatttatttatttatttatttatttatttatttgagacggagtctcactctgtcacccaggctggagtgtagtgatgcaatctcagctcgctgcaacctctgcctcccgggttcaagtgattcccctgcctcagcctctcgagtagctggaattataggcacgtgccaccatgccgggctaattttttgtatttttagtagagacagggtttcaccatgttagccaggatggtctcgatctcctgacctgatgatctgcccgccttggcctcccatagtgctgggattacaggcgtgagccaccgcgcccggctggcactgtgaagttttaaatgctttgaatgtactgttaatatataaatttgttgaatggagtaacgaaggaaagcagctgaatttgcatgtgacagaaaacaagttgttacacgtggaggatgcagcattatatacttactaatacgattagcaattttttttcagaatatatcagaatttcctttaaaaagtgaagctacatatactgaacttatatccaccctacccctcgctcaattaaattatttctgatatgaaggaaaggattgcctatagctaaacagaagttttggcatagatatgactgagtggtaagggataatgagatatataatattggttatagttttcttttttccccaacttttaagaaaagaaaatctaagaggaaataatgtttctaaatgttaaagttcttcttgttaaaattaaaatgtagtgtgaaaacatattcatggtggtaatggtttagggtggtggtatttgaattttttgtttttttttttttactttttgaaataaaatgttttatttattataagaaattcatggtcttcctcggtacttggtccatatgtatttctttctcctcaccctcccctcttctaaccacctcttttccagaatggatggtgatgccaattttgctcctaggttgtcctccagccacccccagcccagttttcactttctagctttgaagattgtccagttttccagcttagactagcattgcctctacgatagttctaggtatctgtgaagatttttttttttcctgtagcaatcatgaaatagctactagtgctctggacgattgtgcttaatgccatttgggtgtaaggcctcctaatttcattagtcttaccacttgtgcttgcaaggatagctgtttggagtcagcagtgcatggaacatgtgaactgagacaaatctgtttgaaaatctcaacttaagatttcaaatccactgtgtatactatttagctgttaagtttctcagtctaagaagaacacgttttcctctagaaataagcttaacccagtacctatgcatcgttcattaatataatcagattacggcctagatgtggaatttatttctgtttctattttctccagctttttaatacagctcagacagtcatatacagttgtacacgatgtgcactgcacaactctagggtgctccatgcatatagacatatctgtatgtgacagccctaagtacaatgtggtagacactctggacatttggtaaataagtatctacatcctcactcttctctcattcacattggccttctggccagcactatttctggtttatttaataaacaattcttgtcccccagaaattctgtgagtcttctgaagatgctggggaaagccagccttcataaatcttttcaatgtcactaatgaagacatgtcactattgcaacaaaggaataccaggccatagtaggctttcacaacttttttctgacagaatttgtttctttctgctttatcttccctgtgtactgtctttttttatccaccctctttcttaattacactggtagaagaatattggtgggtgatggagtcattcacattctgtgtaagactagaatcagtccaagatccacaggaatgtgggatacttctttcatgagaagccacatggctcacaagacttctttacatttgtgttacttgccttctcctgaaattgtctctacagtgaatcaaataacaaggactgaggtgtattttccatatttaattccaggaagcagtcccactccttctccctgcccgatttccagttccaaagtcatgtacagggaagtccattgactttgatgttggtcaaatggcccagcaagcttttgtccacttttctgtcagacacagtccttggcacaaaagacatctgaaatacttcccattaatttcttctttatttatgaccttgtagttaagtgtgttgaattatatgcttctatacacatctgttttaatccagttactcacttataactggtgactgaaacttttatatcactatagcgtattattggtacccaggatacaatagaatcctcaatatcttacatcttcaatatagtacttccttgtatgacttatttcttaacataaaaatcctgttttagacctgtggataaacctttactataaatcccagagacaatttctggaatgagaatatagtatttgtccacacacatgattccatgtagaacttggggtaataagatctgggactcccagatacatttattattaccacaattggatagaggtgctacagaaataggcacacaaatgacagtaaaattgtttctgagaacatttctaggctcaacttttttctacaacttaggatgaacagagagagtggaaactgtatataattgggaatgtgactgagatgagacaaagatgacatggaagcatttcttcttcccttgcttttctggtggtaagttcactcttctgtcttccttgccactagttcttgcagtccctaccaagacactagggcattatacagcaaacacaccctgaggccccctgctactgcatcatgaaagccttagctggttgtgatgtcctagttcataaagaatctgcctagtctctcattagagctttccaatatttgacaattcattcatttatttttttcaacaggtatttattgggcaccaatatatctaggcattgatctaggggctgggaatgaagcaggaaataagtctaggggctgggaatgcagcaggaaataagacaatgtttcaattctcttggaatttgcattccaagtgtgatgggtagaggcagacaatatgcaaatgtgtaacatgtcaggtgtgataaatgctatgaagaaaatcaagtagggggagcggatacagtactgaataaatcagaggagacctttctgattcagttatgtctctacagagtcctgaaggtaataagagagacagaggcaaccatcagtgcagtggccatggtgggcgcagcaagttggcttcgatgtctgggtattagccagggagccggtgcagctggaggtggggtgagtggaggccagaagtgcagttgttgaggttggagaagtagccagagaagatcatgtaaggtgtgactgtgctcccataaaactttatggacactaaaaattgaattttatgtaattttcctgcatcatgaaattaaaaaaaaaattgtttcaaccattggaaaatgtaaaaaattgttcttagctaacaggccatacaaaaacaggctgcaggttagatttggcccatgggtcatagtttggcaattgtgttatatataaattattacactgttttatcttcatcatggtacacatccatacctgacatgttttatttgcctgtgtatacatttattgctttgtcaccgtctactagaatacaagttttttgagaaaaggagctcttaattgtcttgtttactgcagcatcccaatcaccagtgaaaagcctgtatgtaatagagtagatactaaaaacagtatttgttgactgattgatggactagacctcaggatttttagatacccaggatcaggatatgaactactgcattaaatcatctccaacatctactctcatgatggcttgtctgacttcatgatttaaaaaaaattctaaagcatttttaaggcagtatattcaccctgtgctattttcctgtgggcataggatagggtttgtgtggatgtatcaaagacttctccactgtccttccaggcacaagccatcctataaggcgttcccttttaggagccagaggtatagaaggaagtcatctgagcccattattccagcctgttggtaacagaaagagagatgagcaaagtagcatttggctgcacaggggtctggacaaaacttcaacatcttgatgttttccttcatccctgagagccttagaaatgctacctatgctttcattttatgttaggttgtttgtaaaatcatggtaaattatggcaaaatactctggtcagatactttatcaggttaggccaggatatgctgtgaaaacaaacacccccgaaatcttggtggttcataaacaacagagacttatttattgcttataccacatgaccagcctggttcatctggggtcaaatccacatggggatgaagctggctgagtatccgatcttgaatgttaggaatcactatgacagagggagggagagcctgagagcgcctcaccctggcacttaaattctctggcccagaagtgacacatattacttctagttgcagccccttgacccactgccccatctagccacaaagggccaggaagtgcaatcccaccatgcgctcagaaggcagagagatggaaatatttgacaaaccgtattaatgactgtgacacatggtgagttcttcacattggtgacttctaagtgcttctgaacacacctttgactgtagaatgtcaaaaacattctcaattttacagcagtgctggaaaatgaattgtattgagacaacttgggaggagtagaaggagatggaataaaaaaaattcactgatttctgtcatgtgtcatgcctcctttaatgcacggaagaacgtatactttgcttaggaaatcacattaccacattcagaacaactttagtgaagatgggaaacaaccatggctggtcaatggggtaacgtgtgctgaaggaagacaggtttatttctcaggaggcatcttctcccctgggaaaaggaaagacacatattcatctcagtaaatatttgtggaatgtctaccatgtgccaggcatatgagtggaaatgatgtttttataaaataaagatgtcttaagtatttgcatgtcttactaacagtcagggagttcaacttggccagtgggaaggataattttatgcctgaaactttagtaatgtaaatttttatgctgattctctttttgtcattcactgagtattcctaagtaactataacactcacatattggagataagtattggtttcctgaaatctaggtttggctaacattgcttctggaaagagaaaataacatgtgttgaatgtccctatggcaaattcttgctgttacttactgttccattatggagagtgttagaaagagtgtaattttgattgaatgaatatgctaaaaaaaacaccctaaataagaaactcacaaaaagaacagagtggaatgaaaaagtgaaaacaactttgcaatggtgtgcttcgtttataagtacattgtcacagcaagactagggatgattgggcatcttagagagtgcagaggatgttgataaggaagaggaagaggagataagtggattttgatatgggacactagatccttagggaagaaatgtgaaagagggtattctgggctgactgccgctggcatagcaaggctgctttgtagaagggacaataaagttttgcgtaaggatcctttttcccatccaatggattatgctatactttagctggaatagggctgtagcagttagctattgccacaataatgctgtgtaacaaagcagtccaaatttcagtggcttaaaacatcactaccttattctcacttatgtctccaagtcagctgggagtcagaggattaaggctcaaggcttaggtttggtgcaggtcagccccaggtgtctctcatcctcctttgatcagtgggctagcaggagcatgtgcttgcaatgatggtggaaatagaaaaacgtgcaatcatatgtgagtttcaagcctctccttgcatcatgtcttgtaatgtcctattggtcagtagggctgggaaatatatccctccctcagagagtcaggagtggaaatgaaaatgtttttaacaatagcctaatcaccataaaggctttgggtggcacactgggcccttgatcttggagatcagtgatagactgtaacagacctcagaaaccccttggggttattcagagcatacttctagagggtctggggttgtcttgccattcaagcccatcccacacccatctgcccccacatatcctaagcacagttatgtcaagtgagaacagaggcatttgagtggagcacagatttcaaacacataaaggcagggcatggccatctcccgcagtgctagatgatctggctgggagaaaaccacaagcagtcttcatcaaattggaggatgtggaggtcccaggcatttagtcccctagtatgtccttaaaaaacccagacagccatgcacacacactcacacaaatgcacacgcacacacacatacattcacacacacactcttttcctgcatttgtagttcctttcctcagtctaagtttaattaaacaacttggatttcatatatattcatttaaatatagaattgcataaagaaaagagccaccagaaccaccaatggtagcatgaggcctctgaaatgaaagatgagcccaccccaaccttaaatggccaggtttctggatttcagagaagcaagatcagacccttggcaggttccatctgagcagccacagcagccatagctacagcaataattattagcaagtgtgcgttctccctgccctagttagtacaccctataccatcaggtgtcatctgttctagttaaagtcagaccgtaataacaaaacatcaaaatgtaaaatgtgggttgtttttttctttacacacttctaaagacatttaaagcctgagcagataccttaaaattcatcttctatctgaaaatacctcctagaaccattttaaaaaggagatggaggcaaggtggagagaaaaagtttgtctttggttgacactgggaaagttgtcttttaaaaaattttttaatgtttatttactatggagttgccgtgtcttgctcttttcaagctcacctgtccggcttctaaggaatatcaggggccctaaaacacagacttctaaaccccaacacataggacacacctaagtgtggaaagaaaggaaagaggcaggaaagaaaggaaagaggaaggaaagaaaggaatgcaacatttattgtgtgcctaccatatacctgaccctttcctacatatgaccacatatgatctcttcatgagctttatgaggtgacctattattaacaatgctgctttataaatgaggaaaccaagccttaaggaagtcaaataccatatcctcagtcaaatagctaaaaaaaaaaaaagaaaagaaaaagaaaaggtagtgcctggattcaaagacagcttatttttttaacttatagagtaaaatggattttttcccttttggtgtgtagttctatgaattctaacacatgtatagatttatataaccacaaccataattaggatacggaactattccatcaccccccaaaaattcacttacgttatccttttacagtcagaccttcctcccagcctcccaacctctggcaatcactgatctgttctccttcactgtcgttttgtatttttggttcgctgtcattttggttttttgggaatgtcatataaatggaatcatacagtatgtagcagtttgagattggcttctttcactcatactgcctttgagattctaccagtgtcccagtagttcattcctttttattgctgagtagtattacatcgattgctgaaccgttcacccattgaatgacacataagttgtttctagttttttggctattgtgaataaagctactacaaacattcatgtacatgtatttatgtgaacataaggcttcatttatcaagggtaaaatccccagaagtaggactgttgggtcatatggtgagcatatgtttataagaaactgcaaacacattttccagagtgttataccattcaaagccagttttgaacaattcaaatctatgctttttctttccagtaagctgtttctccagacgacagagtggtttactatattaggcaaagcttcatcttggggaatgttatttccaactgagagctatgggaggcaaagtcacaaaccttcagctcagactcaccaatctaacttgatctgggaagatacctcgacaggtgggggagggagaacatctgctgaggaaggccgggagtggagtgagacattgctacttggaccccaaaaccaggaaaaatttggtggttttggttgagcttgaaccatcaggttaaacaggaaatgcaaaatgctcttccagtgaaacagaagaagctgctaagaggtagagggaacatggaactatttgtattgcaaccgaatccacctccccaaacccactgcaaagggaaattgctgactgcaatgtccctgaactccagggtgagtaagaagagaaccacgccccccagggaacacttgtaaatttttaagcaaatctagggaaagttgtgtaaaatgtgtcccttccataactcaccctaaagcttctgggtattctaaatatacaaattctattcatcacaccgttttatcaccaagcttcctgaaggcatattgccaacacaatttgacaaagaaaatagcaccaacagctttttaaagccttggaaggatagtctcagacccatggctctctagaggtccagggatgaatctagcaaagctggcctccttttccatatatatagaacaagaggattgttaatagcatgggattggaatggctcaagaaaagctttttgaagctctttgagaaaagtagccagggtccccccttaaaccttctttgctgatggccttacagctcaaaaccagcattggaaccggctaggtactcccaaaccaaagcctcttccacttggcatgtatatttatattctcatatcttctttcaaatacctttcagtgttgccttttgaaaagattataatttgtacttttttgttgaattcagtaggttaaagcagtacctattatctttaattttattttgaaaaattggttggtttggcttttggggaatttgagaggcaatttagtctgtcatttaggatggcatcatataaggcagccaacttcatcatgctgtttagcctgaaaagcgatattgttgatcttcaaccttgaaaaagtcgtacaggttgggagctgacctgcaaatggtcaggtatcttgagataggaaaaggatttacaaatccaggtcagcaagatactcatacaaatattttgaacccaaggtatacatcaaatagatttaaagactaagactatttctgagcatgcatcgactgtttgaagactagtggacttgtatgaagttcaggagttaacctgggtcttgtaacttaaaaacagcatttctcatgccctaaattagtagtagagagacaatatagagagttcctatatagccctcacctatcttcctctaaggctaacacctgggaagtttttttttaaaaaatcctgatggcaaagctgcagcccagacccaaaaaatgagaatctgtgagatttaagattcgagcatcagtatttctttgaagcttattcccaggtagattcaagaagaagccaagattttgaatgcctgctttattatttttttttttgtgagagctttaatggcacaaaatgtttatagctacaagttatacatgtattgtaaattgtatataacgatacaaagtgctaactaaatagatggagaacgcataaccactttggctcagttaatccaataatttccacaatgggttcatgaaaaacctcatctgactggctaagtcttcaattctcatttttttagaatagtaaatatttttactgcaatcacaggaacttgttgcgctttccaatgtgcaagtttctgcagttttgctcttgattctatttacaaatatcttaagccagttttcatcaaacatatgaaaaatgaagcctgcctttttgtccccaaattgtaaataggtgtaaatctttttaagcatcaatctcacaatttcaacagttaattgttgaattctcctttccaatacacgatgttttcgttcaacacaaatctgggtagtagtaaaatgttcatcccgtgtgttagggctacagatacatactacgtgctctcataataaattttactgttatgatgtattcattttttaagtaattttccataatttcactgatgctttaagaaaaagagcaacactatgtttctttttaacgttgaaagaaatcataaatatacccaggttcaatggcgctactgatagaactgctgctgaatttggaatgagcacaatgcactagctgtaagaagtcagttttgggtaatgaataattttacttttccctcctgtaataccaatttcatactgtagcagtttatctagtcagttctcctaactttctgtcctttccaattttattcaggcttttcaaaaatcagtgagccatcagatttactttcttcccaaagaaattcaaatatgaatgcttgaaataaataggttatagaaggcaaatcaagtgttatcaggtttaagattaagacagaaacatggtctaataaaaagatgtccaaaattatctagacatcaaatgctagaaagaaaaaagaaaattacttgcaaaactatttaggatatatcatctttcttaaagattgccagctatattcttgaaaaaaagataaaaattttcttgtttaacctgcatgttattttccactataacattaattttacaaatgttgatgtgagagagaagagttagatagtttctgcaaactggcaaacctggctgtgatagtgtttttattcaagttaacctggtgcactttatagattgctagctttaaaattaacagtgtgaacccctgctttaaacccttctcaaagtgcagtcagccaatcaacagtattgccatcacctgggaacttgttagaccccactttgtcaaactcatttcctggtatgacaatgaatctggctacagcaacagggtggtggacctcatggtccacatggcctccaaggagtaacaccccaggaccatcagccccagtgagagcacgagagaaagagagaggccctcagctgcttgggaatccctgccacgctcagtccccaccacactgaggatctcctctcctcacaatttccatgcagaccccctgaagagggaagggcctagggagccccactttgtcatgtaccaccaataaagttccctgtactcagccaaaaaaaaaagaaagaaagaaaaaagaaaaagaaatgcagcatcctgtcttgccccaaacccactgcgtcagaatctgcattttaacaagatccccaggtatgcacattaagttttgagaggcagtactacatataaaatatgcaacagaccacacaaacctgggcccaattgctatttgtcagatacatgtatgtatttattacttataaattccttcatcagatatgtattacgtgcttattactttaaaaagatgaatctgacacatatcctaccctcaaagagatctcagtctaggaagggaaatacaatgtgttcataaataatatagtctaagttagggacttcataaaatgcttgatggaagaagtggcatttattttggacctggaatgagaactgaaagaagatattcaaaagacaagtgatgtagtgatgtagttttgaatacacgaataatctcagggttactttttctatagcttttggtgaatcaagttgtttattcatacatttaataaatatttattcagctcttactattgctataagacagataccattactgctcaggtggtttttacaacctagtggggaagacaagcagataacaagaaatgacacaattcattagtgttactggtagcgttgtgaaggacaaggatggggtgctagaaatccatgtgacggaccagacctaggcaggggtgggagttatggaggaggtttccctgagtaggtaacatctaagctgagaaagatttagttagacaaagagtgaatggcattccaggcaaaggaaacagcatggactaaggtcaaaacaagaagaaatgaacgaaagagcaagttgataaaatggatgtccaataatattccattgttcaactatgcaacatttttcattgcctcccaaattgggtcaaagtagcctggtcttcatgcctccagtccttcctctttttaaaaattttatacaactatattaatatagaatttacatactataaaatttcattcaagtatattaggaaatttactgagttgtatagctatcatccatataaggtccgttatgtccctttgcaatgaaccctccattctcactcccagcctcaggcagccaataatctattttctgtctctaggggctggaaacttaggattggaattagttggttgtataataaatttagcttattagagaactgctgaactcttttccaaagcaacaatacaattttacagtttcatcagccttgtgtgagggttcctgttgctccatatccattacaacacttggtattgtcagtccttttgtttatagccattctactgggtgtgaagtggtatctcatttcaccagcccctcttcctaacttatttgccagattccccacttctaaacttgctctatgcccaaccaaagtgaaccccttgctgttttttttttcccctgaggctcgttgatatccccaaattatgcctttcttcattctttgaatgtgttacttgactggatatgtatttttggtgaaggagaggggctggaaattgagagatgaaattggtaggagtacagaaggccgttgacttcctcacaacgtgggacacttccaagtttctcctacaaaccccaccactatacctttccaaatatcttgcctgccatcttggtcacccgtgacctaaattaatacttaggaagctatggagatgctcatgcttcctcaggggagaatgctgtgtgaacttagaaattagcaaaaggggaaatgactacccttgaaattgtaccacagaaaggagcatacattcaaatgatggtgaagtcttattaaaaagactttaagcctcccaatttagaagctggcttgtggtagccaagaaattagagaatgatttgttatttaagagtgaaattgctagtagtcttgaattaattaccataaaaaagctgccgctgtaataaaaagcagagatctggtaaccctgcttcattcactttcttcctcttgatgaaaaccttttaattattttgattttgattagcacttccatcagaaaataggaagaaattaggagcaatttacttggcaaaggtttagtaattaaaaccactgaaatcaatggtttaagtatgtatttgggataaacacatttttaattgttatttttgtcttacccaagtggataacataaagttcattatacaaaaatcaaccagtgcagaaagccgattgggaacaaacaaccattcttgaaccctttgaaaatgtatgcccttgatgaattacttgtcaggtttctacttaagtttaattgttagtacttccacttaaaatagcaaaatgactgtctgcaatttctgttatttcaaactaggttttaaattctggggttgaaagtaagcttaaataactctgagtacttgagtaaacactgcattttttatgatgaggcaagttgtatgagccatttaattactttaattcaatccagagatttgatattttctcctgagttctcacagttggatagtttaaaaatatttctaagattgaattgaatcctgtaagaactataataaaaccatacatctgcctgttttctttctttctctttctctcctttcttttctttctttctttctctttctctcctttctttctttctctttctctcctttctttctttccttcttttctttctttctttcctttctttcttctttctttctttcctttcttctttcctttctttctttctttctttctttctttctttctttctttctttctttctttctttctttctttttctttctttctttctttctttctttttcaagatcgtgctccattgcccaggctggagtgcaagtggcgagatcatggctcactgcaaccttgacctccccaggctcaggtgattctcccacctcagtctcctgagtagctgggagtacaggcatgcaccagcatgtctggctaatttttgtatttttagtagagacagggtctcaccatgtttccagtctgatcttgaactcttgggctcaggcaatcctcccacctcggcttcccaaagtgctgggattacaagtgtaagccaccatgcctggccttgtatttttggataatattgagtgaaatttgcctcaatacataaaaatcctttcaatatgcttcaactctaaaatctttaaaaagctgcttggtttcattattttcacgtggaagcagcattgtcacaaagttttattttgaagactgaattgtatatggagtactgtccaactagaagagaatgaataatcaggaaaagagagactattgacaaataagacttaatggagaagcattgaatttcaaagctgccagagacattagcaattgttcagtttcatctccagatttcttagatgaagaagctgtggcaagccaatttcacaaacccgatctatgatcctcatgctccccactcctctcactcccacaattttgccttgattcaaactttatcgaaaagtgagaaatcacaggtatgagctcactgagcttcccaggcagtcttgccatctacaaacccatgtcattctgtattttcctcttgtttctgacagtgatcctctcatctagtcacactacatccacttatctctggcacttatgtcaaaacaacccctctaggtcctgccttagctctcctgcatatgctttttctttcttcctgtctgttgcctctttcccccagcttataattctcccgcttttattaaaaacatgcacccacagacacacactcacatctggattcccaagtgcgataaccttgtagattcatattttcagatcgttcttagtccacagaatataaaattgattgaatgatggcaaacatctgcagatgacaatcatttacagaaatggcactaaagccatgaagctgaagctgcaggacttatggatctgggctagaagacaggggccatcaaaaatttagcttcagttggaaatcggctcttttagtgcactacatcagatccatgaaagaggaaggaagagttactgctcattgctgcctggagctgtgacttctatgaaattacttaacggggcaaaggaggaagcagatacttccttgcaactaggacgtgagctgagctgatccctgaatcataaatactcaacaagattcggattcaggacccagggtattatggggtacaaccataaaacttctaaatgttggagaaagaataatgagaaagaaaaatgaatctctgaatgaaaatggaactactaaccaaaattccaaatcacgttaatataattattactaagaatgacagcaacaaaatgaataatcagtatatgtcatacctataaagttaaaatctaaaataatttgaagaaatacttaaatatatttgcaaccctcaaagagataaagaaataatattcataaaattgaaatgacaaactaggggcagggcgcagtggctcacgcctgtaatcccagcactgtgggaggccgaggtgggtggatcacaaagtcaggagatcgagaccatcctggctaacacggtgaaaccctgtctctaataaaaatacaaaaacaaaattagccgggcgtggtggtgggcgcctgtagtcccagctactcaggaggctgaggagggagaatggcgtgaacccgggaggtggagcttgcagtgagccgagatcgcgccactgcactctagcctgggcaacagaatgagactgggtctcaaaacaaacaaacaaacaaacaaacaaacaaacaaacaaactaggaagaatatacagaaatgtaacagaaagtagataggaagaagaatgaagtagaaatgcttgaaattagaaatacggtgattgaaattaaaaccttaacaaagtaaactctagactcacaacaattggagagttggtgattggaaagatgaaccaattaatttacccataacacattagagagaggtgaagaggaaaaaatagctaaatataaaagcacatttaagagacatgtaagatgattaaaagcctccaacatttttcaaaaaagagagtagaggcaatattataggtggaataatgaaaatgataatggctgagaatattaaagaattgagaataaaaaagacaagtggcctcagattgaaactgccatgaaggtctctgtctcaaattctcaactctgcttttgtagtatgaaagcagccgtagacaataagtaaatgaatggacatggctgtgtgtcaatacaacttgatttacaaaaacaggcaggcagcaggctaaattaggctgggaggtcatagtttgacagctcttgatctaaagaataaccattgttggccaggcgcagcggctcatgtctgtaatcacaacactttgggcggccaaggcgagcagatcacttgagcccaggagttcaagaccagcctgcgcaacatggcgaaaccccatctctactaaaagtacaaaaattagccgggcatggtggcaggctcctgtagtcccagctacttaggaggctgaggcaggagaatcgcttgaacctgggaggctgaggttgcagtgagcggagatggtgccactgcactccagcctggatgacagagccagactcggtctcgaaaataaataaagaataacctttgtttacattttcatgtatatgtctccagatgttcctcatatatccatataagtatgtatatatgatgtacataagtgcataagtaaaaatacataagtaattttaaaagaggttatatcatagctgaatcacacatgacttagaccacacttgctcttctgagtacccatttttggacaactctcagtgtccactagcatgtctaaaaaaaatttctcctcctaaaatgctaatgcatgatgtagattttaactacagcttttgaggctcagtggaggagagtgtacatcacactacccaatgcaaagccttttaacagccccttttgctcatctttgttttccttcactgttcctcgccctgcagcaggcagctgacattcacctttcccttccaccctcctctctcagcactggtcctttgcctcctccctcatcccagctctacaaatggcctcagcctgcatattccaaccacccagcaaaacaaacatctagtaactaccgggtcagcaagagaaaatcggaggccctagccatagatagatcaccttatcatttctccagcacattccaggaaggatctcaattcgttctgtcccaatatacctctacatcctttgttttgatgatcacatagaattcattgtatgcatatatcattatttatataactaagcccccaattttgaacaagaggctacatactgaaaatcttttatctaccaagtcttttttttcttacaaacccatccaatacagttgcactgtatccgccaatacagttcatgcaactgtatggaaagcaaactctagaagagtatttgatagctccataagaatattaaactcttatacttctagagcgtaaaaccccagaaaagtattttgtcagaaaaaaatcatgtttttgaaatagtaggttttaaaagaaaacaaagagagttagaagtaagaaaattcaggttatcaggggcttgatatcttttttttgtgactgtagtcaggttacccaggcctttgtggatcaatttctcaaacaaataacagagatgaaaacaactgtcagtagctactgtcacaaaaataatatgataaacatcttttcgtttcctatggctgccataactaattatcacaaacttggtggcttaaaataacagaaatgtattttctcacagctccagagtccagaattccaaaatggaagggtcagcaaggctgcacgccctcaaaacactcttggagagaatcttttcttgcttcatccagcttctgatggctctaggcaatcccccgcttgtcactgcatcactccggtctctgcccccatcttcaaatgaccttcctctgtgtccctgtcttctcttctgtctcttataaggacacttgtcattgtacagtatttagggtccacatagataatccaggaggatctcattttaagatccttaacttcattacatctgtacagatcctttgtccaaattaaggtaatgttcacaggttctgtgggttaggatgtggacatatcattttgaggcccaccattcaatgcactacaattttctttgtaagtgttctgagaacccaggaagaataagtaaatcctctgattcaatcaaaaatgagcagaatgtaaaccaaaaatactagaagatatcctttttcctaggcactggcatacatttcaatagtatctctaattacagatgtatttacacttctaagtgtcagaaatgaagattattatgacaaatttaaaatttagtaacttgtttttaaactggtatttttgtttttttaagcgatcatctcagtccacattagaacgatctgaacagcagatcagggctgcttctagtttggaggaactacttcgaattactcactctgaggactggaagctgtggagatgcaggctgaggctcaaaagttttaccagtatggactctcgctcagcatcccatcggtccactaggtttgcggcaactttctatgacattgaaacactaaaaggtaggtgtgtggatgtggagacaaattctttctctttattagatagtgacaaacacacttactttctccaaaagtctgcgtagggcagacacgtgtcagagggagaatgaaagtcggtctttgatttccagtattagtgcagaatcttgattttttaatgtttacttcacagagaaatatattcaatatgattttgagataaaaaacacaaaagaacatctcaaaatatagaaataaatttaactcaaggatgtgggggcaaagaaaacccaggaagactattgttctcaatagaaaaacaatcatcaggtttacttagaaaataaaacctggggattcatccacaaggagtattctactgccatacatacatagacaaaaaccaaagatggccaggcatggtggctcatgcctgtaatcccagcactttgggaggccaagaacggcagatcgcttgagcccaggagtttgaaaccagcctgggcaacatgacgagaccccatctctacaaaaaaatagaaaaaaatagctgaacattgtggtacgtgcctgtattcccagctacttgggaggctgaggtgggaggatcggctgagcccaggaggtcgaggctgcagtgagccatgatcatgctactgcactccagcctgggcaacagagcaagatcctgtctcaaaaaaaccaccccctccccgaaccaatagattaggtatagcttttttttttatttctgcaaagttgtgtgattttttagtaaaagtgaaaagtaaaagttagacactgagttgtaatattgggtactggtattgctaggagaataatgaagggagaaaattctcaagacaaaatgatcaaaactccagactagaaaataacataatttgaaataaggataatgatcgttccctagtaacgtatgaagattctttaaaagaaaatcaggccaggtgtggtggatgacacctgtaatcccagcactttgggaggttgaggcaggtggatcacctgaggtcaggagttcgagaccagcctgaccaacatggtgaaaacccatctctactaaaaatacaaaattagccaggcatggcggtgcatgcctgtaatcccaactacttgggaggctgaggcaggagaatcacttgaacccaggaggcggaggttgcagtgagccaagattgcaccattgcactccaacctgggcaacaagagtgaaactccatcttaaaaaacaaaaaaacaaaacaaaacaaaacaaaaaaacaaagaaagaaagaaagaaaaccagtgtgagtaggtactgtcataatgaataaaatgcttgtcaagtaaagttctgtggtttctgattaggcacttaattttttgatgtcatgtcaaaacaacacaagaagctgctacagcattgctgatctagcattctagatttgattaacatgattacctggtaactgactatatatatagcataattcaaattaaccactaggccaaaactatttttttctttctacctaaaattgtatttgttttttcccatttgtaaaaagatgttggggttgcacagacctctgttgttggctgtggggagagctgtgcatagatggggacatattctttggtagcaccttgggcatgagtgtgaagaggattcttagtgttcatgtgtatgactgtgtgtctaagtgagttgatgtggtaggaaccatagcctcgagctcacttcagacagaaatttgaagctctagatgtttctatgtggtgaattaatatagccttcatgagaacaaagggttggcacctcatctagaggtcaaaggccttaaccagattacctgactgaaggcctgaggtgaacctggagctatttcatgaacatgaacgttaccataaaaccaagactaggtgatctaaaaaaagtcaatgacattgacattttctaaggagaaaaccattaaaatatcacggaatttgcaaaccctatgaatttatctcgtaatttctaggggatcatctgaaattatttactaagttagaagcagtcaataatgaaatcagcatgttacaccaattagaatttgttatcaactctcccttgtggatttcaaggtaatttcctgaggcagagcagtcctgctgggaagcagtaaagaatagtagagttatgaagcctttaatcagtgatgttggtcataattgcatatgattttgattaaaagcttaccactccaatttcaaaacttagttttataaaaagagaaaaagcaaatggaaagcaacctttaagtagaattttaaattgggaatattttcataggttggtttcttgttttttcaaggattcatgattaattatagtgaattaaataataaccataataatacttaattgagtaatttatctctcatgtgttcagccttcaggctttttatataaatattaataatcagaaatttttaaaaaggtttcttgggggctgggcacagtggctcacgcctttaatcccagcactttgggaggctgaggtgggcggatcacaaggttaagagatcaagaccagcctggccaacatggtgaaactccgtctctactaaaaatacaaaaattagctgggcatggtggcgcatacctgtaatcccagctacttgggaggctgaggcaggagaatcgcttgaacccaggaggtggaggttgcagtgagccgagatcgcgccgctgcactccagcctggcaacagagtgagaccccgtctcaaaaaaaaaaaaaaaagtttctcaggatagaatnnnnnnnnnnnnnnnnnnnnaccagggcctgttggtgggtggggggcaaagggagggagagcattaggacaaatccctaatgcatgcggggcttgaaacctagatgacgggttgacgggtgcagcaaaccaccgtggcacatgcatacctgtgtaacaaacctgcacgttctgcacatgtatcccagaacttaaagtaaaataagctaaaaaaaaaaaaaaaaaaaaaaagcctgcaagtggagaaggaggagagagagagagagagtgtgtgtgagaaagtgagacagagtaagaaagaagggagcttgcaataagtagaaacaagactgcaatcttttttaacttcatcatggaagtggtatcccatcacttttgctgtattctcttcataagaagcaagttactaggttcagctcacacacaaggggaaggcatttacacaagggcatgactatcaggagatggggaccactgggggttagtttcaaagctgcctaccacaagagattttcaccagcaccacaaccccacacataataaataaactctacagttccatggcaagctacaaggaagtctttgtgttgtctttatcataaaattgaatctttcccccaaaacacctgtagaaaggctatgcagcattaagtatcaaagggtcaaaatctaatttaaaaaataaattatgagagaaaagcaagtactgttttacaagaaagtatataatttttttattcccataggcttctttttttgttaccttcaaattaactatggtcaaaggattgctcattccagtaataagaacagacttatttcatcatttacataaatatcagtatcgggcacttgcaaatgagaaaactctgatttgagtaaggattagtttcacttcaatttccatttatgcatttgccaagtttaaatcctactgtagttacttaagcaaccaacagaaacatatttcttgatgatgctaaaacctacctacacctggctttaaagcagaagaaatgctatccagctgtatcctataaattgcttgataaataatatttacatgttatttctttacacgcttctatttacttccctattaaccagcttctccagatgtattcagtgtaattatgtacaggacatggtgttctacctcaaagggaaataaaatacttatattctacaaggtatggtataaatgggaaagagcacagagattggttgtaacttctctgcaaacaatctttggttaaaggactgacaaaaaatatccatctagtaaaagaaacaagcagtagaaatgtgaaaatgactgtgttcagcataaccctggcacatgttggcacaccaggaccattccacctgctagccccagtgagctttctttctctctgcagttatagatgaagaatggcaaagaactcagtgcagccctagagaaacgtgcgtggaggtggccagtgagctggggaagagtaccaacacattcttcaagcccccttgtgtgaacgtgttccgatgtggtggctgttgcaatgaagagagccttatctgtatgaacaccagcacctcgtacatttccaaacaggtataaggacatcggcaagcctgccgtctctaaagccctgatgataatagtgttgatagctacaacaaccttgttgctaaacactgtactaaatgctttatgtgcataatcgcatttaatctttgaaacaaatcaagagggtattttatgctcctttatagatgaggaaactgaggctcagagaggtaacttacttatccaagtttacacggctgataaatagcagagctgggattcaaacccaggtctgtgggaggccagagcctgaactcttatcagttattgtctctctgatgctatgatgtcaagactcagaaaaccatatggaagttactaggacaggatgttaaaaggaatgaagatagctgatggcaggttctgtgttgctcaaatggagtgattgagaaaaatttaatgaaggttgtgggcagaattggggaaagagggatgggacagtgaagcacctgaagctagcaaaaagggtgagatttccccacccttcgactgaggagacaaggggagggagcagttatgggaacccagagggaaagcggagaagagggtttctggactggccactgtcaactcttagcctggcagggagtaggggcaggggctgggagaggcaagagggtttatagatgtagcccatggagggcagcgtcctggggcacagagcctgatggggaaggaaggggagaggatggtgtctctggaggggcaaagagagaatatctagcacaaaagacatttggaaataattctgcagtccccatgaaagaaataattcagccctcttcatcttataaatttccctttgcttagtaggtaagttttcctttctctggttaccatgtttttaataaatgtcgcatatgagagcagtagtaacaaacttgggaaagcaatactaaaaaactgtacatcaaactacattatttttggtatctgttgcaaattctttgaatgttgatatacttatttaattgtcagtttgcctatatggtttattctccttttaactgcaaaaagaggtagtacaagaaaattacatgcactgaatatatccatgttaggtaattttcttaatgctgatttgttttgttaatagatttacttatccttaattttgttcctccaccctctaaaatatcctttaaactgcagagtttctttttctaaattcttttagagaatcttggagcttgtgtgtattttaacctctactatttgacaattaggaaaaaaaaatgacccaagtagggctaagcatcaattctgagtagaaaaaaagcttgcataacgtaagagggtttagttcatgatcatgtgattccctagagcatagccaaaaaattgtgcaagaagatgaagtttatgcaaagtaaacactacaaaaacactctcactgagactcatggaagttccattatatattgagatgtcagaataaacacaaccttaatggattgcttccacttaatagatagttgagtactttattttgactgctgtactcaacaaatgattaatttcatacaatgtacttaagtgtaagtgtacagcagtttttcttccaaatatgcatttttgaacattttaatagtagttttttaaaaactatctctcgccccaaagttatggactatttggcaaaccacctcttagaaacaaagtgaacaaatgaatactctatgtagtaaggactacatggaatggtgattgaatagacaatgcattaaaatcaacttcaaactcatccacacatcatagaaccactcaagaaagttgtgtaatctctctgtacatctgtttcttcacctgtaagatggggataataaaaacccaccccataatgttgttataaggggtaaatgagttaacatgaaagcacttacaacagggcctggcctacggaaagcgtagaaagaatgatatacatgttagctatagttatttgtttgggcatgatgatcttgtatcagtcagctattaatacacagtgctacgtaacaaacacactaaaactcagtggttccaaacaacaatgatttactctcacttatgtatctgaggttcagttagtttagggtggattcagctgggcttgactctaagctgcagtgtgagtccaagtcaacttctatgtttcccatcgcttggaccagcaagcctgccggattatgttcttttcatggctatagcataagtttgagaaaacaagccccataaaacatgcacagttcaaatttgtacttctgtcatgtctgctaacatcccactagccaaagaaagtgacatggccaaataaaaagtcaagagacaggaaactatatttcttcaatagagatggtgtgagaagggatgaataaatagtttgaataataatctattctaataaaatcctaaagaaactgcatagctttaatctcatttaacccttacgatttacactcaaatttaaagcaggagcagggattaacagtaccattttacaagagtatcaatgatcaaaaagttaaaagatttgaccaaacttaaacacttcataaagttagatgagcctgtttagttccattcttaatggacaacttggctaaagtcattgccgtaaatgacaaaggcaaaaattcagactagaacaactttaaaaatgatatataaaattaaaaaaatatattgtggttatctttctctgctgtagctctttgagatatcagtgcctttgacatcagtacctgaattagtgcctgttaaagttgccaatcatacaggttgtaagtgcttgccaacagccccccgccatccatactcaattatcagaagatccatccagatccctgaagaagatcggtaagcacttttgtttttttttttatactggattatgcttatttttgccttgccaaaactgtgtgtagaggatttttcattaatgtagagttatcaatttatcttcaaattattcatattttagcttctaacctgaacctactggtaataactggcaaatacatatttttattagatgttagatatatattgtggtaggaccaaaacgctcagtggtatgagcttgtcatgtctacttgtagacacgtttgttcttaatatgcatagtctactgcaggtgtaaaaccgctgtaacctcaaatttagcacatgttccagaacaagcattaaataaaacttatttcaggctgtttgtatatttacatcctgaaatgagagaaaacaaagaagattcctggggtcattggggagtgacaaaactagcagcacgtgagttttgcaactttctaatctttcccccttaagattaccaaatggaaaacccttattttaaattaaaatgacttaaaattaatttggctttgaaattctcttgagattaattttgtgattatttataagacaaacgacaaaaccaaaggtaaggatcacttatttgaagaaaaaaaaggatttaatataaagaaacaagtaaagggtaactgaatgaaaagatcattagttagatacttagactttgcaaaagtaaagcaataaatatattgtgtgagtggcaagtaaaagagtaagctggtgattagttaacattgaaccaagaagacacctccgcctctctccagcagaaaagaaaacttgtagaaaagcaacatttattctcaagatgttcctgctgttctggccaatgcttttatctttattttaaagaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatcttaggaggtatgttagaacatatttaattttcgtaaataaactgttgacagctataatttgcatagttttaacatataccttcttaagaagattacaatttccaaaattacagtttagtttctaaacatttccacgtagaatatttataattacagaatcactatctagtaagatgcagttcataaatacaaattaagctcctttaaaatctttttttttttttgagacggagtttcgctcttgttgccccggctggagtgcaatggcgagatctcggctcactgcaacctccgcctcccaggttcaagtgattctcctgcctcagccttccaagtagctgggattacaggcatgtgccgccacgcccggctaattttgtatttttcagtagagatggggtttctccatattagtcaggctggtctcgaactcccgacctcaggtgatctgcccgcctcggactcccaaagtgctgggattacaggcgtgagccaccgcacctggcccgctcctttaaaatcttaactcttctcacatccttatcattttgtggtgagaacatttgaaatttactctcttagcaatttggaaatataaaatacattattattattgactatagttaccatgctgtgcaatagatctcaaaaccttatttctccaaactgagtataaaaagcaaaaaataaatttaaaaaatcttaactattatctactcaggaatttatttaatgttccaaagttttgattatccttgaaagcttttaaatctggttcattgttttcttttcctagctgttcccattccaagaaactctgtcctattgacatgctatgggatagcaacaaatgtaaatgtgttttgcaggaggaaaatccacttgctggaacagaaggtaatgatagtagtagtaaaataataacagtaataataaaagtagcaacaatagcagcaaccgttattgagtacttagtatgaccagacaatgttgtaaatcttttatatgttttaactcatttaattctcacaacaaccctgtaatgtactattgttatttctttttttacaattacaaaatggacacaccaagatatcgagtaatttcctcaaggtcacacagctgagagtgatagaagtggtcagattccagaaccctctgtaccataatcatatagtaagtccatcaatgcatcactctgctttttaatctcaaagaaaagcccagagtggttggagcatcctgaaacactgaaattgaaaggggatgttaaacttgaatgaaagctgcttcagaactaaatactagtcaactgcagtttactaatttatttgtataaaagtctcacaggaacataaagtaattttggacttggtttctgtcagctgcatcatatgaaaacacgccagtaatttgaaaaaagaaatggagaataagagaaaaattttctggaattagggcaaagcaaaagcaaaatatggctattggtctaaggggagctgggagcaaaatgagatatagtcaaattgtcattgctcataatccgtaattctgtgactttgggtgatgaacatttgcttgaaaatgaatgcattttaatgtattttccagagagctttacatggttccaccaaaaaaaaaaaagaaagaaaaaaaaagtcacaagtagtcatgcagttttaaccttgcttgttttaaactataatctataagcaagaacagtaagggctaaactctaagaaatctgtcctataaactgtaaatagcaacctactctccattcttctgcctctcagcttccttctaaatgttttcacgaaagctcagcccagagcatgtggggaaatttaatatttatgtggtttaaatgcccatgccgatcttgaatgttctttacacccttcccaccaagtgttcagccatcctctaccagaacatacatcagttatttggagactcgccatccagtgaggcagcaccaaggggtgggcacactcctgttgttatactgaaatgaaatctctctccagaacagaccagactgcccaatggaatacaataagagtcatatatgtaactcacattttacattaaaaagataaaaagaaacaagtgaaatttatcttaatatattttatttaatccaatctatccaatgtactatcatttcaacatgcaatcaatataaaaaatttatgagctagcctacattctttgtgctaagtctttgaaatccagtgtgtgttgtacacttacagcacatctcaatttagactctctatttcatgcccaatagtcacatatggcccatagctaccttgttggacagcccagctcaagagcatcaactcattagttcaggttttaccctatagaaccatgtaaaacaaatctaattctttctccatgtgactcatgttctaaaagtgttagaaaatttttgtggggttggccgggaatggtggctcatgcctgtaatcctagcactttgggaggccgagatgggaggatcacttgaggttgggagtttgaaaaccagccgggcccggccgggcgcggtggctcacgcctgtagtcccagcactttgggaggccgaggcgggcggatcacgaggtcaggagattgagaccatcctggctaaaacggtgaaaccccgtctctactaaaaatacaaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaagaaaaaaaaaaaaaagaaaaccagccgggccaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctgttccaccaccagttctcttgcatccagttttttgtttcttttaacttggctataaggatgtgagcacagactctgccaaacagcctgctgaagttctgcaaacaccttgtggattgtgtttccctgaacaaccctgtccaacaatggccttgggcctgtctgaagtattcttagtgaacttctgctgccacctagtgatcattgcgaatttttaaaaagcctctttatcctttaacaagttactcttgtcttaccccaaagcggcatctgcctcactggcatatgacttacagagctcacattttccctctccacaaagttcaaaatggagacttctcagatttagccttccagcacccattctcaaacgtcgtgcattacagaaaagtttaaactataaagttgaaccgcacgagattctcattttgatatgtcattaaagtcagatattggcaagaacatatggtttaacccaatggcttggaatgctggatgggattcccagaagctccatacatcggcctgcttcaggacccttttattacaccaaataaacccaacaaacatccatcgagtgcctattttatatcagaacaatgagacctgctccttctccttcaggacattttacttaatgggggaaacatacaagtaaacagacaaatgtaatcagtgcaagaaagaatcggacagcaatatgcacaggataaggacacttagctaaacctgcagacattgggaaagatgtcagggaaaagggatggcagaaggaaagacaaggccaaaggcatgggactgggaggcactggaatatcagggcaacagaaagtgctgtcatttggtataaatggaacacacaggatatatgaaagcaagaaacagaagatgagtctgtgaggttactatgatccagttcatggagggccttgtatgtcctggtgggaaaattggtttttattgtgggaagggaaccttttaatgcattcaaagcagtggaatgaagtgatttggtttgcatttgttaatcatgtgaagaagaataggttggagggataaaacttgtggtggtgagatgagtgacagagcgacagccatctacaaaagaaacacaaggtacagactgaattgtgggagtggtagtggggatggaaaataaagaacaaatttagagaggcagaactgagtggacatgatgctcagacttaccagagcaggtgagtcaagaatgatgtcaccattccctaaatgaggcaaactgggagagaagcagatttggggagaaaactactaaacatgtacgtccctccaaaaccttcaagaatgctaaagggacagagtcaagttcttccaaagtttctgtctcttccatttattttgcaatgaatttcaacttgttaatcagaaatggatttggagtagtagctattcaattgttttatacaccttctagaagaaatatttgtcagatgagtatgtcaaaaacttctcagaccctcccctttacttgaatgtatcttccagcagatgttggtggaatcaaagttcattattactcctatatcttttatactagtgttatgatctgcagtgaggacatgcattgctattgctacgcctggcctggaatgtctgaggtgtatttctacaacaccaattattttgtgtgtctctccttttaatctccaccaaaaaatggagacagctagattcataacccttagacatcctatattttattactaatacttggttgtggaagtttgcattctaaacaagtcatcaacataaaaatctctaaaaatattttatgaaaaatattcagcttatgatattttaaaaatcacaaacctaagaaaacacacaaacctgtgtttgtattgtgaaatcagaggttaatcttcctcaccctgtgaaaaaattaggggcataaatctataggaaggagattgggtgaatccaagttacttacggatgacataaaagatacaatcaactttggtgatccaattgccacactacaactatctgaccaacacgtttctgtttctctttagaccactctcatctccaggaaccagctctctgtgggccacacatgatgtttgacgaagatcgttgcgagtgtgtctgtaaaacaccatgtcccaaagatctaatccagcaccccaaaaactgcagttgctttgagtgcaaagaaagtctggagacctgctgccagaagcacaagctatttcacccagacacctgcaggtaaatgccttgagttgtcttgcctttactcatgacatttaacgtagatgccattttaatttggtgggattccttagtaagctaatttttccccttggtgcctgagtcccttttggataatagaacagaggtttagcagctaaggaataagcaagagtataccgagtcatgattaatcatgaaaataagaaaatcaatcctgcctgttattatgtgtgtagagctttttttttttagacggagtctcgctctgtctccaggctggagtgcagtggcgtgatctgggctcactgcaacctccgtctctctggttcaagggagtctcctgcctcagcctcccaagtagctgggattacaggcacgtgccaccacacccagctaatttttgtatttcagtagagacggggtttcaccatgttggccaggatagtcttgatctcctgacctcatgatccacccgtctcggcctcccaaagtgctgggattacaggcatgagccaccgcgcccacccggggtttagagctcttaaacaacaatgaaattggtaaaatttaagcagttattaggatattgtcttaataataatattttaggaaggggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatatagcaagtaatttattcatgaatagaacacttgggaggttactgattcacttcagtagattttgaatccatgtgggataaccatgcaggattttatactgacattttaaatacatgtctggaaaacttaatcaaatcagagcagagttattcttttgaatccagtcattgattctgaattctcatctttattttcttttgcaacagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgttttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccattattcaagccatataattttatgttatttaatatgcttccactctatatttatgctaaagaaaaagtgttttaaagaaagaaaggaatttcaaagtggaaggtgcaggaagagacacaaacactggacctcagttttgggaaaccaagggaatagctctcagaaaggttaagatcctaaatgaggctaagcaaatgtgacccaagaatccactgcgaatcactctgtgccttgagattaaattgaacttgacctgatccccatcccatggcagaggggaacccatccatgcccttgacctctttgagagtttgcatttcttctagccacctctggctccaagtttctgcacttactcaaatctcagtgtcatggacaccccaactctcatggcaacacagttcttctctctgttctacagctatcactttttgttttgttttgttttgttttttgttttgttttttttttagacggagtctcactctgtcgccaggctggagtgcagtggtgcgatcttggctcactgcaacctctgcctcccaggttcaagtgattctcctgcctcagcctcccgagtagctgggtctacagatgcacaccaccacgcccagctaatttttgtatttttagtagagacggggtttcaccgtgttggccaggatggtctcaagctcttgaccttgtgatccaccctcctcagcctcccaaagtgctaggattacaggcatgagccagcgcgcccggccacataaagcctttttcctcaaagtactcctacatctaatttgttaatgatgtagactttattgaaattttgccataacagagagaatttagcagcattagcagatttaagttatgtattaaataacttaaaattaatccctgcatagtatcttgcatagatagatatgtatatagacacacacaacccattatggtacttacaacacatttgtgtaaatagtagtgttcctgtttatctccccaccatactgtgacctcattatgattggaaacggtgtcctgatcaaatttgtgtaacccaactttctcaggccagaacaccctggaacagtacaatcaaaaggagaaagacaatgataaacaatggaatagtaaacaaatgtagccccatggtagtggcattgtttgatcctggcccaaatccctacccttcctctgccagggtttctaagcagttcctgaattctcccttcattcactgaaattctctgaagcctggggctccaggtcctttgatgcttccctggctttaactctcagtccctgccctggggacatgagctaaccttcacctggccttggaaccactccccactgtgctgccattgtcattgctcttgtcatttactggtgccaacccagtcactcctcttttgccactgttctttttgccctcactttatgaccttgatgtcaacaggcttcttccttctcattttactgtatttttaatcaggcttctgaaaatgcttgcacataacttagttttttaaaacatacttggcattcgactctttgctttgccttttcgttcagtttctaccactcccaacttctccatgatatttgcttaaattcctttgagatctggggcagaagacaattcaaggataccacacaattaaaggagttactttgcttatcctcgactggtaaaaagaggggatgtatcactaaggagaaaagacctgaatttaaggacagactctgccacctaaacacattgtaagcctgaacaatgtcatcgagcctcagttttctcatctgtcaaatgtaaatgataatctcatttccctaaatctcagaattgataatttcattagagttacgattagtgaaaaaaaaaaattgaacaatacaatgtaccttatagctcaaaggaattattctgaaggaaaaaagcaagactgagcaannnnnnnnnnnnnnnnnnnnnnnnnnnnnnnnnnnnnnnnnnnnnnnnnnnnnnnnnnnnnnnnnnnnnnnnn

SEQ ID NO: 17158 - DNA, 28843 bp, Human; identical to SEQ ID NO: 11812

SEQ ID NO: 17159 - DNA, 28843 bp, Human; identical to SEQ ID NO: 11812

SEQ ID NO: 17160 - DNA, 29350 bp, Human; identical to SEQ ID NO: 11963
  misc_feature (1)...(29350): n = A,T,C or G

SEQ ID NO: 17161 - DNA, 25428 bp, Human
gagtggttaacacaaacttgctcaagggcacacagccagtaaaatgacatggctgggattccaaaccaggcaggtgttcctaagtctagattattatccactatgccatactgcctcttggagagcttgccatgatccacagagaactccataaagtgttgtattgtattcagttaaatgaatgtacataatttggctgggtgtggtggctcacatctgtaatcccagtgctttgggagctgaggtgggagatcactggagcccaggagttggaggttaaggtgggctttgatggcaccactgcactccagcctgggcgacagagtgagaccctgtctctaaaaaaaaaaaaaaatagaaaattaaaattaaaagaaatgaatgtgcattagtttatcaagcctccttttgtggacacctgagttatttctcatactttgctattataaaccatgattaaataagtaactatgtatactttggatatttgttgaataaatttctggtaggcagattgctgggtgaaaggaaaatgcatttgtaaatttgccagaccccgctgtggggttgcaccactttacctcagcttttccagcagattatgttagtaaacttttaaatttttgccaaatttatgggtaaaaatttctatctcagaataactttaatttgcacatttaaaatagtgagtttgtctgagcatctttttctttctctgctgcccaggctggagtgcagtggcacagtcacggctcactgcagcctccaactctcaggctcaagcgatcttccatcctcagcctcctgaatagctggggctacaggtgtagccccaccatgcccggctaattttttaaattttcagtaaagacaggatctcaccatgttgttcagactggtgtccaactcctgggctcaagcgatcctcccaccttggcatcccaaagtgctgggattacaggcatgagccactgcaccctgggcatctttttgtatattcaggagccatttggcatttccttttatgtggactgtttattcatatcctttgctcatttttttttcctactgggtttctgaccttgttcttactggtttcttattgctggcctagagcttgtgatgatataccagtgctaagcctactttgtaacagcgtctacaccctcagattttcagcagaaggttgttaatgcttttctttccttttcttcggtgtcttctggtttgtttttatgcgcacaacctctcttgagacagggggagctgagacagatggaaagggtgatgggtgggcaggcaccaaccccggagcacccagaggcccaggaaaaggtgtcagtcgggatctccgagtagtctggccctgctcaggagagcacagccgctctgatggtggcgcgacggttccggacctgtggggcctcagcggggccaaacggcaggccgagacagtatcggggccgggaaggtcactcacccctaaagggagaggcaccatgcgaggccccttcctatcctatgtgcggagactcacagggtccttcctggtcctgggctcgggaccgtgagagacgcagttggttccgagttcaggactaggggtccccttagatcctcagatcctgcagaatcccggctctgccccagtgggagccaaggccaggtcgccagagggactgtccgccggctggaggctgtgtgcaggacccacgcctcccaggctagcgagcgggcagcgccccggggctgcgctcccacggggccggcccctgccctgccctgccctgcccctagcccgcagcggcgcaagtggaaccgcatcccgctctttcgttttcgtttcccggaaggatagcgattaccggagcgcctcgcgcgcctgcccgcctgcggagggcacacgccttggcgcttctcgaaagagatttcctcccacgcgaccttccagttctcggagccaggttaggggtttggcggaggaggactgcggggcgcgggcctagggccccagcagccacggccaggggagcgctcaagacagaaagccggtggcttcctcacctccacctgtaatgcaggtaagagcctggcggctgaacacgcagcgcgcacgcagagccacctgctcccgcatcctttcctcaccacctagatttccaaacctattttatcagaccttttacctggcgggaatctctctttccaacacattcctaaacctcacatccatccctcactcacttccccttccacctccagacgcgggtcaccgcccctgactctctcggtgtcatacacagctctgaaggcatcacgcacagcccctgcgggccctttccgcagcccccttaccactggtcgcccctacaccaaccagatgtgaggtctttggaagttcgtgcgccagccaggtcctcacagctggtgaacgcattctcgcagggagcccctctttagcagcctctccccactcgccggttttctaggtgcctcgagactgcccccagagctggcgccccgtcccactccaaggcctttctccactcccctctcgccaggacccatacccattatcagacccttccctggcctccatgctgaaacccaggagtctgatcctcagcagctccgtggctggcgtttcccaggcagttacagcctcggaattccccgctcctcttacttggatgaggacagaggagtagacaaagagcctcctgcaagcctccttggcaagtccgaggcaagtcctgtgccttgagccccttctccagcaaggcaagcttccctttccccaccaggaggcaacccctgaggtctgattacttgggaaacagcaccaaagggggaccggctggaaatgaagtgagaacgaccccgaaaggtgttgaatcccctttcgcagcagccaaggcttctggagtttgctttgctggctccgatccaaattctctctcggcagatatctctcctcggatcccaagagatgaatgtaaagcttttgacaatcctagagtgaaaaatgacttgatggagctggtttcacttttcctttccgtgctgtggcagcctgtggctgggcatgagcccgaaggagcttcctattcctacaaaatcctgccactttcttcattttctcatctgaatggatgaaccccgtcatctctgggggccatgctgattgttgaattgtaaagatacaggcttcccgtggtgagaccttaggattcagaaatgtatccttatcctttctttttctcttttgaaaatagtgtttgtttgttctgagacggagtcttgctctcttgcccaggctggagtgcagtggcgtgatcttggctcactccaacttccgcttcccgggttcaagtgattctcctgcctcagcctcctgagtagctgggattacaggcgccggtcaccacgcacggctaatttttgtatttttcgtagagacaatgtttcactatgttggtcaggctggtctcaaactcctgacctcaagtaatccacccgccccagactcccaaagtgttgagattataggtgtgagccaccgcacctggtctatttgtttatttctgatttaaggtcttttgatcctggcccctcaggtttcctgtgttgtcctcaccagggatccagtgaggattcctaggctttcagatttcaatcatacaagtcttggcaggggatccctcttggagttaggcacatgcatggaaagcttgaattggaaggatgtcatttattgtgtccactgggtacaaaatgttgatggtactgagttgaagatatacatggttcctacctttaaggttgatgcagtcttctggtggagataaacactctttcccttccaaaaaaattcttaagacatttaaagatggctgagccttcaccaagatgctcttctttgactgtcctggtttttctctctctaggagggagaattggctatttctcctataagccctgtggcagccatgcctcccctaggcacccacgtgcaagccagatgtgaagctcaaattaacctgctgggtgaaggggggatctgcaagctgccaggaagactccgtaagtagaggggaggagaaaagctgagtttttaaaagtaaatttttattttgttttagatccagggtcttgctctgttgcttacttaggctagagtgcagtggtgtaatcatagctcactgcaccttcaacttccagctcctgggttcaagtaatcctcccacctcagcctctccaatagctgggactacaggcacactggctaattttaaaatttttagtagaaatgggaatctcagtatgttgcccaggttggtcttgaactcttgggctcaagctatcctctcgcctctgcctctcaaagtgctgggattacaggtctgaaccactatacctggcccttaaaattaaatttttttttaaataagagacagggttgctctatgttgcccaggttgttctcaaactcctgggctcaagtaatcctcccatctcggcttcccaaagtgctgggatcacaggcatgagccactgtgtctggccaaaattttatatatatctcataccataactttgtattgcataaatatatacaattattatttataatttgtcaattaaaaatttaatttttgccaggtgccaagattaacttaccttccctctgtttgctgtttctttgctgagttttctttagctttttgtttgtgatggagtctcactcttgcccaagctggagtgcagtgatgtgacctcagctcactgcaacctccgcctccctggttcaagcgattctcctgcctcagcctcctgagtagctggaactacaggtgtgtgccaccacacctggctaatttttgtattttttagtagagatggggtttcaccatattggcctggctggttttgaactcctgaccttgtgatccacccgcctcggcctcccaaaatgctgggatgacaggtgtgggccaccgcacccggccaaggttagaaattttaacacaacttctaagaaacactttctaatagtgaggttcaaacacaagacccacaactctcctctgagccctgggaaatcctatttccctaagaccaaacttcctaagctcagaggctcactaaatatctattgaatgaattaatgaatgaatgactagggatcttcatcaagaacaccaggacctccaaacaatgcaggatcacttctgtgggcccttctgagatggtcaccagatcttcctgcacacttctagggacaggcatttcctcccctcttgaggcagcctattctctgattgcataactcagggtgcaggtcaccgtggcctattttctcctagattagaactcctgagctaccagttctgttgccttgggttagatttccccaggagcagaccctaaaacactggtgaggagtagggaggaaagacagagaagagaaggaaatcccaaaggtgttcttttggtccagttagcaccacggggatctctggggacagtgaatcctaagttattccaaccagtgggtaaggggattatccactcacttcccttccatgacagcatgaatgctgtttccaggggtattggctctccagcatttccaagttaccctgtacactggctaaggggttcctgcagccagaaaaagcccaaggcagagtcagatggggcattcggcagccttcagagtgtggaggtgagaggcagggcctatgggcagggccccagcagcatcttctatacctgtcatcttagattccatgactcatatttattggaacatctgcaaatattcagacaatacagttctggcccttagtaaatacctgacagttttaaaagataggggatgacaaatgactcattttcctgtcaacagcatcccaaacaagcaaactgctgacaccaaatgaagattcgacttttcagccctgttgggggtgatctcagcccagtttcctaaatttctggaagctgggtttccatctctgcccatctctctgatgtttattccccgtcacccaccccattccctcccctacctccaacctccattttagtagtcaggactgatttgcctcagcaggaagtgaataaacaaaacagatcttgtttagccttgtgagttgatgctaagaggagcacggaagttattttcctgtagagctcactttttttgtgttgattttcctgacaaagatgtgtagtaaagcagtggaaagtccactctgaggacaaccgtgatgtccagggttgtggcaagggtcaggaggtctactgggatggaggagtgggattcacggagattcacaactatgcttccctgtatggaaatggggaacaaaagaggattctcacctccccatccctggtccatggccatgagggtctgcccaaggccagagtgagtcaggagctatggggggacgcagctgcagggcagggacagctggcagtgcagactctaggaccattttcagaactgggctgatatcacaggggagtgggaggaggtgatgcaccctcaagggacaacttgggagaattttgagaggaggcagttcagagatggtcaccaccatggcctcattcagtgacagagaaactgagactcagggagggcaagggtcaactgtgatgctaatggccagactaggcctccaacccaggactcttacttctcggtcctgcgtctcttcttttccctggagcttattccccagagaaaaggtctgtgaacttctcactttggatgcagaggaaatgagacttctttgtgttttgaaattgactttcaaagctcctagctgtaaataagccatgggaagagacgtagagtgccgtgtcctatattcagagttgcaaggagagggataacacctctctgtgactccctggaggtgtaaagcaggagaaatgggcctttgggaagcttgaacagattttgggtgcccatgctgaagttcacatccttcacatgtgagagagttcctgggcacttcatttaatagatcagcgctaacagttgtggcttcccggtattccagaccagggcttctcagattttaatgtgcacatgaatctgctgggaaccgtgttgaaatgcagatgctggttcagcagtaggtctgggatggggcctgagattctgcagatttctaataaactcctgggtaatgctgatgctgctggcttgagaaccacattttatttattttcaaagtgctggtcaagacttactaaggaagtgaaatccacttagtggaccaagataaatatttttaaaaattgaaatagaacaacacatcagagcgcattataaatagtaaaggtagctgagattcgtgactactttgtttaggctatttttatatatgtgtgtgggtacaaaatattatttgtttaccatgggttgaggtcaaaaatggtttgagaaatgctgccctagatcatggcctatgagaagcaggaggttagatggatgtgggtgtaaaacaccagagaggtggggtggaatgggaggatggagattaaaagcgagtgttctaattcactggaacgtgtgagtactgacagtgacatcacctggcaatgaaaaggaatgtggcggtgaggacccaaacaagcagatggggaattccaagaactattaatatgaggataaagaacctctcccctccctaaatgcagggtctgggctagaccatatgcatctttgtgcaaattggaaagactcctcctttggggagaagccaatcaaagtcccagctggatttcacctccatcctcccattcccctcctctgatggtatctttgtgcagtacacaacgtgaactgtatgcactggccctgcccccacagtgtggtgatgaccgtaaagcttggtgtgattaccaagaaaaggattatcgaccaagacaatggggccaagcaatggggtgacagatttaaggagtctctgaagacaccatgacacacaataaactaaggacatgataattgataaaacgtagtcatcatggcagagaagcaagctagtctctctgttttcaggctggggtctgatgatcagcatcctgatcatcagaataaaggccattcattcgttgagtttttattcttgacgaggtattgtgatgagcataccgtatttattatctgattgaatatattcagtaggcatggaaagtagctttttttgttatctccgccttacagttgtgtaaactgggccataggtgaattatcttgtccaaagccacctaccagtaaaatggtggagctgggatttgaaccggcatccctcagaccccacagctgtcatttgctttgagaaactgcctctagcctcaggtgatgatagctcccatttttagggtactggccaagcactttaactgcctcctgcattcttcctgcaaggggatcctgcaaggtagggagaagccagctgttcattctgatttggttgctaaaggctggtcaggctctgtggctcctggagctcactagacccagtaaactgcaggggtgtggtgggaagtggtgggaaatagctttggtcaggtggggaggggcactttgaggggtcttgaaaccaggacagaggggttttgacttgatgggcttggtagttgggaacaatagtttcttcagcaagagagtaaaaggggtgctgtgggaagagaggtccagtcggggtcggggtgggagtcaggggctggagaaggggcaggcaaggaggccctgggggtgaccccacactgctttgctcaactcacttatttaagcaatttatttttattgagcagctactatgtgccaagcattgctataggggctggagagaccacagtgactgagacaggcaaagtctgtgcctcctggagcttacattctagttggggattcagtgactatgtaaagaagcgctatgtccacagataagggcagtggacgtgatatagctgggaggtggaggggagcccccacatgtagccctgctctgggaggaggtaggggacaacagtgttgactcttcagggagacacctgagccctccaattgtgtcctggacaggcagctcctcttgctgccccagccaggggactctgtccatatctgccttgggagctgggagtcgggagctggccaagctggaaatcctcagttagcaggccactgggccgggagagtgaggtgacatttgcctggagtcttgagagacaaagatggttaatgggaaagaactgaaaatgcaatggattattgccaagagagggagaggccgggggctgatctgcaggtgaagtcccacattcaccttacattgggaaggggagccccagttactctcatcctggcaactgggtcagggagacttcttgagggtgattgacgccctagataatacccaccaggtgttggaccctgtgccacgcattttacgtgtattacctaattgacatttatagctctatgtgtgtcaaaaagcacatgccacatgccagatgctgcttttaaatgggttatctgaaagcatccttgtgacagccctgtgtggacagtacaatttttttcatcatccttggtttcactgatgatgaaactgaggtactgtcatttaggtcacattatttacagctggcctggcaacatcatctatgctttctgttgttgttgtatgtttttacttttttttttttttttgagatggcgtcttgctcagtcacccaggctggagtgcggtagcttgatctcagctcactgcaacctccacctctggggttcaagtgattctcccgtctcagcctcccaagtagttgggattacaggcacgtgccactgtgcctggctaatttttttatttttagtagagatggggtttcaccatgttggccaggctggtctcaaactcctgaccttatgatctgcctgccttggcctcccaaagtgctgggattacaggcatgagccaccacgcccggccttcttctttttcttcttcttcttcttcttcttctttttttttttttaagagacagggtcccactctgttgcccaggctggagtgcagtggcaatatcatagctcattgcatccgtgaactcttgggctcaatccctccctcctcagccttctgagtagctgagactataagcatgcaccaccatgcctggctaattaaaaaaaaattttttgtttgtagagtcaagggtctaactatgttgtccaggttggtctcaaactcctggtttcaaatgatcctccctcctctgcctcccaaactgctgggaattataggcctcagccaccacaacaggccaggaatcacagttttgaattttcaggctgacgcctccaatatggtgaactaggggaactacacaaaaaatatgagttcaggtacaatgcaattggcggttgacaccctagccgcggaagccctggctggctgtggaggcctgccctcgacccctcaggaatctgcccatcgtgtggcctccacattttacactaagtcagctttcggcgtctcatgtatcaccagactcatctcccatcgcggctctaaattcctatcttcaccagcaaagcatccttttccctgcactcctgctattaaatatcttattcttctctgatggtacatttccctgactattgaggtgacatgtcttgtcacatgcttattggtggatttgctgtgccacaggggatctcacctggcagcaattttgctgctcctttccccccggggacatttggccgtgtctggagacatttttagttgttagaactaggctggcattgagtggatagtgaccagggtattcctaaacatcctgcaacacacaggataggccttcacagcaaaaaattatcagtcccaaagagtcaatagtgctgaggttgagaaatcctgctttgctgggattgctggaaagattttttttgtctttaaaaaaatcaatttacagatgctcttgacctatggtaggcattaaccttttatctgtcatctgcattgcaaatatttccccgaaatctaccctcttttagttttgtttatggtatcttttgcagcaaacacagaaaattaatgtagtcaaatgtgtgtttcgtttttattacagcctctgcgtttcctgtcatggttgaggtcctctctgctcttattgagtgcatttggtttttgatttctacttctattaagatttgtatttttctattctttatgcctttaatctacctacaattgatttttgtgaatgtgaatggtgggaggtgaggacccaaatgtatttttttccaggtggagagtcaggtttttttttttttttttccatattagattaactatcctttccctctgaattaaaatcctgcctctgtcatgtattaactttacaaaatatacatacacacataggcacgcgtgtgtgcgtgcatgaacacttacttgctcctgggctccaccttcttttccaatgatacttgccaatcttagcataagaccattcgatcttagttacatggctttgtcacatgcagtaccacagaggccagttctcacatgtattcttttttcctgccttaaataatttttttggcaatttcagacatgtactcttttctcttactcatttttaggtcccaaaatagaagtaaaggaaacctttcctcactcttaaactgggctctagctccttgctttctgttttctcagcacagtgaacgttccctgtgtgccgtcgggaggactatcgttagagttattggtggtggggctcctccctcctgccagcctggttctgtgccgtgtccctagccctgcacagtgactgacacaagctggtactcattagatattggctgaatgaatgaacaaggaaagatgcagatctcctttgttttaaatgttaaaattaagttcatttcctgtgttgctttgagtataagggagcagaggctggtctggtctttatcattgccaaggtgtggccttggacagttgcttctctcttctgcctcaactttcttacctgtagaactgaacccagtgagctctgagtctttacaccagtgcagtcataaaataggatttaaatttatgtatttttttgatacagggtctcactctgtcacccaggctggagtgcagtggcgcaatgatggttcattgtgacctcccgggctcaagcgatcctcccacctcagcttcccaagtagctgggaccacaagtgtgcatcactatgcccggctaaattttcttttttgtatttttggagagacggggttttaccaagttgctcaggctggtctcaaactcctgggctcaagtgatctgcccactttggcctcccaaagtgctgggattacgggtgggagccaccacgctcagtgtattttaaatattttttgcccacaaaggcaaatgtgtcaagggctcatgaagtcgtaacgtagccctgctgaacactatccaaaacttggcattaggagcgtagcagtcccaggcaaagtggaaacgtggggagaataagcagccacttgtctggctactgccagaaataaaaacacatgcactgaaggtgagtgtaggaggctccctttgtcccctgggctgttccctgagcaaacctgattccaagttggcacaatggagcagaaaagttcaatagccagacagcccggctgtgccccatgctgcctgtatgcgtgtgggctagtcacttaacctctgggagcctcactgcctcatttgggaaacaataacatcccttccttttttttttttttttttctttagagggagtctcgctctgtcgcccaggctggagtgcagtcgcatgatctcggctcactgcaacctctgcttcccgggttcgagcgattcacctgcttcagcctcccgagcagctgggactacaggtgcatgccaccatgcccagctaatttttgtatttttagtagagatggggtttcaccatgttggccaggatggtttgaatctcctgactttgtgatccgcccgcctcggcctcccaaaatgctgagattacaggcatgagccaccgcgcctggccagtaacacccctttcattgggttgttcagtcattcaagtactcactcaacatgtgttttctgagcacctactgtgttccaggcactgttctaggtgctgaatacacataacagtgtgctccagcacgcctagtccagtgctggcacatagtaggttctcgttaaacacttgttgaatgaatgattggaaaacaggtggtggggaggtaccaacaataaataagtgaataaatacatgctacatacataatgacaaacacgaacacataattctatccaatgtaaaatgtaattacaaagaacgtaacatgctaggaaggaaagaaacaggtggcagcgacagaagatgatgggggttgggggccaggacaggggagcatctgctcagatgaagtgttcagggtgggcttctttgaggaggcccgacggggagtgatgggactggtccttgctggttgcaggcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtcagggaaacgcacaggctttcctctaagcgggaaccctggtaggccaggatggcccaagtacccccggggggcccagggagggagatggaggggtcttccttggggaatcatgctcatttccagcactgcagatgcccctctgcatacgtgtgtatctggtggttcctagctagagcaggccttcagcaagggagtccatttgaccacttgttttcagagctgtaggggcctgttctgctctctcgctttctcttccctttatctgtggcccttgtctcctctatccacttccatcctgttgcctcccacccgctacccctactgaacaaaaaaccaactagagaaagatcaaatattcattcacactgaggtataaatgggtggtaacagcaaaatccttgacttccaatatgacttttgattttaaccagaaactaggtctgagggcaaaggaatgaatgtcagatgatggtgttccagcagcacggagtttgtggggagggactggtggtgggagggagggtggccagtggtagcgggcagcagggccttccaggaacctctagaatcgcatctgagtcttgtgtggcttgttttcagtggctcttttgtttgtgctgatttggtgtctttttcttaagaattcgctcatgttttctgtgttccttgtcttttggccaagcaagcccacagtgtatttggcaaagagacgttctgaaatctgctgatttgcctgtttatacctaacacatacagcccagtctcatgtcacatcccaagttcttttttttttttttttgagatggagtctcactttgtcgcccaggctggagtgtagtggcgcgatcctggctcactgcaacctctgcctcccaggttcaagcgattcccctgcctcagcattctgagtagctgggattacaggcgcctgccaccacgcccggctaattttgtatttttggtagagatggagttttaccatgttggccaggctggtctcaaactcccaacctcaggtgatttgcccaccttggcttcccaaagtgctgggattacaggcatgagccactgctcccagctgacatcccaagttctatcacccacttcccactgtgagcctcctgtagcagctgctggaactttcgtctctctaagagcttggattcaagagctctagtgggaggtgaggggagggcagggacagagagacaaggcttccagcttccccacagccctgatggtcctgcactgaggcaaagcggggaagcaggtgagcttggggctggtccccttcatgcccttgttcgtctctccaccttcctacaagcactcctggtcctcgagtgcccactgtctacattgtatccctctggctgcctgggatccccagattggctctctacccacagatcccctctttcctgccctactatcagcaccttagcccaaggtatgagtcaaaggagatttctgggaccaaggacagagcccaattctggcttttttttttttgagacagggtctcactctattgcccaggctagagtttggtggcgtgaacacagctcacttgtgcctcaacctcctgggttccagtgattctcctgcctcagcctcccaagtagctgggaccacagatatgcgcaccataaccagctgatttttaaaatttttgtagagacagggtctatccatgttgcccaggctggtctcaaactcctgggctcaagcaatcctcctgccttagcctcctaaagtgttgggattacaggtgtgagccaccgcacctggcttttcctttcttcaaccatttattgaagcagctactcattctgccttttaggaagaggctaagacagctttgctccttagaaggcagggcagactttcaataaagcttggaatcccatgagccttagaactgtctctgctcccaggaacgtgaggtacagttgcacagtttatgcactgtgcacaagccctcagccaagggtgtgtgcgagggttgagaaacagcctgaccttgcaagctgcatgccgtggaggcggctgcgtgtaccggcaggaaaggatgtctttctaaaattcatccaccacgggagcagcagcatctctgcccattgccagcccagcctcctgttagctgcagcaggaacccctttgccatcggcatgaagctgtgacaagacatgccagcccttgccctgaggcaggtggctgcagggggatgaggctggccctccccacgtggcctgttcagcagcctgccctccctcccacccacctccaggtgacgtcctgtatgagctgctccagtacatcaagacccagcggcgagccctggtgtgtgggcccttttttggagggatcttcaggctgaagacgcccacccagcactctccagtccccccggaaggtgaggaagctctctgtggtgctcggagtacctccctcaaatcagcctcactgggagggcaggacatcctcaaggcgaagcaatgaaagaggtggccagtgtgggcaagctcccctcccgccccacccccacctcctgctctggggcgttcctggccgcccttcctctgtgctgcaccctccatgcctcccacctccccattctctgctctctccagcaaagagttgtttgtatcatgtctcaatttcctctctgcagccctccgtggaaaccacttgtcaaggtctccagaaacctgaaaataaggatgtccattccatggccactctcagtcctgatttactgtggtctctcgcagcctttgaccctgggggtcacctctccttccttcccccaaaactctttcttcccttggcttccagaacaccccactcacctggtctcctctaccccactggtgtctcctcgacctcctcttctggtttctactcttctcccctgcttctagatgttggggtacccctctctgcttctctatctgcattcagatgctgggcaatctcatctgatcctgggtcttaaacaccatgtggtgccaaggattccaatatatgtcttcctcaacctctccaaattccagatatgtgcacccacgctgcctgccccacccctccactggggcatctagtaggcctctcaacacccccagcccctaaaccaaatgcctgatatcctgccctttccagtcttccccagccccacaaaccccacctccacccttccaattgctcagatgtcatcttagatttctacccccacccccactcatcccaactgtccataaatcctgtcagccctaccttcaaatctgtccagaatccaacctcttctcactcctctcctgctgccccattccagcccccattgcctctggagaacgtcctcactggtctccttgcttctgctcttgacctcctatgatctattctccacagcacagagagtttcagaagtcaggtcacgtcacttgtctgctcagcatcttccagcagctcccttctcactcggagtccaagcgcagttcttccgctgactcctgcccttgccttcccctcccagccttctcccccgtgctcctgctgctccagacacacgggccttcgggccttcttgttcactggacaagtctgagacgctcctgccccagggcctttgcacttactgttccctctgcctggcatcccctctctgctctagatacccacagagctcactcctctacctccttcaggtctgttcaaatgctaatgtcagggaggcctgagcagcctctctaaagtggcaacccctgctcctttcccagatttccctatctgccttagggtgatttatttttttcacctcatattgtatactgtttctgtttcctttttattttaatcgtccatctcccctgctctcaactagcatataagctccctgagggcaggggctttgggagctcagcgatatatgctcaagattcttagaacaatgcctggttcatagaaggctctcaataaatactcgttgggcaaatggagaggacatgggatacagggcccctgggttctagacctggctctgtcactgcttggctttgcagccattttcatagatgagggaacaggcttgacaggttgttacttgtgtgggagctggggttagcacttaggctgtctggccctcacccactgccccccactgcctccctgaccttctaaccaggggctggttggagaaagagcatcaggagtgctgccccacagggctcccaggctcaccattgagggattgagttggggaggcttggggcccactgcctgctaccactggtgctcatctgcttgcagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctggtgagtgggaggctgttcctctggccatggaaggtgcactgagtctgagtctcagagtcacgagtgatgaggacagggctattttgacctggtgatgggaggtctgtggctgggggattgcagggtagcgttgactgtcctgtgtgctagccacaatctggtcacagagggcagtgatacctgggatcaccaagcctcaccctgtctcccacacagggacaatttacccagtcatattctgacactcacattagcatggagtgccacacctgccttttaaaactttatctgttttaaaataattgagcattcactatgtgccaggcgtggttcccaagcccttatttaattctacaatggccttttgagtttggtactattattagccccatttcacagatatggaaattgaggcacagaaaggttaagtaacttctccaagatcacacagcactggttgaggtgtgatgtgaacccaggcagtctggctccagatcctgagcgctaaccaaatgatacacttccactctgcattcattgttaaaggattaacaggcagacaaccagacagactgacagataagctgaagggtgtttttctagtcataatagtgacactgcatttattctttttttttttcaacttttattttaggttcagggggtgcatgtgcaggtttgttacatgggtaaattgcgtgccactgaggtttggtgtatgaataatcctgtcaccaaggtactcagcatagtacttgataggaagtttttcttttcttttcttttctttttttgagacgggagtctggctcttttgcccaggctggagagctgtggcatgatctcaactcactgcatcctctgcctcccgggttcaagcgattctcctgcctcagcctcctgggtagctgggattacaggcgcccaccaccacacctggctaatttttgttttattagtagagacggtttcaccatgttggccacaggctggtcttgaactcctgacctcaggtgatccacccacctcggcctcctttggtgctgggattacaggcgtgaaccaccgtgccggcctgtgataggtagttttttccaccctggctcttcccctgtagtggtccccagtgcccagtgtctattgttcccattgttatgtccacaccacatttattctatgaagccacagagtgggcagaagcctggcttttgggttggaaatgactagaagtcactaaaaaacaattggcccaacacatagaaatgatgaatacttgaggtgatggatgccctaagtaccctgacttgatcgttacacactctatgcatgcaacaagatctcacatggacgccagaaacatgcataaatattatgtatcaataacaaacacaatgatccacaattactgggtttttttttttttttaagagacagggtctcactctgtcgccaggctggagtgcagtgatgccaccatagctcactgctgcctcaaattcctgggctcaaggaatcctcccacttcagcctcttgcaattactgaattcttcaattataatgcttaacattcttcgtgcacttacagtataccaggcactgtgctgagggttttgtggtctattatgttacctaattctctcaccaccccatacaaggaagctggctcagagaaggttgtgtaacttgcctgcaatggcccagccgacaggcccaggtcctgggatttcagatcacacagttgctcccggatgcccacttgccctcccaatggcatgcctggttttcctgagcctcaccattagggagcttgaaggggtggatgttataattaatagaagtccagggggctgagtgagtgggccaggggcagagagggacctggggtcaggggcccagcccctcagcctgtgggcccagcacctgccctcacatggctctgatgctgggtggagccggtcagactccctgctctacctgccacttaggagcttggcaactttagatacctctgcacctctgagcccatttcctcacctcttcctggggataaaggtaacgacttcccagactcaggaagactgcctgagacaatgcgtgaggagccccattagtggctgtttctgttgatatcatcattttcaccttcctgctggtgctcctagggctctggccgggaggcttccaagagtgcctttctaacacctgtcctcacagctccagtaaagctgcgctgcctgcactccctgtgctaaattgcagactgccgcctgctgtgggattacgtgtatcagctgctccttgatacccgatatgagccctacatcaagtgggaagacaaggacgccaagatcttccgagttgtggatccaaatgggctcgccagactctggggaaatcacaaggtgagcctcggccagcagaatggtctcaacataaccagaaggggacagagttgggggtcagagtggacccctagcactatgggacaatcctcagctgatggggccttcatcagcagccccaaaagtgacaggataattttatttggggagctattgagggacaggcagttacctcttatggatggggaatgtctctgaaactgaacaattgtgtcttctcattgcttaatcttacctttgcttagtatttcaggctttagaagcatgtttacatgaactgcacagttaggccagatgaggaagctgctttcctgcggggagctggacagaaacccaggtctcaggcccaacaggagcatctgatgtcagggctggaaaggcctggggatgactgaggccagcattcccatgatgaggaatgcctatacctaaatgggtgtctgtaagatgatcttaggtggtttaatatcctcataattatttttgaattaggattacaaaatgtaactaccatgaccatctcatgatttacagcagtgatataaggaatgtagccttttaaaataaataggtttctttaagtaaaaaaaatcttttaaagaaaactattaacgataatgataatcatcgatttatagcctttcctaagatgtaatgtgcctgattgccaggcactgccctgagggctccacttgtactaattcatttaatcctcataccaagctcgtgaagtaggtgttgtcggatgtggagactgaggctcagtgagggctaacaacttgccccaagtttacccatcccctgctatgtaagaggcagaacagggagttgaacccaggccatgtgctgcactatattatactgctcttagcagtgctggtggctggaaggatgcagatgactaaagttcgggaggacttattggtctaatcctcatatagaacagggaggaaaacaggcccagagagcagcagtcccatttaatgagcatatactacatgccatacactgtgctaactgctttcatggattagctattaataatttaatccttgacttatgcgatgggtgttctccttttcattatgtagctggggaagcagactcagagaggtcaagaaacttgtccaaggtgacacagctgacaagcggtggagctggggcttaaattgatgccacaccccaggctctttggccctacctcacactgcctacccccgagagagaaagaaatgacttggccaaagtcacccagggtgtggcctggcaaggccatccatgccaccccaccatactgtctctctgattgcatttcccacaaatatatatatttatttgttactgttgtgacatttgctgtttaaaagtaacatgcagttcactcccacactatgttctcagccaagtaggcaggagaacctttccatcatttccttccttccttccttcctttcgccttccttccttccttcctttctttctttttgtaatggagtctcaatcttttgcccaggctgtagtctagtgacatgacctcggctcactgcaacctctgcctcctgggttcaagggattctcctgcctcagcctcctgagtagttgggactacaggcacgcaccatcacgcctggctaatttttgtatttttagtagagacagggtttcaccatgttggccaggctggtctcaaactcctgacctcaagcgatctgcccacctaggcctcccaaagtgttgggattacaggtgtgagccaccctgcccagccccatcatttcttccccaaccttcccctgcctttttccttccaaactcaagtgagcactcataaaccctcacagatccctggaatgagaggcttaagaagctgtccagtccaccctactcccttccaggtgtggaaggagcaggacatggggagtggggctgatgtggggctgctttgctttccagaaccgggtgaacatgacctacgagaagatgtctcgtgccctgcgccactattataagcttaatatcattaagaaggaaccggggcagaaactcctgttcaggtgagtggcctaggggatgtggtgaaaggggaagcagaactggggttgggtgggctggaatccccctgcagctggggcaggagctgatttgcagttggggcctgaattctagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctgatgtttctttcttttatttttttgagacagtcttgcgctgtcacccagggtggagtgcagtggcacgatctcggctcactgcaacttccgcctcctgggttcaagagattctcgtgcctcagcctccggagtagctgggattacagctgcccaccaccacacccggctaatttttgtatttttggtagagacacagggtttcaccatgttggccaggctggtatcgaacttgcgacctcaggtgatcctcttgcctcagtttcccaaagtgcttggattacaggcgtgagccactgcgtccagccgatgtttcttaagtgtttgctatgtgccaggccttgtgctaagggccttgtggatatcttatctcatttaattcactcggcactcagacgtgaagatgaggacactgagggagaggcttgtggagctggcccgcctctccacaacccagggcttcgacctgttttctttcagcacctctgactgtatgtggatgcttcttagccaggccccggccccacctctctgctcttggcatcttcactgaatagtccatttcacttggcccagccccctcatcctcagttttcagtgactacgacccagtgaagactggcccccgtccccacacttgtggcttcctatgctcctgtccctgtatctgctgtgggactttgggcaaggtgttccgcctctctggggcctcaggtttctcgtctgcaaaatggggctccttctcctgacctgacctctggggttgtcggaaagcttccataaggcaatacttgtgaaatgcttaatgtttgcctgctctgtggggcgtgcttcacctgtgttagctgagaagactttgcagaccagaagctgctctgaagcatgaaaacacctcggtccaatgggtcagcttctccctctgtgccctagccccaagtactgattggggcctcctgagggccagagcctctgcccttgcaagccgtcaggtaaagctcaggtagaaggagaagggagtattttcatttaaccaagaatagaactcctcggattcatatcttctttctcagaaggaggaaactacctcagcctcttgcccccagccggtcaggaaatccccgtctctgctggcgcctgcactggccttgagtcactgcagagaagtccttgataaggactcttggactttggggctcaaagctgtgatagcccatgagcagggaaactccaggcttagtcctatctgggaccctcgatggtactcaccggcaggggggcaggcaggtggctttggaaaaaggatcgatgggaaaatgctttgcccctttcactttccctctgagactgttccagctccttgactttgctctgcgatgagcccatgccccatggcctctcttattgagagatgacagcgtgctggcagtcctcacagccctcgctcgctctcggcacctcctctgcctgggctcccactttggcggcacttgaggagcccttcagcccaccgctgcactgtgggagcccctttctgggctggccaaggccagagccggctccctcagcttgaagggaggtgtggagggagaggcacgagcgggaactggggctgtgcgcggcgcttgcgggccagctgaactttcgggtgagcgtgggcttggcgggtcccgcactcggagcagccggccggccctgccagccccgggcaatgagggacttagcacccgggccagcggctgcggagggtgtactgggtcccccagcagtgccagcccaccggcgctgcgctcgatttctcaccgggccttagctgccttcctgcggggcagggctggggacctgcagcctgccatgcctgagcctcccacccgctccatgggctcctgtgcggcctgagcctccccgacgagcgccaccccctgctccacggcgcccagtcccatccaccacccaagggctgaggagtgcgggctcacggcgccggactggcaggcagctccacct

SEQ ID NO: 17162 - DNA, 13533 bp, Human
acatctaatgggctgactcctccattcattctccacacatttgctgatatattgccatgtgccagaaatgaaaaagacagattgcctgactgaaataatggcaggtgttgttgtgtgatgatggcaccccaccctcttctcagaatgatcttccaggctgtgcctgaggctgcaggactgcccgggagggcttggggcacagagtttgggggctgcagactccctagtgtggacccccggcttgctgtaagcccctagcaaatttctttccttgttcaatagaccttctttttgacaaagtgaagcaggtggtccccgccccttccacagccccatgcctgggcaagagaggggttggacaagtcaggctgggcatccagagcccttgcagccatctcctccccccacctgcccaccttgctcctcagaggcctttgtggtttgagcatagaatctccatcaggctgcacaggccaccagacaggtggcaagggccccaattagtcattgtcctcatagagccttaggaagtccacagaaactgtgttcaaaactgcacatttgggccaggtgcggtggctcacttctgtaatccaaacactttgggaggctgaggtgggcggaccacctgaggtcaggagttgaagaccagcctggccaacatggtgaaaccccgtctctactaaaaatacaaaaattagctaggagtggtggtgtgcacctgtagtcccagctactcaggaggctgaggcaagagaattgcttgaacctgggaggcggaggttgcagtgagctgagatggcgccactgcactccagcctaggcaatagagtgagactccatgtcaaaaacaaacaaaaatcctgcacatttgaacctgcgtggatatttggtattatagaattagtgctattaattttaggtttaagaatgtattgtgggccaggcgcggtggctcacgcctgtaatcccaacactttcggaggccgaggcgggtggttcacgaggtcaggagttcaagaccagcctggccaagatggtgaaaccccatctctattaaaaatacaaaaattagccgggtttggtggcaggcacctacaatcctagctaatcgggaggcggaggcagagaattgcttgaacccgggaggcggaggttgcagtgagccgagatggcaactgcactccgacagagtctcaaaaaatatatatatatagtattgtggatacgtacttttaaaaatccttacgttttagagatacaaaaatatttatgaataaaatgatatgacgcctgggttttgcttcaaaacgatggtgggagaggaatgtggatgaaataaaattgattatgagttgtggttgctggggaattggggtcacgggggttcattagaacctcctatcagatgtggttcagaagcctcagatctgggagctggctagaaatgcagaatctcggctccaccccaaacctactgagtcaggatctgtattttaatcaaataaaatgcccaggggattcctgagcacactgaagtgtgagaagcgctggcttactctgttcaattctttcctgcatgtttgacattttccataatgaagaggttgtggggttttgttctgctttcctgtgtgttcacagtcacagggagctcttcctacggagaccggggctggagggaactgggaagcactgcctccccgctcctgcttggacccaccagccccgccgctggcccgcgctcggctgggaggcaccggggtcccgctgggcagccccgaccccgtgcctgggccgcacctgccgcagtggctccgtcgggccgggcggaagcgcgggagcgcagggctggacaggcccgggcgtggcggccccggcgcacctgggcgagccggcaggtgggagcgtagcagcccggggcccccgccctcgcgcgggggaggagcgggcggcgcggggcgggcgcagcgggggtcggggcgctgggagcccgttgggccgcgaacgcagccgccacgctggggccgccgagatcgggtgcccgggatgagcctcatccggaaaaagggcttctacaagcaggacgtcaacaagacagcctgggagctgcccaagacctacgtgtccccgacgcacgtcggcagcggggcctatggctccgtgtggtgagacccctgggccgctggggggcggggggcgggcgccaggctctcccctttccgcccagcccgccctgggctggcccctcgccagcgccaccttgaccgcggacctcaaggcccagcgccctccccggggccacccagcggccatctcccttttctcaccgagtggctgagtgaggtctctgggggttgagttgggactgggcctggttctccaggactgtacacttgcaagaccccagagttcatcgggcagatcctcactgttacagacgagtacaccgaggccccaagagggggaggtggctcgccaagttgcagacagagtgagactcccgccctgccgtggatcccgtcgcaatgagacgttgctgcccctggcgctgtgcccctctctcagctcctgcctggcttcctactccctgccctgcgtcccgcggctcccccatattctaggtggtgggcctagtcccctctcagcccagctgcccagtgggaggggtcagggcggtctgggagatacggcccaggaggagagcctcgcctgctgaccggcctgtgcccgacagctcggccatcgacaagcggtcaggggagaaggtggccatcaagaagctgagccgaccctttcagtccgagatcttcgccaagcgcgcctaccgggagctgctgctgctgaagcacatgcagcatgagaacgtaggtggtggctgccccggggagggggtgggggctgccctggggagtcaggggcaggcgcaggcggggcctcccggtatggagagctcgggacagtctcctccctgctcccctgacggtgcctctcgcctcactattgaaaggagggggtgccgagaccttccctgcccactttccaggaagaggtcaaagggtatttttggcagaatgcactttgtgaggtacagactgtgttatcctacagaggaaattggcacaggggaactttgtaattggttccatgtctgagagcttgtggccagctgggactagaatcctagttagcgttgtgtccacgtgaccctgataacaatagcaatatacacatattgagcacttcctatgttctaagagctctgcatacactaacttgtctagtcctcatgatatatgagtactactgcccccatgtcacagacaggaaactaaagcacagcaaggctcacagattagatggttagtcagtagcagagctggggtttcaatctcggcagcgaggctcccggtctgagcacatgaccatcagattgtcttgtctgatagcagcagctgggaaaaccaggggcccagctcagggcctggcagccaggctttgctgcaggatacctagattggagggcagacatttcaaagaatgatttcaaaatgttatgtacattttaagcccatccttctccagcaaacccctcccctatggcctccagccagggtgatcttgcccttggctctgaaccagccctgtggcaggcaaggatggatgtggctggagacccaaggtcaggggcagggagtttgctggctgaaaagctccttctctgttccctcctttttcccttccaccctccccttatgctttcctgctgcctaggtgagttgagagtgggtttgtgttgcttgccctgacaccagacttgacagcaatgagcacacatcattctccccaccttcccttctccccagcctgactctctgtcatgatttattgcaaactccctccaaatccaggggattcctctaggcctctgccctttttactgcttccaagaaggttggagacatgcctcctgctggaggtggtgtattaggaaagggtggatggccctgtgcatggccagggcccaggaggaggtgggaggagaaggtagcgtctgtctagccctcacaggtgacttcttccccaggtcattgggctcctggatgtcttcaccccagcctcctccctgcgcaacttctatgacttgtgagttgggctgcactgggttctggggcatttgcaggccttacatgccgctggggagcaaggtgggggagggtctagggtttctattccgggtgtggcggggagagcctccttccctggcagtcctgtgcctttgcctgtcaagtgtgattctctctggaaagatgcttttagccaaaggcaggcaggaagaggcaggaaggactttgtggggtgcttgcctggcagggggcagtctgcacagctgctttgctttttacccagctttaacaccatgaagacacatctgccagtcctcacagggttagcaccaactcacctttcctggggacacagatgtgagtctggaccttggagctctttctagcatgaagcaaggattaagaagccttggctgcctctggctgatgggggtgtttgacagaatggcagaaaaccagaatatttagctgcaaaatgtatagctttgcctgtgcagtgtctgaatgagactggactatttggacaagatggagaagtcagtgtggcacgtggaggccagcagctggcttggtcaagctgaatctggactgaccctacaggcagcctcaagacctggggactttgagccgggaggtgatatgttcagatgggatttgggggatgcacactggcagcagcaagaaaggagtaggaagcagctcggaggcagagggggagagcctggaggtcagtgttagtgatctaaagtagggatctaaagcagaggtgatgggatgccaagagcagacttgaggccccatttgggaggcagggccgacacaatgttccatctgttggggtgcagtagctgagtgaggtggcagaggtggaggaatgggcaggttcctgcttgaaatacacggtagaggaagaacagatcttgggggaaagataacgaactccattttggacactttacttttaaagaaactgtgaacattccaatgtttaatcacagttgcaaataaatatgaacctcaggagacgaaggtctgggctagggatgtggatttgtgctggaataatcaccgatgggttatagctgacacccgggaacagataattgtagaatgtggtaagatagtattgattcagatatcaacatgaaagagaagatccaagaggatgagcagatggaagaagctgagagggcctgataggaggcagaggagagtcagcaaagaattgagagggagtttcagacttggtgaaaggttagatcagaagaaaagggagtcatggtgtgtttgtcgggtgttcactggtgaccttgagctgagcagtctggcagtaggagggaagcagaaaccaggttaactcaggactgggaggtaaggcagtgggatccaggagtgtggaccgccctttctagaagtttggtggtgagagagggagaaggggtggtcagttgaagaagcaaagtcaagggaatgtggttctagcacagagaggcttcaggaagcatgttgccaagatgaaagaaccagtgcccgagtggaggggaaagacacaggaggggactgggcatggagaggcccccaagggaggtgtgtggtccggcaggagagggctgccaaaatccagagtctcctggagatgcctccagcatgtcctttcaaaaacaacaacaacaacaacaacaaaaaacacaacctattacataattgtttaaggtaacattcattttaaaaaagttttaaatttattatattctagagatagggctgggttgcccagactggagtgcagtggcacaaacacagttcactgcagcctccaactcctaggctcaagccatcctcccgcctcagccccccaagtaggtgggactacagatgcatgccaccatgtccagctttttgttttgttttaatttttatagatatggggtctcactatgttactcatcctgatctcgaattcccggcctcaagtgatcctcccacctcagcctcttgagtagctaagactaaaggtgcatgccaccacacctggctaatttttttttttttttctgaaaggtggggtccaggccgggcatggtggctcacgcctgtaatcccagcactttgggaagccgaggcaggcagatcacctgaggtcaggagttcgagaccagcctggccaacatggcaaaaccccgtctctactaagaatacaaaaattagctgggcgttctggcgtgcacctgtagttgtagctactcagggaagctgaggcaggaaaatcgcttgaacctgggaggtggaggttgcagtgagccaagatcacgccactgcactctagcctgggcgacagagcaagactccatctcaaagaaaaaaagaaaggaagaaagaaagatgggtccctatgttgctcaggctggtcttaaactcttcgcctcaagcgatcgtccagcctccatctcccaaagcactgggattggaggtatgcccctggcctattttataatttttattattttttgtctttgtcctggtctttgcttttactgtaacagttacattttgctggccttatcctgttgtgcaatcccctaagaggctgcaggagcctccccatctccctcttccaccctcctggaaactgttgtattgtttccttcttggaaaggtagacatattgtttgtttgtggagccatctcagctgggcatgaccctctgagggatcaaatatttggacagaagccgaaggaaatactggcagatgtttctaactcctagctgtggctttccctggggtgtggaggagggcaaggagagagtacctttgaagagcgggaacacagttccatgtggctttcctgagcgcgctccaactgcagcgcttactccgagctctgccagctgggcggcccgccacagggagactgggagccaggagcccagaggcccgtgtggtgatctggctggctgaggtggagttgagtttttgcacactggagggtgtctctatgacccctgttctgccctgaggtccctcctctgagctctgacctggggctgggtgggacccggcactgttccaagaacccctcatgccttccagctacctggtgatgcccttcatgcagacggatctgcagaagatcatggggatggagttcagtgaggagaagatccagtacctggtgtatcagatgctcaaaggccttaaggtgggtggggacttggaggctggcagaggggacgccttgctgtctagacctgaggtttggggaggctggagggagcgcactgttacaggtcggccagcctgaagtgcctggtgtggaagctgggccatggactcacccttctctctctcccacatagtacatccactctgctggggtcgtgcacagggtgagtgctttctctgccatggtcctcagaggcccctgtcccatccctgggtatggggttctctggcaatcaaggagtgggaaagttggagggagaggacactgcccaggagcacagaatgtggagttttcacacccagccacggcccaggaaggcctgctcaaaagagtcactgtgtcccaggggacttcatggggaattgctgcagacaaagtgagccctgagctgagtgtttcaggcttcaagaatcaggaacattttagagctgggtgggccctgagagaacacctagtccaaccctcattttacacatgaagaaactgaggcccagaaggggaaggggcctggctgaggtcacacccctgggtggtggtggagctaggacaagctccatctctgcctcagcctagcatgcattctctgtcctccccccaggacctgaagccaggcaacctggctgtgaatgaggactgtgaactgaaggtgagtgggctgcaggctcagcccagaggcgggataggccctcccccagggaagcccctggaagccgctcccagagcctcctcccctcagcaagttccttttctatttatcccctgtgccatagattctggattttgggctggcgcgacatgcagacgccgagatgactggctacgtggtgacccgctggtaccgagcccccgaggtgatcctcagctggatgcactacaaccagacaggtcagtggtcaatgcctgagagggcggtcctggggccatctggtcactcggtgctgactgactgctgggccccagacagtccaggtgacactctccctccctctgcagtggacatctggtctgtgggctgtatcatggcagagatgctgacagggaaaactctgttcaaggggaaagattgtatcctttgctggaaaagccaaactccatctagggattccttccttcaacagacactttatttaaataactgtcttttttttcttaatgtgagagtgatacatactccctgtagaataatttgtaaatgcagataaggctggacgcagtggttcatgcctgtaatcccagcactttgggaggctgaggtggaaggatcctttgagcccaggagtttgagaccagatgtggcaacatagggagaccccatctctaaaaaagttttttaaattagccagacatgggcctggcgcagtggctcatgtctgtaatcccagcactctgggaggctgaggcgggcagatcatgaggtcaggagatcgagaccatcctggctaacaaggggaaaccccgtatgtactaaaaatacaaaaaattagccaggcgtggtggcaggcgcctgtagtcccagctactcaggaggctgaggcaggagaatggcgtgaacccaggaggtggagcttgcagtgagctgagatcgcgccactgcactccagcctgggtgacagagcaagactctgtctcaaaaaaaagaaaaagaaaaatcccagctacttgagaggctgaggtgggagggttgagcctgggaggttgaggctgcagtgagctatgattgtgccactgtactccagcctgggtgacagagggagaccctaactcaaaaaaaaaaaaaaacaaaacaaaatgttgggtgggcatggtggctcacacctataatcccagcactttgggaggccatggcaggcggatcacctgagattaggagttcgagaccagcctggccaacgtggtcaaaccccatctctaccaaaaaatacaaaaattagccgggtgtggttcacgcctgtaatcccagctactcgggaggctgaggcaggaaaatcgcttgaacccaggaggtggaggttgcagtgagccaagactgtgccactgcactccagcctgagtgacagagtgagaccctgtctcaaaaaaaaaaaaaaaaaaaaaaatgtagataagcaaaatgatgaaaaattctaccactacgtggaaaatacattttggcacggcacacattaactgagtacctgtgtgtgcagggcaggcctttggtgagaagacgaggaaacagaaaagagtcactgggatgaaggctgagaagtccacatccatttgttgggtagggacccccctcagcctggcacgttggaaagctctccagagccctgagccctgaagaataagcctcctcctgagagcaggaggtggttaggcagggctggagcctggatgatcagttgccatggtgcccgggtgaagtgatggtggggtcgcaggaagggcagtctcagacccaccaggagagcaaggctaagccttaacctgccaccaagacctggaccagctgacccagatcctgaaagtgaccggggtgcctggcacggagtttgtgcagaagctgaacgacaaagcggtgggtggtaaatgggacctaggctggcctgggctgtgtgcttgcctgacgtgggcccagtgggctgcaggcctttgtggaagaaggctcaccagcaccttcccacagcatcctcctaccctggcaggcactcttgtcttaatctcaccgtggaccctgacctgaactttcagccctgctctgaggcttttctgaaatccctgctctacacgctgaggccagagccctaaggggtttgatgcttttctgtcttccaggccaaatcctacatccagtccctgccacagacccccaggaaggatttcactcagctgttcccacgggccagcccccagggtgagtctcagagcccgctccccaggggcctctcagcgtatcccagagggcgggctctcccagcccctggtgtgaggctcttggctctgcccctgcagctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcgtaagagctggggcctcgggcttcctcgcctccgcctgcagcctctcttccttgcttcctccatctttgtgcctggcctctgccagccctacctgccacctccttcttggtgggcattgtctcctgggtgcttctttctccttgagctgacttcgctctccatgctgtctctgaaggggggtggactttctcgccacagcacctctttacgcaccttaaaccatgctgcctttctcagagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatgaattccagggggaaatgattcaactcactacagacagctgggagggaggggccccttcctgggccccgtgctgaggccttgtgctctgtgaaggaacccaatgtgtttggctgctaaattaagggagttgcagagagagctgcagctggtgcgattgcattcaggttattttgggtgagtgataagcaatcaagatatgaaacaacagcaggctcggagactgcgagctgcacaggcagaaatgggctcttgcctggcttgatggcaaaccgttctgctccctttgggagatggcacagctctccagagctttgacctgacagtggctagaacctctctgtttttatctgagaaactttggcagaacaaatttccatgtgcacaagctgtcgggcacagtgggtctcaaatttccttgtgcaccaggggacttgttaaaatgcagattcctgggccccaccccagggcttgtgactcagcaggtctgcagttgagaccttagaatgtgcatttgaatgaggacctctcgccctgacccaagcctagtgattctgatggatatcagaccatagttcgagacatttagtggatttcagtcatacttgatttgttgggaggcctaaatcaaaaacctataggaggagactggggggcttcagatggagtttcacactcatcttacaggtgttaaaactgaggctcagaaagcttttttttgtttgtttgtttgagacagggtctggctctgtcacccgggctggagttcagtggcacaattacatcttactgcaacctcagcctcctgggctcaagccatcctcccacctcagcctcctaagtagctgggactacaggtctgtgccacccaggtgcaccaggactgcaggtggctaattaaaacattttttttcttttttgtataggcggggtttctctatgttgcccaggctgatcttgaacttctggactcaagtgatcctcccactttggcctcccaaagtgctgggattataggcatgagccaccctgcaggcccagacagcatttttaaggccttgaaactcttctgtataatactgtaatggtggatacctattgtgcatttgttaccatctgtaggactggataacacagagtgaaccctcaagtaaactatggacttcagttaataataatgtatcagtattggttcataaattgtaacaattgtgccacactaatgcaagatgttactcatcaagaaaactgaggagagagaaggggaggaagtaggtgggaacctctatactttctaccaacctaaaactgctctaaaaaataaaccacaggccggtcgcagtagctcacgcctgtaatcccagcaccttgggaggctgaggtgggcggatcacttgaggtcaggagttcaagaccagcctggccaacatggtgaaaccccatctctaccaaaaatacaaaaattagctgggcttggtggtgcatgcctgtaatcccaaactactcgggaggctgaggcagaattgcttgaacctgggaggtggaggttgcagtgagctgagatcacaccactgcactccagcctgggtgacagagtgagactccatctcaaaaaaacaaaaaaaacaaataccctgaggacacagagacattgggtcagacacccacagctaggaagtggtggagtcagattggaacccaagtaggcttgagcactgtacccagcttggattcaagggttgcccagccttccctcttcacgccagtctgagacccttactgctgactgtgtccatggtctctgttttctctcccacagaatggccctgctgtcaaggagctggggagtccttgactgggactggctagtcttgccacagccctggcctcgctggttactaaaactgccccaggttccctgagtctacatccctctaagcctcctgagaattctcactgccccaaggaaaaagtctagccttccttcttggcctggcattcaaa

SEQ ID NO: 17163 - DNA, 92074 bp, Human
gcactgagtttacatcaaggaaaacctaagcagggtctctacactcaaacagtttactttggggtgggcagtactttcccaattctgggatttttcctagctatcagctctctccctgtcttttctaaaccacacgcggttatcctgaactcacacaaccctcagagtctagggcttccctgtctgtcctaaccttccttttgttttcaactttacagcagggaatagactgggctgcatccttccttggccaacaggtactgtcttcttttgcaatatactcagacatgctatcattcaggttccatgcaacatatatcaattatctaaatttcaaatttggctaacctgcctttccagcctcaccttccatttcatcccttcagttgttaccagccccaatcctagcccccacctacaggtgtccacgtctgtgcctttttgctcaatgtattttctcattcaggaatgcctgacatctccttctccacctatagaaatcttacatatttcctaatacccagctcaaaaactgccttctctggatgggcttaattacttactttgctcaataagttctgccaaagcccccatgcttgacttgtgctgtactattgccctctcatcttcccttctcaattacttgttcagagcaaaggtcttcagagcttccactctgtccagctgcggtactttacaacatgggttggtaaactaagatctgaaataagaataaccgttgaaacggttgaaaaaagatcaaaagggcctggctcagtggctcacacctgtaattccagcaccttgggaggctgaggtgggaggatcacttgagccctggatgtccaggctgcagtgagccgagatcatgccactgtactccggcctaggcagcagagcaagactgctctctctgtctttctttaaccctcaccttcccttcaaaacctaacaaagaccatgtttaaatcaatagaagaacattttatgacgtgaaaattatatgaaattcaaatttcagtgtccatacataaatctttataggaacacagcccatattttctatgactgcttttgagctccaatggcagagttgagtagctgagaaagagatcttatggtccacaaagcctaaatatttactgtacggcccaaagaaaaactttgctgagcctgctatacaataagggcttcatgattaaataactgggtcgtacaccaagattctgaacatataggcaggccctcttaagtttagtgtctttgtgtaatggaagtaataactattttgcctttaagttgccataaacatcaaatgagataatgcacttagaaaataaaaacaaaaaaaacttataaacaagacagctttatcatgtattgaaggtggtagaataagaaaacattaaacgtttttattctcatttccccttctttcctttacagctttcacttaaacttgaaatttcaagagaaaattcacttttgaagtttttacttttcaagtgataatagggtcacaggttctttccttccagtctttttgtgttgctcccactcccttttctttctcacatgtaatttttttccattttctttaaatagtatctcaactgggctcacaatagctcagggaaggagaaactgggacatgcctgattaatccattttacaggccaggaaactgaggcagatcccagttgcctccgaagctctgactcagcagcatgcagagagccctgccgctctctgcgccttttctaaacaaatagaacaaaactaaccttgccaggtttccaagcttggatctctaacactccttcaacgttcaccccggcgttcctccccgctgcgccccctccctctccttgccgccccctcctcgggagcaggtggtaggctccgcgcccaacgcgcaagcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaaggtgagcggtggagcggcctccgccacgaggggcaatggtcgccggggcgaggcccgggtcagcgccgggagcttcgcttaactgccgcggttcggttcccggacgtgcggcgcccctccactgaggtggcgccgccccacaccccctgcctctgggctgcgggtccgcgcccctcagtccgggcgtcctctggcgccggccgtagccgccccttgttccccgccaggccggctcgcgccttggggccactccagggcccggcccttggcgggcgacgcagacccccacccgcccgccccctgacccggcctgagacccctccggcgcatcccgcccgggcgctgctctgcgccccgtgggccgccagccccacggccggccgcctcgccggagcccgcagccgcccccgaggcaggccccgcagccgggcctggcgcccctgctgggtctccaccctcaccttggtcgcctcctttcctccacattcgcccttcatccatccctctctcctgcagtgcttgcgctccaggcccgaaagaaaaggaccaaggccaagaaggacaaagcccaaaggaagtgagtcttgtaccccaacatcccattctttggattttcctccggcaccttctctgctctggtttcacgtcttgaacgtgcaccgggtttgggcaccctgtggctgcagccacatggcctcggggcagctcggagggtcgctctccagcaaccatgtggaagagagctgctgttgctcaacgccaggcctgggtcttagcagccccgggcctgctggaaagggctgtcggaggaggaccagagcccgcccggtacctttcctccccaactccacagaggaggcacaaactcccctagcttggacctccccaccggagctggtagatcattatcggtctgtttctgaactctggtctctcttacctgctccccaacgtcttaacttgcctccgacgtcttcacggtaggccttaaggaaattcttgaatgaatttttccgtgtttactttgggttctaccaaccacacactccctttcatagaggagggcatggggcttttccctgggttagtcaacttcctgagcctgtaaggcgtatcggcttttttgcagtgtgccggcagaccgctgtgtatacagtcggtgtctgttaactgcttctcttctgtctaaacctcaaccagatgcagataatcttccggagtggacatcacaatagtaacgggagagttctttaacaaacattgatgattctggtttggcgtattaagcgccacatgtccagttttatcagtaggatgcataacagtagtttagtgctatcgtggcaagttcaaaagttggtcacagcctagtagaaactcaggtagcaggcttagcagcaagtgaggctaagccttaagaactttcatcatgtactaacgtttaattgcaaaggatcttggaaatcagctcttacacactttgtattcagagagagcttgtatgcctagttattaatacatcttaattttagatgtattatctttatagttttacatttatttgatgttttgtggcatcgtatgcggtctaattccctctgagctgatacaacacatttcaaaggccttcctaggtcaccccactgaatgacaataccagattaggggggtgtaggggtgtgtgttgtttttggaggctacctactgtttggggagagcacataatgacttctctctttcaatagaactaaagtggtaggtgacctcacctcttgctccattttctcttctgtcttatgaaatgtattttgtaagtgcttggtgacgaagtcttgtaaatgagagtttgtgtgtgtctgtttacctttggattatccatatatgggattattcaaaaccagtttttaatcctagatcgtttaatagaaacagcaaggtgctaacttggttctagtgtgcagtaggacttgaaatgttacttttctgtgcctagtttagttattctttgtggaattgatgagaatgtgttaaaacgttcttttctattgatacaaggaagttgcagtttttattatattactctgtattttttagaaatcctggtctctcagactatttgtccagatctctcttaccacttagaaattaatttgagattagcccaaatcaagctgtaatttgaggggtaaatgtatatagatgatatactttaagcaccagaaatctgttactttcgattatctatttagaccatatgctttatttctaaagtcagatgtgtatctgttaccccattcactactatggataacttagagttatttgtgttaattgtttgcaagtatggattatagataatctagcagtcattttactgaatatttcatcttgaacaactttgaatcctgaaaatatgcgtgaatgaactgcccccatttccttgtaacttcagaggtgttttatttttggatttgtttccaattaataagttttttttgtttgtttgtttttgaatttacctaccttttttttctttttctttttgaggcaaaaagaaagcctgttgcccaggctgcagtgcaatggtgcgatctcggctcactgcaacctccacctaccagattcaagcaattctcttgcctcagccccccaagtagctgggactacaggcgtgtgccactacgcctggttaatttttgtattttttgtagagagagagtttcgccatgttgcccaggctggtctcgaactcctgagctcaggtaatccgcctgcctcagcctcccaaagtgctgggattacaggcatgagccactgcaccttgctctttttctttcttcctttttgtctttctttctgtctttcttttcttttgtttgtatcccagcctccttttaagtagctgaaatgtctaattaagttggttagagtactgtgttagaagttcaagcctcaactaaggtaacttgactctgttccatgacttctgactgcactcctgatgacttccatttactttgctaaggcaagctgctagttacaggaggtgagtcaggaagaagatttgaggaagaagcatgccatagagtttggtctttggagatagatgtggttttgaattctgattttgctactttttagcaatctgaccttagacaagttagttaaggaaacagtcttatgtatatatcctgactggcagttcagtcatagtgaaaactgatcaggacctaaagatataaaaacaaagcgtttaaatgaaaattttagaaagttttggaactgttacagtaaatagcatccttagtaatttagtcgtgttgtgtcacaggcagaagggattttcagtcccctggtactgcagatcttaaacccagggtcttgaagctggtgacagaagaaccaaaacttggaattcagggtccctttccagctctgtgtttgttagagtggatttcctttgggttcttttcactgtgctggagtatttgactttgggattttaaattttcttatttagacaattcttcattttacttttgtggacgctgtgcttttatttactaacattaactagttggtgatgatctccattttactttacagataagagaattgaggtttgtcagattactcccctagaaaattgcaaagctgggatttgaacccaggtctgacatacccaaagccctggctaccaatcatgtgtttctaagtgacagtgcttttggtgtgtcttacaacaggtaaggtagaagctgagttgaaagaggcttctgaatgagagacctctggatgcttgggggtttgggtgccctttcatgacatactgtcctgtgtctatgaaacagcacaatcatctatctccctctgaacatttgttttcagtgtttataccaatagctgtgagcctttatttgtttgtcataagcttttataatttaacagtgtgtgtctgtttttgttttgttttgttttgttttttgagacagagtctcactctgtcacccgggctggagtgcagtggcgcattctcagctcactgcaacctctgcctcccgggctcaagccattctcctgcctcagcctcccaagtagctgagattacaagcacctgccaccacgcccggctaatttttgtatttttcggggtagagacagggtttcaccatgttggccaggctggtctcaaactcgacctcgagtgatccacctgccttggcctctcatagtgctggtattacaggtgtgagctaccgtgcctgacctatatgtctgtttttgaagttgtttctatggaacataattccagaatggatttcatacttactgattttattacttaccttaggaagctggtttggacagtaattttcactttatttgcagttaaataattatggatttagtatacatttggtagtaaaattaattcagctctaacactgatttgtggagtcatttgggagatatattgaaaatttacttgaatttggccacaaattaaaaaaaaaatttacaagagaaaatacttaaatatctaacatttttattcagtaggaagtagagccagtaaatttgaaacaatttaaaaaatgaaatagtatttgatgctttttacacttagcagtgcaccttggaaattggttctatattccatatagtgcagccttactattttttttagggtctgcctttttcactgagtcttagaaatagttccatgtcaggacagaaagagaacctcatctagcattccattaagttgatatgccataatttaattaattaattaattaatttatttatttatttatttgaggcagagtcttcgctcttgtcatccagtctggagtgcagtggtgagatctcagctcactgcaacctcagcctcctgggttcaagcgattctcctgtctcagtttctcgagtagctgggattacaggcacataccactgtgtccagccaaccataatttattttaatttttattaataaacgtgtgtgtgtgtgtgtgtgtgtgtgtgtgtgtgtgtgtgtgtgtgtatatatttttttttttttttgtttttgagacagagtctcgttctgtcgcccaggctggagttcagtggtgcaatctcggctctctgcaacctccgcctcctgggttcaagtgattctcctgcctcagcctccagagtagctgggactacaggtgtgtgccaccacgccccactaattttttgtatttttagtagagacgggatttcaccgtgttagccagaatggtctccatctcctgacctcatgatccgcccacctcggcctcccaaagtgctaggcttacaggcgtgagccaccgcacctggcctgtatatacctttaaagacaaaaatggaatcactgggcatacttttccctagttaacattatcatgagtatttttcgtgtattaaatattccactatgggctgtttccagtttttcacaattaattcacagctatagtgaataatcttttggacaaatcattgcttacatcagtgattatttccttaggataaatacttcgaatggtatatacatttaaaatatttttagttcattttgtcaaaattttgtccagcaagatttttcttttttttttttttttttgagacggtgtcttgctctgtcgtccaggctggagtgcagtggcgtgatctcggctcactgcaagctccccctcccgggttcatgccattctcctgcctcagcctcccgagtagccgggactacaggcgcccgccaccatgcctggctaattttgtttttgcatttttagtagagacgaggtttaactgtgttagccgagatggtctcgatctcctgacgtcgcgttctgcccgcctcagcctcccaaagtgccaggattacagatgtaagccgccatacccggccttcctccagcaagatttaacaggtttggccgggcacagtggctcaagcctgtaatcctggcactttgggaggctgaggcagggggatcacttgaggtcaggagttcaagaccagcctggtcaatacagtgaaaccctgcttctggaaatacaaaaattagccaggtgtggtggcaggtgcctgtaatcccagccacacaggaggctgaggcaggagaatcgcttgaacccgggaggtggagattgtagtgagccaacatcgtaccactgcactctagcctgggcaacaaagcaaagttccgtttcaaaaaaaaaaaaggatttaactagtttaactcttattcattaaacaaatagtttttgatctcccaccctgtcccaagcattgttttccatattcgggattcagcagtgaaagaaaaacattcctgtcccgttggctactatattattatagtgggaggaaagacagaataaacaatagacataaataagtaaattaaatagtatattaggtgataggtggagaaaaaagagaaagataagtgggggttgagaaatggagataaggttacagttttaaatagggtgatggaggccacactgaaaaggtgacatttgaacaaagacttggaagaggactgctctaggcaaagcagtggaaatgggagtgttcttgtatctcctgtgaagccaccagaactaggtaatattacttgaaaaatcttgccaaatctggtaatctataaaataccttgttgtaattttgaattttttgcccatttttaatattagattgttgatctttttcttgatcttaagaactctttattaagaatgtatcctagccaggtctggtgactcaagcctgtaatcccagcactttgggaggctgaggcgtgtggatcacccaaggtcgggagttcgagaccagcctgatcaacatggagaaaccccttctctactaaaaatacaaaaaattagccgggcgtcatggtgcatgcctgtaatcccagctacttgggaggctgaggcaggagaattgcttgaacctgggaggtggaggttgcagtgagccgagatcgtgccattgcactccagcctgggcgacaagagcaaaactccatctcaaaaaaaaaaaaaaaaaaaaaaagagaaagtatcctttgttgtgcggcagacttttatttctcagcttgttataggtccttcagatgtcacttatagtgtgctttttacataaattgatttttaaaaccgtggcaaatttgtcttttcctctgctttttcttttttctctctcttttatttttttttctttttttgagatggaatctcgctctgtcacccagactggagtacagtggcatgatcttggctcactgcaacttccgcctcctgggttcaagcaattctcctgcctcaggctcccgagtagctgggattacaggtgcgtgccaccacacctggctaatttttatatttttagtagagacggggtttcaccatgttgtccaggctgatctcaaactcctgacttcaggtgatcacctaccctggcctcccaaagtgttggaattacaggcgtgagccactgtgcctggcctcctttgctttttacttttttttgagacggggtcttgttctgttgcccaggtgggagtgtagtggcgcgatctcggctcactgcaacctccacctcccgagttggagtgattcaagtgaattcaagtgattctcctacctcaaggtcaactgttatatcttttttaaaatttgcatttttaattgtgtgtgattcccttaaatataaatttacttgcaaaattgaatttctagaacttctcttgtcagaaaatattttgttctcttcttcctctgtagtttcattggttagtaagttttatttacattagtgtttctactacagtgcatcccaggcttgacaaattaccattttcctttagattacttgaaaccagcaacttgttgaagtgccaaagtgaataaggctgcgggtgcttaggaattcccttactaaaagtgaaaaaggctcggtacagtggcttatgcctgtaatcccagcactttgggaggccaaggccttgagcccaggaacttgagattagcctgggcaacatggcaagatcctgtcttctaaaaacacaaaagttagctgggtgtggtggcacgtgcctgtagtcccagctactcaggagactgaggtgagaggatctcttgagcccaggaggtagaggctacagtgagctgtgattatgccactgcactccagcctaggtgacagaacaagacccctgtctccaaaagaagggaagaaagatgatcaactaaaatcaatttagaccttgtggaataactggcacttttttgtggggtttttcccactttaggtaagctcttttgctcatgctctccaaatcctctctatcactgttactagtttggggatatttttaaattggctaaagtattacaggcatactttggagatactatgggttcacgttcagttccagaccacctcaaagcgagtcacacaaagtttttgtttcccaatgcatataaaagttatgtttgcactgtactgtagtctgttaactttgcagtagcgtcatgtcttttaaaaatgtacagaccttaatttaaaaatacgttattgctaaaaaatgttaaggatcatctgagccctcagtgagtcataatctttttgctggtataaggtcttgcctcaataataatttttgtttaagggagatggggtctggtactgttgcccaggctggagtgcagtggtgctatcatagctcactgcagcatcgaactcctgggtgcatgcgttcctcctgcatcagtctcccaagtagctaggattacaggcacatgccaccatgcccagctcattttttattttttatttttttattttttttaagggatggaatctcattatgttgccctcaagctggccttgaattcttggcctcaagcagtcctcctgccttagcctcctgagtagttgggattaggggtgtgaaccactgcacccagctatggtcttgcctcagtattgatggctgctgactcatctggcggctgctcaaggttggagtagctgtggcaatttcttaaacaatgaagtttgctgcatttattgaccctcccttacccaaagatttttctgtagtatgcgatgatgtttgatagtatttaacccacagaggaacttatttcaaaattggagtcagtcctttcaaactgtgctactgttttataaattaagattatgttatattctaagtcccttgttgtcatttcaacaatgttcacagcatctttaccaatagtagattccatctcaagaaaccgctttctgctgggtgtggtggcatgcacctgtggtcctagctacttcggaggccgagatgggaggattgcttgggcccaggagttcaaggccagcctgggcaacatagtgagaccttagctcttaaaaacaaaaaagaaagaaacttattttttaaaaaaattaattaataaactaatcagttattttgagacagggtctcaccatgttgcccatgctggtcttgaactcctgggctcaagccatcctcccaccttggcctcccaaagtgctgggattacaggcgtgagccaccacgcccggccaagtaaccactttctcatcataagaagcagctcctcatctgttcaagttttattatgagattggagcaatttagtcacatcttcaggatccatgtctaattctagtcctcttgctgtttctaccacatctgtagttacttcctccacagaagtcttgaacatttcagtcatgcatgagggttggaatcaacttcttccaaactcctgttaatgttgatatttttacctctccccatgactgttcttaatggcatatagaatcgtgaatcctttccagaaggttttcaatagatttttcccagacccatcagaggaatcactatggtagctattgccttatcaaatgtatttcttaaataataagacttgaaagttgaaatgactccttgatccatgggctgcagaatacatgttatgtcagtaggcatggaaacaacattaatctctttgtacattcccatcagagctcttgggtgactaggtacattgcaaatgagcagtaatattttcaaaggaatctatttttctgagcagaaggtctcaatagtggccttaaaatattcagtaaactatgcagtaaacagatgttctgtcatctaggctttgttgttccatttatagagcacaggcagagtagatttagcataattcttaagagccctaagatttttgtgattgtaaattagtattggcctcaacttaaagtcactaggtacgttagctgctaacaagagtcagcctgtcctttgaagctttgaagccagtcattgacttgtctccagctatgaaagtcctagatggcatcatcttccaatagaaggctcttttgtctacacctaaaatctgctgtttagtatagccaccttcatcaattatcttagcatctaggtaacttgctgcagctttttcatcagcactcactgctttaccttgcacttttatgttatggggatggcttctttctgtaaacttcatgaaccaacctctgctaccttcaaatttttcttctgcagcttcctcacctctcacaaacttcataaaatccagggccttgctctggattgggttttggctaaagagaatgttgtggttggtatgatcttctattcagaccactaaaactttctccatctcagaaatgaggcttgcaagctgggcgtggtggctcactcctgtaatcccagcactttgggaggctgaggcagatggatcacctgaggtcgggagttcgagaccagcctgaccaacatggtgaaagcccgtctctactaaaaatacaaaattagtcgggtgcggtggcgcatgcctgtaatcccagctacttgggaggctgaggcaggagaatctcttgaacccaggaggtggaggttgcagtgagctgagatcatgccattgcactctagcctgagcaataagagcgaaactccatcttaaaaaaaaaaagaaagaaatgaggcttgtattaatctgttctcacactgctgtaaagaatattacctgagactgggtaattataaaggaaagaggtttaattgactcacagttccacaggcttaccaggaagcatggctgggaggcctcaggaaacttagaatcatggtgaaaggcaaaggggaagcaggcatcttcttcacaagttggcaggaggaagtgtgtgcaacagcaaggaagtgccacacttcaaaaccatcaggtctcgtgagaactatcatgagaacagcatgaggggagccacccccatgatctgatcacctcccacgtggtctctcccatgacatgtgggtattacaatttgagatgagatttgggtggggacacagagccaaactgtattatttcactcttggcccctcccagatctcttgtcctcacattgcaaaataatcatgccttcccaactatcccccaaagtcttaacccattccagtattaactcaagagtcccaagtccaaagtctcatctgagacaagtctcttccacctataagcctataaaatcaaaagcaagttagttacttccaagatacaatggggatacaggcattgggcaaatgttcccattccaaatgggagaaattgtccaaaacaaaggggctacagaccccattaaagtctgaaattcagccgggctgtcactaaattttaaagctccaaaataatctcctttgactctgtgtctcacatccagggcatgccgatgcaaggggtgggatcccatagccttgggcagctccttcatggactggcattgagtgcctgtggcttttccaggtacatggtgcaagctattggtggatctacccttctggggtctggagaacagtggcccactcctcacagctccactaggcagtgccccggtgcagactctgtgtgggggccccagccccacatttcccctttgcatggccctagcacaggttctccatgagggctccacccctgcagcagacttctgcctgggcatccaggcatttccatatgtcctctgaaatctagacagagattcaattattgacttctgtgcacctgcaggcccaacaccacgtggaagctgccaaggcttggggcttgaaccctctgaagcaatggcccaagctgtaccttagccccttttagctttttcctcctaagcctctgagtctgtgatgagaggggctgtcgccaagatctctgacatgccctgacgacattttctctattgtcttggtgattagcagccagcttgaatttctccccagaaaatgtttttttcttttctatcccattgtcaggctacacatttcccaaacttttattctttgtttcacttttaaacataagtcccaatttcaaatgatttctttctgaatgcataaaactgaatgctttcagaataacccaggtcatgtcttgaatgctttgctgcttagaaatttcttctgccaaataccctaaatgatctctgtcaagttcaaacttccacagatctctagggcaggggcagaatgctgccagtctctgctaaagcatagcatgagtgacctttactttagtcccaataagttctttgtctccgtctgagaccacttcagcctggacttcattgttcacctcactatcagcattttggtcaaaatagtgcaagtctctaggaagctccaaactttgctacatcttactgttttcttctgagccctcctccaaactgttccaacctctgcccactacccagttccaaagttgcttccacattttcaagtatctttatagcagtaccccactctctgtggtaccaatttactgtattagtccatttcacactgctataaagaatactacctgagaccgggtatataaaggaaagaagtttgattcacagttccacaggcttaacaggaagcataacgagggctcaggaaacttacaatcatggtggaaggtgaaggggaagcaggcaccttcttcacaaggtggcaggagggaatgtctgcgagaacgaggaagtgccacactttaaaaccatcagctctcgtgagaactcacaaactatcagaacagcgtgggtgaaccacccccatgacccagtgacctcccacctcatccctctgctgatgtggggattacaatttgacatgagatttgtgtagagacacagagccaaactatatcaaggctgttcctctttcttgttattcatgtgttcactccatcttacttattttttattttttattttttattttttgagacggagttttgttctcattgcccaggctggagtgcaatggtgcaatctcggctcactgcaacccccgcctcccgggttcaagtgattctcctgcctcagcctcccaagtagctgggattacagacatgtgccaccacactcagctaattttgtgtttttagtagaaatggagtttcactatgttggtcaggctggtcttgaactcctgatctcaggtgatccacccacctcagcctctcaaagtgctgggattacaggtgtgagccatcgcgcccagcctcactccatcttattttaaagcaaatcccaggcatcatattattttataaattatagactcttaatttttttaaagcatagctacggtagtataattgccctaaatttttttaaacaagtctttaatgtcaagtattcaatctgtgttcaaattttcctaattttctttggatcaggatccacaaagtctttccattgcctttgtttgaaaagtttctagtcttttactctgtaagttctctgtggttcttttccttgcagatttgtttttggcaaactacctatgggtggtggtgtaaactttcatcaggaaacatcaattctggttgtctctctttttgtggtgttagtggctattgatccttgcttagatccattaatttatttagggtttcaaaaatggtaatattctatttcttaatttattaattgtaatacttctataaagagaaactttatctcataactttggttacccagagagagagttgacagatccctagcatgctccaaaatgaccaataaacatttgataataactcacaaatttgaacgtatttgtggtttagtccattagagtgggtttttttttcctacagttttatggaggtataattaaaactcattttaactgtgcaattcagtggtttttagtatgttcatagagttgcacaaacatcactgcagtgtaaatttaggttgttttcatcaactccaaaagaaacctggacctattagcagtcataccccttgactcccgacactgcctcaccttcaaccttaggcagccactaatctactttctgtgcctatggaatttcctgttctggacatttcatataaatggaatcataacatatgttatctttagtgactggcttcttttacttaatgtttttaatattcgtgcatggctcacatctgtaatctcagcactttgggaggccaaggccggtggatcgtttgaggccaggagtttgacaccagcctggccaacatggcctaaccctgtctctactaaaaatacaaaaatcagctgggcgtgatggtgcacgcctgtaatcccagctactcaggaggctgaggcatgagaatcacttgaacctgggaggtggaggttgcagtaagccgagatcatgccactgaactccagaccaggtgacagagtgagactctgtctcaaaaaaaaaataataaaattcgtgcatgttgtatcatgtgtggttatttttattgcttgtccactgttggctaattggagttttttttcatggtatctcctgagttcattttactcaacctgagatgtctttgattgctttttttaatctggtgtgacagtatgtctaaggcttatcttgtacattttctgcccccggctaggaaatagctgtctctccaagaagccttttagtgggaaatggtatttggagaccataatctgagcgcttaaggagcttattactagtgagtgagttagtcattgtttctatgctttttctgtgactagagcttaggaaataagttgtgttttttcatttaaaaaaatcatgagttcatgttatacttaaacatggaatcataggacccaaggatttttgtttgattttatatttcactcttctttctcccacgctgaaaatcccagttctcaacagcatcatgattgctcattttctttttcctacaatatatacacaacagtcttagaattacaattccagcactaccccaacaatatgattactaaagaagatcacaatttttgttattgttcttagagtatatttcactggggatgtagaatcaagtgactgaattttatagttgcactgactagttccttgctgtaggattatgctaccacctaatttctcagattcatgtgtttcattttgctttcattttacatcatctttgacttttttaaaaagtccaagtcttgcagaattatttgggtcgtctaggcttattgcttaaaataaatattgtatgtaatttgtgattatgttgggtttttttttagaatatggcttatgaagcatactatgagtaagacaacagggaatggttctgtgcttattagagtgtgtgaagtgtgcctcctcctttatatctaaagaagaaaaggtttcttagctcctgttaccctgtgagaagatgggtccactattaccacgtcttcagctttttcaacagaagctagaactttgtttttatgtgattctccagattgtttagtgttcacaacttttgtttgtctgttttttgttctttatttgagataaggtctcagtcacctaggctggagtacagtggtgtgatcataggtcactgcaatctcaaactcctgggctcaagcattccctctgcctcagcctctggagtagctaggactacaccaccaggcccccttaatttttaattttttttttcttttcttttgtagagatggagtcttgctgtactaaccaggctggtcttgaactcctggcctcaagggatcctctcaccaccttggcctcccaaattactagaattacaggtgtgagccacagtgcccagcccacgactttatttattttttatttttttattttactttttttcttttttttgtgacagagtttcactcttgttgcccaggctaaagtgcaatggtgtgatctcggctcaccacaacctccacctcccgggtcctggttcaagcagttctcctgccttagcctcccgagtagctgggattacaggcacgcaccaccatgcccagctaatttttgtatttttagtagagacggggtttcaccatgttggccaggctggtcttaaactcctgacctcatgatctgcctgcctcggcctcccaaagtgctgggattacaggcgtgagccactgcacccagcccacgactttatttaaaaaccattgtatacttttgtttacaggcaggattcagcttgcagcctgtagtatgtaatctctgcctcagagtctttatggtgaaaggtaggcattaataggctgactgttgcaagttccctctctgagtgatagtattaagcacagttgtggaagagccccatggttccatgggcctcgtagtggaggattagctttggaaatttgaaaaagaccaacaaagatcagctgtgaagaccatagtatccagtttttcaactaatttaacagggtataacttcagaaagttatcagaagcccacaaaataatttgaatacacttaattttcagataactgtagtaaaatgtttccactaaacacaaaaatcagttggcaggagctagataaataaaaatcatggcttggcatggtggctcatgcctataatcccaccactttgggaggccaaggtgggaggatcacttaagcttaggagttcaagaccagcctgggcaattcagtgggaccctgtctttaaaaaaaaaaaaaaaattcgctgggtgttgtgatgcacgctaatagttccagctatttggaaagctaaagtgggattgcttcagcctggaaggtcaaggctgctacgtgccatgattgtgccactgtactccaacctggacagaagtccaggtgtgtaattcattgctattgggtaatttattggtggcttaaatgccttgaacaatattgatgagtattttaggatggcatatcaagaagtttcagaaattttaatatacattttaactaccacgtaacaattgtcaccaattcttgtttggtgaacaaaaacatcaatggtatgaagcttggtacttgtagtcaatcatgttgataaccttttttaatttactcaaattctaaaatttatgatctgagtgtcatagaggcctaggcattttgaacaaggctaacagtccttttggggatagtgttgtgatttttttttttttttggagacagtctcactctgtcacccaggctggagtgcagtggcacaatctcggctcactgcaacctctgtctcccgggttcaagtgattctcgtgcttcagcctcccaagtagctgggattacaggcacatgccaccacacctgactaattgtagtattttcagtagaggtggggtttcaccaggttggccaggctggtctcaaactcctgacctcaggtaatctgcccacccctgcctcccaaagtgctgggattacaggcgtgagccaccacggcctcttgtgaacttttgtttcctgaaatattagggtaagccttattttgtaactgattatcaatgtaccttgtaggcaaccctatctttccgttcattcactttgcttttttttttttaaatagagacagggtctcactgtgttgcctaggctggtcttgaactcctgggctcaagtgattctctcaccttggcgtcccaaagtgctgggattataggtgtgagtcaccatgtctggcccactttgcctttaattattgtgctactcttcagcttatgaacattttttgatgtgcctccacttagcaatttgatcagagatgccaggttttttctacctacatatgagcttgaggacaagctcccttctgctagtttttatgccttttagaatagctttaacaggaattgtattttgcatttttctttactagaaagaagaatgcagtgggataaattaggtaattcatgctaatatttctaggtagaaggataatacagtacatgctcaatatgctgtttatcaaaaagagcttgtccttttgaattacacagtcccggatttcagcctgcctccaacaccattgttaggtgaacatggacagtttcttttgacttttcagttcaagttgccttatctgtagatggcaaggttataaggatgaaattgcattgagtgcctagcccagtactgaggtgaaataagtttttggatgactgctttctttctcatgcttcgttctttaccttagatgggtttatctttgtcttttatgtgacttttttttggatttttattttattattattttttattttttagaaacagggtctcactttgttacccaggctctggagtgcagtggcgtgatcatagcttacagctgcatcacactgctgggctcaagggatcctcctgcctctgctcccttagtagctgcgactacaggcacatgccaccaagactggctaatcttttttttcttttttttttttttttttttgtagagacggagtctcgccatctggcccaggctgggctcaagcattcctcccgccttggtctcccaaagtgctgggattacagacatggggccactgtgccaagcctatgtgacatttcttaatactattagtgtatcaaactaatagttttagctcatgtgttggtgtttcattttcatgtatatttatatatatgtgtgtgtatatatggtagagtttggagtatagtcacctgaggatcaaggttgaattatatttatttgtatgtaacacctgataaacttaggcactcagatttttatttttatattgttagaccctagttccagcttaagatttctgagttgagaaacttagactacttgtgagtatgtctcagaagttaagtttggataaaattagatatgtaaaggattatgtcaatttgcaaaagaaaaaaatctttcaggaaaaatatatatggaaaaggtagtgggagaaatttagcatttattgagttccattgtgtgtaggtgctagaacctaaaatagcatctcgttaaatctttgcatcacatctaaataagtgtgataactctagaagggatacagagatgactgggacacagtcctttccttcaagagacttaggatttcttaagggaaataagtatacaaacatggttttcttcagtcttctgtaacaaagtaccaaaaactgggtggctaaacaacagaaatttattatctcacaggctagaagtctaaaaggtgtcagagggttgattccttttgagggctgtgagggagaatctgtttcaggcctttttcttgccttgtagatggccatcttttccctgtgtctcttcacatcatcttccctctatatgtgtgtgtgtctctacatccagattttctctttttaaaaggacagtagtcatgttggattcgggcttatcctgataacctcatcttaacttgattacctctgtgaagacccaccctgtatctaaataatgtcacaagcccagttattggaggatagcactccaacgtatctttctaggaggggcacaattcagcctctaacacaggcctcagaaggcagttccctgcattaggagatcttaaccattccccactcccaagacagaaaagactaaagtttatatgtaagtaaactaaagtttcaaaggtgctttttccagtcagcttttagtctctccttctttctctctttaatttttagttttttgttatttaagagatggaaatctcactgtgttgctcaggctggccttgaactcctgggcttaagtgatcttccacctcagcctcctgagtagctgggactacaggtgtgtgccaccatgcccagctttaatccatcctttagagccataactaaatcatttctaagaccccaaacataccatctttaaatccgttcctctccctaaatttccattttctgaaaccaccgttttgaatcattccagataaactcccagcatcgctcacctccttactcaaatgtcacaacactatttaaaatagcatgagcacactgtgtccccttgccctacttaatttttctctatagctctcttcatagcctgacattgtagagcatgtatctcctggagagactgagataggactttgctgtcccaacttctgctgttcaccagctaaaactcaagaaccggataggttcagataaattagggctattttttgtcacttcatgctagaatgtaaacacagtgaaggcagggaccctatacttgctcacagctgcattcccagtgcctagaaaaaagtacctgggatatctacagacactcagtaaaactaagttgaatacatgaacacatacttgcttgtttcttttcttttattttctacctacaatgctaaaatttatgttcaggcactgtattaaccacaggaataacatatcctcgcaaatgccctatgaggtaggcatcatttctgccttcattttacacataaggcgagaggcgcagagagcttcttacactaacagtttgttcagagttttggagctctggtaaactgtggagccaggatcaaactcaagtctcctgactccagagacctttgctgtaactattatctctgcagtggtccccaacatctctgctttctggttcccctacattttacaaaccttaccaaaggaatctttttatttttttttatttttttattattattattttttttttgcgatggagtcttgctctgtcgcccagactggaatgtagtggtgcgatcccagctcactgcaacctctgcctcccaggttcaagcgattctcctacctcagcctcccgagttgctggggttacaggtgcccgctaccatgcccagctaatttttgtattttagtagagatggggttttgccaagttggccaggctggtctcgaactcctgacctcaagtgatacacccgcctcggcttcccaaagctctgggattacaggcatgagccaccgtgcccggccccaaaggaatctttctaaagcatttcttctgtagggccactctaatggctgcacttccttctttgtaaagtgcttcaatgcttgacatttaaggctcttcacagtctagttctgttgggggcagatgtgtaatggactttaactgaagaatgaataataactaaatacgaaagagaaataccttgtacacatcccggttctaggcatttaggatatgccattgaacaaaaaaaggctgccctcatgaagcttacattctgggagtgtctggaggaagacaataaaatgccaagtgctgaagaaaagtagcgggttaaggggagtggcagagggcatgtggcaaacactgctgtttcatataggaaagtcaaggaagttctctgaaagggtgccactttagcacaagcctaagaagatatgtatagagagatgggttggagggggcaatgaagagacagatcacgtaaggtcttgtaggccattggaaaaaaatctgtttggagtatagtggttgcctaattgtgcttcattaaagatcaccagtgttttgttttgtttgtgagatggagtctcgctctgtcatcaggctggagtgcagtggtgcgatcccagctcactacaacttccacgtcccaggttcaagcgattctcctgcctcaacctcctgagtagctggtactacaggcacgcgccaccatgcccagctaatttttgtatttttagtagaggcggggtttcaccatgttggctaggctggtcttgaactcgtgacctcaggtgatccgcttgtcttggccaccaagtgctgggattacaggcgtgagccaccacgcccggtgtctgtgtaggatttgttgacatttttgttttgttttggaaaatgtgaactggagttcagagggctttaagagggaggttttagggaaaacagagaagaaggcatgcttgacactggaagaacctgataatatgataaattaacttttttgagatggagtctcgttctgttgcccaggctggagtgcaatgtcatgatctcggctcactgccacctccgcctcccaagttcaagtgattcttttgcctcagcctcccaagtagctgagattacagatgcctgccaccatgcatggctaaattttgtgataaattaacttgtaaaaaatatagtaatacataacttaaaaaaataattatttcagtagttttggggtacaggtggtttttattacatgaatgagttctttagtggtgaattctgagattttagtgcacctgtcacctgagcagtgtacactttacgcaatatctagtcttttatccctaaccccccaatcttctccccaaccttaagtcaccagagtccattatatcactctgtatatctataagtcctgattgcttagctcccacttataagtgagaacatacagtatttgcttttctccattcctgatttacttcgcttagaataatggcctccagctccatccaagttgctgcaaaagacatttcattccttttcatggcagagtggtattccatggtgtatagatgcgacatttttctttatctgtttgttgatcaatgggtacttaggttggttccatatctttggaattgagaattgtgctgttataaatactttaaaagttcattgcatggatacattttcaaatatagtaaacattcataatgcaatgtattgatcaattggcctgcatagatgatccttttagcaattacaggttttaccttacatgaacaaattggtaatcaaatttaaataaacatacaggtgatctatgcagctaataaatctattcaacccacctcttgttggacatttaggtgtctaatttgttccaatagaatacgcagtggaagcctttttaaataaaagctacaggatgggtgtggtagctcatgcctgtaatctcagcaatttggtaggctgagactggagaatcacttgggcccaggagtttgagacttgtctgggtaacatagtgagatcacatctctaaaaaattttaaaaattagccaggcatggtggtgcacgcctgtagtcccagatacttgggactgaggtgggaggatcacttgaactgaggaggacaaggctggagggagccgtgatagcaccactgcactgcagcctgggcggtagagtgagaccctgtctcataaatgaatgaattaatgaattaattaaataactgctacatagtcctctgtctcaccttttccctagacataggtctacttcctaaagcaactacttttacccattgctttttgtttattttattaatagttggatagacgtgcacatctccagcatacttactgctattctttgattgatcagctttagctattaccataaattcttgctatgattgaggaagatatagttcacttgtactatcaccactttatctctctcttcctctcaataaagcactatatttggacctagttttctaaagctttattgagacataatttgcatgccataaattcacccatctagtgtacacttccattgttttaacatattcagaattgttatatctcaccatgatctaagtttagagcatttttatcctcctgtaagaaaactccaaacccattagtagtcactcaccattactcgctttactcagaccctggcaaccgctaatctactttctgtctcaatggatttgccttttctggacatttcatgtaaataaaatcttaggattatgtggtcttttgtaactggcttctcttagtataatgttttcaaggttcattcatcttgttaaagcaggtatcagtacatcattcctttttatgtatagatatatgaattttgtttatccgctcagcagttggtggacatttggattatttccactatttggttattatgaataatgttgtatttgtatattccaccctgtccccaggaatcagtcagcattttactttatagtacattcataataagttcctgcatttccaaggtaaccagatcccattcaggttaacactactggtaacaaaatcatacaactatgcattgtgaacatccatgtacaacttggtgtgtggatacatgttttcatctcttggtaaatacctagaagtggaattgctaggtcatatggtaattctaatgtttagcattttgaggaattaacaaactttccaaagtggttgtgccattttacattcccaccagcgatgtgtaagggttccagtttttttcacttcttcaccaacacttgttattatctattttgattactttataactttaatataccttgagtaggaaaacttcaaactgttttgttgtctgctctcacaccacaacaatgaacacagactcctgtgaccaaatgtatgagactttttcccctgccatacaccacccaatcagttctgcagcagataccagctagatgtcctctgattcaattcagttctgacagtgtcttcttggagaccccacggattgagggttcactcctcaagactgcctctcccccgtttccagtgccagttgcaagcccaggttgttttacctgtgcttctgatcaactggctataaattgtgtttcccatgacacctccttgggttgaattaatttgctagaggagctcacagaactcagggcaacatgtttactggtttttctaaataaaggatattacaaaggatagagatgaatagatgcatagggcctaaggtatgggaaggaatgcagagcttccatgccctctctgggtgtaccaccctccaggaatctctacttattcagctgtctggaagctctccatacttcaccctcttgggcctttcatgaagacttcattggataggcatgaacaaagcatggtcaactgtgtagaaatgtgattggacaaaaagagtacgacctaatagactgagtatggaaacccagcagggcctgtctgttcagattcttggcctctctgtgcatcattccttcccccaaggtatggggctctgaaatggggatcttatgaatcaggatcagataaggtaggtcagataatttctttatggaaaggcacgggaggattacgttactgcattgggaagaaaaaggagcaggtgaaagagggcaggaggtctgttttctgaggcctgcttttgaggcctaaagagccccaacattataacaaaagactaacaagggctgtgggagttacgagccaggaactgtggatgaacacacacacacacacacacacacacacacaagcatatgcctcaacctttgtttttggtttcattaactgtaggcactttaacttcgtaacatgaaaatattggtggacttttctttctctcccaactggcccctaaattctgtctttacagtgtttacaaagaatccttacgttctactttgtagccataattaggtattttgtgctttatcattaggttgattttgaagtagaaaatcaataatctgcatttatgttattttgactgtgtcttgtgctataattacataactttttttgtttagattttgtttgtttcttggaattcgtaattatgtttttctcccttgtgttacctcttttttatcatattgttagattcctccagaaagtatgtctcaagcatactttcttgtctttgtttttttccccggaatctctcagagctctctggtctctggctctaggtcagattaaatgcatttcaggccttctctatagttgtgctcttggaacttcctttttggctcttctgtttttgatctgtaaaacagaatcctgtggatcctatgtcttctttctcagttttactgctttgttttcttgactttaagtaacttcttcagagaagatgaatgggagataagtttcaatgttggtccatatttgaaaaactttattctgctctcaaatgttgttgatacttagactaggttaaaaaaaaaatcctcagaatttagaagtcattgcctcattgtcttttagtgtattggctttctgatgagatagatgatgacagtctaattactgcccttctagctttttttacctagaagcctttagagtcttcttaacactgggatttaaaaatttccctaataaaaaattaagtagagcttccgttcaatctccagaaatttcttgaatttctttaataattttatctcttctattttcataagtttctctttctgcaactctattattcagatgtgggaacttctggtttgattgtgtttgtctcatctctttttgagcattattatcttgagtagagatattacgggataatgggcgattatgagataagtgggcatttttcccccctacatttagggaatggtcaagtttattttctagaacttctttctgactttactcatcttttagactagagcatcatagtctgtatggaaatcggcatcatttaacatttctctattcatattaactagtttttaagtttggtctttctcctgaatgcatatctctcttgtagggtcagttttccaattgcttatcttggtctctgtctttggggccgtgggctttcctcaaatgttcgatgatccttagtcaccttttatttttatggatgaggcattagagacctgattgatagccctacgtccctagcaaggctttttctttcttttctttttttttcttttatttgagacagagtctcgctctgtcgcccaggctggagcacagtggcatgatctcggctcattgcaacctctgtctcccggattcaagcaattctcacacctcagcctcccgagtagctgcgattacaggcgcatgccactgtgcctggctaatttttgtatttttagtagagacggggtttcaccatgttggccaggctggtcttgaactcctggcctcggcctcccaaagtcctgggactataggcattagccaccgtgcctggccagctttttctttagagtaaataggaggctacctgtgtgatgtttggtcccactgaatgccagaatctggaaaagtttactctggggtagcatcatccacactaacagcatttgttctttccagtttattttattttctttagagaataggcctccttttttgccccctgcaagataaataccagtctgtctgctgtgcagtgtatggtgtcaactccattatacaagccttcagttaatcatcccccaccccttttttttttgagacaaggtcttgctctgtcgcccatgctggagtgcagtggcacagtcatgactcactgcagccgcaaccttgcagcttcaagcattcctcccacctcagttccccgagtagctgggactacaggcacgcaccaccaagcccagttaatttttgcgtttttcttaatgatgaggtttcaccatgtttcccaggctggtcttgaacttttaggctcaagggatctgcccgccttggcctcacaaaatgctgggattacaggtgtgagccaccgcaaccggccccatttcatttactttcattaagtttgaatcagagaatctgtttcagaattccatcttaatctcaaattggagaatgttgttcttcattcagactccttatttccacttaggaaagtgggccagtgtattactaaataaatttcccaaagacatgttttcagttacaatgaacattgaatcatgcagttttatagctaattttgtgtaccctgggggattaaaaagaaaatcaagaattgaggaaggttggaatggccaccaaaaatctaaatcattagttgcatcaaggtatttcttatgtcttaaatagctcagtcatagcatgtaactggtttttctattaaaatgtttttctgttaattgaatcttttgaaaaaataatctgatgaaacaggttgatgaaaaggtaaataaatactgaaaaattaaaattaagatgtattttcctttagctattgaaaggaatgctgtgtaccctgcctttttgttttgttttgttttgtgttgttgtcgttgttgttgttgttgttgttgttgttgttgttgtttttagacagaatcttgccctgttgcccagggtggagtgcaacgacgcgatttcggctcactgtaacctttgcctcctgagttcaagtgattattgtgcctcagcctcccaagtagctgggattacaggtgcctgccaccacacccagctaatttttatatttttaatagagatggggtttctttatgttggccaggctggtctcaaacccctggcctcaaatgatctacctgcctcagcttcccaaagtgctgggattacaggcatgaggcccagaggtaccctgctttttttgcttaaaggtcctagaagacaggcaactaataagtgtcagagcctgagtgtaaattcaggtttttatgctgcttgaacttctcagtgcacaaaagttgtgatataactaattgaagacatatagagaaggaaatcagtaaatatttttaatgcattataaaatgaaatatgatttttacctatcaaataagctaagttttcagaatgaggtagtacttaaataccaaaagcccatgtgtggctggtggggatgtaacttagtacaacctttttgggaagcagtcatactacataaaaatcattagaagcgaagcattcatggccactgactagaaggaaatattccaaaatgttaatagttgttctgattaggtatgccttgaaacaagtgttttccaaattttccacatttaacatgttatttttataaataggaatgttttaacccctacttagtagtttaattttagggaaataattctaattacagaataaagattatccaaaagtattcaacaactatatttttagtagtgaaaaattggaaataaatgtccagctgagcagaatgtgccaaagtaagcagtgatacttctaagggaagcatgttaagatttttttttttttttttttgagacagagtttcgctcttgttgcccaggctggagtgtaatggcacaatcttgtctcaccgtagcctccacttcccgggttcaagcaattctcctgcctcagcctctcaagtagctgggattacagcgtggggtgcccaccaccacgctgggcaaattttttgtttccttagtagagatggggtttcaccatattggccagactggtttcgaactcctgacctcaggtgatccacccacctcggcctcccaaagtgctgggattacagatgtgagccaccatccatgcctggcctccatgttaagatttaagagatttcatagaaatgaaaaaagtttgtaatagaaaaagccagatgcaaatttgtttatgtagtatgtgattacagataaatatttttatgaagatacagcaacataatggaagaagagtcagtagtttatcagtgattatgtttggatattgagattcaagtaatttttctcctttgtactttttaatatttttcagattttatttattatgtactgaagtttttaaaaagtatttttctaacatgaggtaaaactacagctaatattttcctaggctgccacttggtaatactctgttcatattatctgaaagtttagttttttgtggggagggcagcatttgataatgtcttattttcttctgtccaaatggaatgggcatttttgtatcatttcttagatctgaaactcagcaccgaggctctgctccccactctgagagtgatctaccagagcaggaagaggagattctgggatctgatgatgatgagcaagaagatcctaatgattattgtaaaggtaagttcataaagaggtatgaagtgagacatgagccatctatttgcaatttctcgtttggatgtttgatctatcagcataaacacagttttattgctgtttacttgtatccttttctctaaaacataggaaatagtatttgttcttagtctgacttaatttatcaaagcctaattttatattaaatgtttttacctttttcctctttaaaaattataatacatatttaccttagaaaatttcagagctgtgttaaacagaaaagaaagtaaaagacttctgcaatgctatcagccacatataaccagtgataacattttggcatatagatttttacaaaataccttcttaccactttttttctcatagtgatggctgttaagttaaactggaatgacagacacttaaatggtgtcattaggttgcctgttaatcttttctgtttcttgatgagactttctagagtctttgggtaggaacacaaaatggaatgtatcataccatctagaagaatgtggtccttcttattctcagctgacaaagataaatatgaaaataccttgattcttgccactgttggcagccttttcaggccttcttctgttttctggttttttgggggtttttttgttttgtttttttgagacagagctgcccaggctggagtgctgtggcacgatctcagctcactgcagcctctgactcctggattcaagcgattcttgtgcctcaggcacccaccaccacgcctggctaatttttgggattttttgtttttttgtttttgaggcggagtctcgctctgtcgcccaggctggagtgcagttggcgcgatctcggctcactgcaagctctgcctcccgggttcatgccattctcctgcctcagcctcccgagtagctgggactacaggcgcccgccaccatacccggctaattttttgtatttttttttttttttagtagacacagggtttcaccgtgttagccaggatggtctcgatctcctgaccttgtgatccgtctgcctcagcctcccaaagtgctgggattacaggggtgagccaccgcgccttgccgttttttgttttttgtttgtttgtttgttttttgagacagagtctggctctgtcatccaggctggagtgcagtggcacaatctcagctcactgcaacctccacctcctgggttcaagcgattctcctgcctcagcctcccgagtagctgggactacaggcatgcaccatgacactggccaatttttgtatttttagtagagactgggttttaccatgttggccagtctggttctcaaactcctgacctcaggtgatccacccacctcggcctcccaaagtgctgggattacacgcgtgagccaccatgcccagccttaatttttgtatttttaatagagacaggtttcactatgttggccaggctggtctcgaactcctgacctcaaatgatccgccctccttggcctcccaaagtgctgggattacaggcatgagccaccgtgcctgggctgttttgttttgtttttatttagagaaaatcccgtttgcttacttgcttttttttttttgctaaataaacagaattattctgtctcctaaaaaacacctgagactgtaattgtaaatagatatatatgtttagataaacctattgaattattgagagacaagaatatcatgatatacaacctttttattgtttttggatgagactgttgtaggctcaatctaaatcattaatcttactcactttttttaataacatgaattcagtaatactatgtggctgatttgactattaagattttcttctgttgaattgattgtataaaagaaactttttattgataaaaggtatatagatgttgaaaaatgtgatgttaaaaatgccttttcttaccattgtttctcatcctggtttttctgattgtatttcccctgtttcttccaggaggttatcatcttgtgaaaattggagatctattcaatgggagataccatgtgatccgaaagttaggctggggacacttttcaacagtatggttatcatgggatattcagtaagttttagtggttctgtaaaagaattagttagatgatgtctaaatgtgtttgtctgagtttccactgctgatccaggcttcaatctatctctagcctgattcatttatcagaattttgttgttggcaatagtctctgtattcttggagaaaccacttttctttcgtgaagaatcagtattatatatctccctttctactatagagacaggagtgattaaattaatgctggtaaagcttttgtcgtttgatttttttgtgatttttatcattttcttttcaccgaagtatttcttctggctgcctatgggaaaatattacagcttttaaccttttagtttttgcctatatacagatatatacacagaacacttggaatttggtaatatctttccccttatttatcctcattttgcagttttgcttgtaactcagggagatattcaaaagaaggattttaactcagagaaaatgttcaacaactgagattatctgagaacagattttttattcttcctataaatgaaatctggccagttagtgtcattaacaagtataaatgttcccatagaagtagcttgtttgggctacagggaaacgtgaaatcaatatttgtcctttttaaccatcttatagctaaatcttagcttcctaaagtaagggtaggctatgtagtcttaattgcctgtgtttgtttcttagggggaagaaatttgtggcaatgaaagtagttaaaagtgctgaacattacactgaaacagcactagatgaaatccggttgctgaagtcagtgagtattagattatatgtatgaatgtgaagaattataaataaatcaagtttcattgaataaaaacacaccaagtggaggctctttagcatggataattttctctataaagttctagtaaccttaaagaggtaaaggaagacaacaatatttacacataccatgcatgtagtagggaactggtggcaaatgctatgatgagaattcttcttacacgcatgaaccaaaaaaaaacctttcaaatgaataaaaatattcactgagcatgttttacaggccaggtagctactgtcataatgtttttttttcctactatggttaaaaggaaagttgtgtaaataaatgtatagcatcttttttgttgtttttcaaatatgttatagaatacataatataaaaatactgtatttactgattccatttatacctggaaactgagataaattctatcaaaaatgtatttttagttctgttttaaattaggaatatgccagtgtggtagaaggaacttaaattcagaattagaaaacctgggtttaggtcgcctttaccccggtatgtcctccatgttaccatttttttctttctgagtctcagattttttattcataaagtgagaatgttgcaccaggagatttctatggcagtagttttcttttttattttcaactcctggcctcaagtgatctgccttagcctccagagtagctggggttacaggcacaagccactgcatctggcttaagacagtacttttcagaatgtccgtttgtgacaagataaggagccttgtacctacccaaaagtaaatcaacatactgttttcttcattgagaaagtttttccatgaaaaaaaaaatgtccgctgaaaaaaacagtgtggttagtgctgtagttgatttgcatcctgcaaaatcttcttagttcctcatagcctggtaatcatcagttaatttggaggccacactttgattgatatcagggagcaaaatagtttaattagaaaaatagttcctgttggttgtatttcctcttatgaattgactatttaagatttttctccattaaagctattgaaattttagtatattttaaaaatagatttatgtgagctctttcttgtagttaatttgctgtaagtattcttcccctaccatctggtttatttccatgctttaccttgtgctaaacactgtctcttccccactacaggttcgcaattcagaccctaatgatccaaatagagaaatggttgttcaactactagatgactttaaaatatcaggagttaatggaacacgtatccttttaaaaacctatttgagaataaatcatcccaatcccaaagaaaggaactagatttgttgtgtagatggccttggtgtcttttctaaggcaaactataataaaattacctcttttattgtacacttctgaacacacatctgaattttgtctaattttgtgtggtgtgatttttcagaatattgctttaagcttcttgtcctcttttcaggcaaattaaagcgaaatcaaaggaaacttttagaaaatgcgttgtatcactaagtaaagagtctatgatttttgtcagttagcacagaaactttaagggaagtaatttcttatgaaaaatactgagtaggccgggcacggtggctcaagcctgtaatcccagcactttgggaggccgaggcaggtggatcacctgaggtcaggagttcaagacccacctggcgaacatggtgaaactctgtttctaccaaaatacaaaaattagctgggcatggtggcaggctcctgtaatcccagctactggagaggctgaggctggagaatcacttgaactggggaggcagaggttgcagtgagccgagattgagcccactgcactccagcgtgggggacagagccagactctgtctaaaaaaaaaaaaaaaagatactgtctaaaagaaagagaaaaagagagaaagaaaaagaaaggaagaaagaaactggatgaacaatttaaggtatgattgtatttattatactaagcctcaactttgaagaggctgtgaatgtagtttatgtttagagtctaaaagggtgtaattgttcacattctattataatgaaaaactgacttgttttatgtttttatctggatgttttagaactgtagaattgaaaggaaccatagctgattttcttcacaggtatcaaagtgacgtgcggtgagctaatggaaaggttattgcaacagctgtgcttataaaggtcaatcagatttttcagtaaaagatgaagtcgaatcttacttagattggataaatctaaaatcacctgtttataagctgtttttaaaatgtataaagacatttcatacattattttacttttcatgcatgtttagcttcctttaatgcacattcctaattgctgttgatctttttgtatttaaaggagacaggactacatatgactagtttcatgtagactatgggaagagatttgaacagagaagcaggaaggaagggatgggaaaggagagagaacagctgataatgtggaaagactattgttctaaagtcaattctgagtcatttcttagaaaaatacaaatcacagattacccagatgtctaaggaaaactgctgcaaccatcttaaaacagtatcttgtgcttattgtggtcactttgtagatggctctctctctctctctctctctctctctctctgtgtgtgtgtgtgtgtgtgtgtgtgtgtgtgtgtgtgttcaaagaattaagaattctaaaccaagtaattttttaaaaacctacacagggtgtcgtgatggccatatctgttttttctattatttaatcttgtaatgtttgtcattgtgccagatttctttactaatttgcaaaagttccaagtaaaactatagaaatactctcaaatctccccagtaatgctgagtacctttatttgaccctaactaagcaaagaaggctttttaactattgaaatatcttagtaggtttgaatttcaagttccaagatatttttctttttcttttttggagttcaatggcataatctcggctcactgtaacctctgcctcctgggttcaagtgattctcctgcctcagcctcccgagtagctgggattacaggtggatgccaccacacccagctaattttgtatttttagtagagatggggtttcaccatgttggccaggctggtctcaaacccctgacctcaggtgatctgcccgcctcggcctcccaaagtgctgggattacaggtgtgagccaccgtgcccggcccccaagatatttttcaaacattgctaggtggtttctctgtagcttctgtccattgattccctattttattcttttctccatttgttcttagccattttttcctgtctttcttcatccttatctcccagctgtctttgctcctgcattatttactactgttagagattgaaaggatataactcaaaacactatgttaagggttagtaatggctcatgtcactctcctgcctctacccgttttcccaacataacatacccacacagagcagtacatccacattcgtgtgtatgtttgttcaggcgtttttttctctggaccactatcgtttctcatattaaaatataaagggccctaaactagaaagttagttcttacagaattccatataaactggctcactctacttgcctggagggtgaggggaaaagaatgattaagaaggaggacagttggtttctctatataatgttgacattagccagtcattattgtctgcttatatgacctcctatgtctttaggatactttttttttcatgctgtattctgtctgttttgctagctcctcttattcataatgtgccctaaatgtgcttactcaataacataagccttttattttcagccttttgttattttctttacactgtctccccattagatttttttaaaaatataaccttgtgggccgggtgcagtggctcacacctgtaatctcagcactttgggaggccgaggtgggcggatcacgaggtcaggagaccgagaccatcttggctaacacggtgaaacctcatctctactaaaaatacaaaaaaaagctgggcgtggtggcaggcgcctgtagtcccagctactcagaaggctgaggcaggagaatggcgtgaacctgggaggaggagattgcagtgagccaagatagcgccaactgcactccagcctgggcgacagagcaagactccgcctcaaaaaaaaaaaaaataaccttgtgatttcaattactagtgcttctgattgctactcattagctttctttcactcaaattatttggctcttcctttttgccacttgattatgatgttctgtcaagtttttttttaagctactatatgtttggtcattttaatatcactgcttacaaattaaaacattttcaaattgtaatacttctctcaacaaataaaaattaagcagatggaagctagaaacataagagaatagctttacaatcctattttatgtttagtctttttaagtaatctgcattttaaataatcttgttttgataattttttttatttaattgcttttttatttttatttattttgagacagagtttcgttcttgttggccaggctggagtgcaatggcgcaatctcggctcactgcaacctccgcctcccaggttcaagcgattctccttcctcaccctcccgagtagctgagattacagatgcacaccaccacgcccagctagtttttgtatttttagcagagacggggttttgccatgttggcgatccacctgccacagcctcccaaagtgctgggattgaaggcatgagccaccatgcccagcctatttaattgcttgtttaaaaaaatttcctggccaggtgcagtggctcacgcctataatcccagcactttgggaggccaaagcgggcggatcacgaggtcaggagttcaagaccagactggccaacatggcgaaaccccatctctactaaaaatacaaaaattagcgaggcgtggtggcacgtgcctgtaatcccagctacttgggaggctgaggtaggagaatggtttgaacctgggaggcggaggttgcagtgacctgagatcatgccactgcactccagcctgggtgacagagcaagactccatctcgggtggggaaattttttttctcagcagaatcattggtaaatttcaaatgtaaagaagtagaaatagtttaatgaatccccacagatccattacccatttcaggagttatcaacttatagccaatcttgttttgtctgtacctcctgataattctgtagccaatcttaaacattttatctgtaattgttttagaatgtatttctaaatgacaaggactcttaaaatataacctagccaggcactgtggctcatgcctataatcccagcaccttgcaaagctgaggtgttcaagaccagcctgggtaacatagcaagaccctgtctctacaaaaataaaaaaatactagccaggcatggtagctcatgcctgtagtcccagctacttgggaggctgaagcagcagggtcactcgagcctgggagtttgaggctgcagtgagctatgatagtgccactgtactccagtgtgggtggcacaacaagatgcattctctgacaaaaagatttgttaaataaaaagataacctgaatgcaattattataccaaaaaaaaaaaaattgtgaccagtttcttagtcacaagtttctctagtcagtgtttcaatctcaccaaatgtcttgtgctttattttctttttgtcttcttcttcttctgctgctgctgctactactactactactactactactactactactactactactagtactactactactattgctactactactactgctactactactactgctactactggttgttcttattgttcttgttcttcttcctctttggtctaattttttctttattgtggtaaaatacacataacataaaattgtgcagtcattaccatcatccatcttcataacttttcatcttgtaaaactgaagctctatacctgttaaatggctattagatctcattggtttattgtgttaagtcctctattgccttgcttatcttctgtctgcttgttctatacattattgagagtgtggcattaaaatctccaactattattgtagaactatttctccctttaattctgtcagtttttgttttatatagtttggtggtcttttaataagtatgtaaatgtctataattgttatatcttcttggtggtatgttgaaccttttattaatatagataatgtccttctttatctcttataactttttctgattgaaaatctattttgtctgatattagtatagccacccctgatttcgtttggttactatttgcatggaatcttttcttcagcctttcactttaatctgtttgtgtctttggatctaaagtgagtctcttgtagacagcatatagttggatctatatctatatctatatctatatctatatctatatctatatctatatctatatgtgtattctaccaaaccaaagttataatcatactagcttttagactaattattttttgacatattggttttttaaatcatgtagaaaacaaaaagaggagttataaaccattattacaatattagcttttataattgctcaagtatttaccttcattgataatctttatttcttcatatggatgcctggctttgtgttattgtttagtgtcttttcatttcaccttataggactcccttgaccatttccagggcacatctggtaatgaactcgttcagcttctgtttacatgggatgtcttaatttttctctcacttttgaaatactgtttttcttaatataggattcttggttgacattatttttcttttagtatttcaaatatattggcccactgctttctggcctccaaaaatttttgatgagaaacttgctgataatcttagtgaggatcccttgtatgtgaagagtcactcttcttgatgctttcaagattccctcttaatctttcaaaagtttgattataatgtgtcttgatgtgggtgtctttgagttcatcttgcttgatgctcattgagctttttggattcatgtctttcatctaatttgtgacgttttcaaccgttgttttttttttcaaatattctgtctggccatttcttcttcttttcttttctttttttttttttttctttttttttttttttgagatggagtctcactctgtcacccaggctggagtgcagtggtgcaatctccgctcactgcaatctgcctcccgggttcaagccattctcctgcctcagcctcccaagtaggtgggattacaggtgtacaccaccacacgcagctaatttttgtatatcagtagagatgggatttcaccatgttggccaggctggtcttgaactcctgacctcaagtgatccacttgccttggcctcccaaagtgctgggattacaggcgtgagccaccgtgcccagcctcctcctctattcttcttctgggactgccacagtgtatatttggtctactcaatgatgtcccacaggtcccttaagcctcttcacttttcttcaatcttttttctttctattcctcacacttgataatttccatcaccctaacttcaggtttgctgattctttcttctgcctacccaaatctgcctttgaatccctctagttaattttttcattttggttattgtacttttcagcaccagaattcctttggtttctttttagttttttttttatcctcattaatatctccgttttgtttatatattgttttcttgactttctccacatcttccttttgttctttgagcttttttttttttttttctgagacaaggtcttgctctgtcaaggtcttcacaccacccaggctggagtgccgtggtgcgaacacagctcacatcagccttgactacccagactcaagtacttctcctgcctaagcctccagactacaggtgcatgccaccacacccagctaatttttaaaattttgtagagatggagtctcactgtgtggcccaggttggtcttgaactcctgggttcaagcagtcctcctgccttggcttctgaaagtgatagggttacaggaatgagccaccacacctggcctaagcatctttaagacatttgttttaaagtctttttctagtaggtctgcatcaagtctttttcagggacagtatctgttgatttatttttgtcgtttgaatatgctgtacttaactatttcttcatatgccttgtgattttcttttgaaaactggacatttaaatctaatatggtaactctggaaattagatttggccatatccctaaggtttgatggggtttgttatttatttatttttttgagacaggatctcactctcttgccaaggctggagtacagtggcacagtcatgacttaaactgcagccttgatgtcctggaatcaagtagtcctcctgcctcagcctttcaaatagctgagactacagttgcatgccaccacacccagctaattttttattttttgtggagatggggtcttgctatgttgcccaggctggtctcaaccccctgggctcaagcagtcatcctgcctcagcctcccgaagtgctgggattacgtgcatgagccgctgtacctggctctgttttgtttttgtatttgtttttcttatgtagtctttctcttccaaggatcagcctgagatgtaaacgaaaggtctttgctcagtctgcatcttttcctgggcatgcgcagtcactttctgattttccctctatatgcagttgcttttgaatgtcctagtctatttatttatttagagacaagagtctctgtcacacaggctagagtgcagtggcacagtctcagctcagtgcaacctccgcctcctgggtttaagtgattctcctgcctcagcctcccatgtagctgggattacaggtgcatgccaccacacctggctaattttcgtaattttaatagagacagcgtttcaccatgtttgccaggctggtctcgaactcctggcctcaagtgatctgcccactttggcctcccaaagtgctgggattacaggtgtgagctactgtgcctggccgtaaatgtcctagtcttaatgtctggctcccaaaggggaaaaagaaagaaattgaaggagaggaaatagggcactggccctttaaatctttgcaagatcacttgagccagaagaggggcttaaaacaatggaggggggttacaaaaatggccacccgactctgatacttggggcaggatcctttttgcccaccatggctccaacaaactgtgtgcagggctgcttgctataggattaggggataggtggttgccactgtgctaagagctgaaattgaccaacatttacaataattattatccaagcctcttcttcgggaagttgtgagccctcagtagactccagagtttcttaagaatcacattagacagattctgccaatgcattggttgtctaggtggggaaacagatttctggtggcttcttactccaccatcttctcagactcttctctagtttacgattcttacttgagtcaggatctgtatgacattttggcagtttattacctggcatcaagatattgcaggctcaccttgtgaatttcctgtcttaaatctagaatcagtttttctctaagaagccctaattccattcagtgggaaatgacatccagaatctaagcacttaggggtatgctttgctactgggtgaatctttacctttatgatttgttgattcattgcaaaaagcacatactttcacctccttcctgtcttccctttttggaggtcactatttgagttgcccccaaagcttgcttttgtggatgtgtggatttgtttgtttggattatttttccaaattgttttattttggactaattctgttgctgtgccatcaaattcactaatctttttattctacaaaatctaatctgccatttgttccatccagtgtgttttgatctctcacattgcactttttgtctctggaagttcattttcaagtcttttttttttttttgagacggagtcagtggtgcaggagtgcagtggagtgcagtggtgcagtggttgctcactgcaacctccgcctcctgggttcaagtgattctcctgccttagcctcctaagtagctgggactacaggcacgcgccaccatgcctggctagtttttttgtatttttagtagagatggagtttcaccatattggtcaggctggtctcaaactcctgacctcgtgatccgcccacctcggcctcccaaagtgctgggattacagccatgagccactgcacccggcccattttcagtcttctaaaaaatacttttcatgtctctacttaattttttgaacatatggaatacaactataataaccatttattgtccttgtctaattctaacatctgtgatggttctaagtcagtttcacatgatcgattattttaattttggatatgttttactacctggtaatcacattgtaagttttaccttgttggctgctggatgttttgtatttctataaatcttcttgagccttgttctgggatggtgtgatgttacttggaaagtgttttatccttttagattttacttttatgatttgttagatggatccaaagcattgctcagtccagatctaatcattccctctactgaggcaagaccttcccaaatatatcctacccaataccctgtgactaaatttttctagtctctttgctgggaacaggcactgttccaagccctatgcgaatgctgggcattgttctctataatcctttaagatgttttttcttctctgcctctgctagtttcctcacacacatgtgctttgctgaatccttgaaggggcgggccccctctgcaaatctccaaatttctctctttctgcagctctcccctctctctggtacctttttcagtgaattatagctgccttggtctctccagactctcagctcccattgattcaacttgtggagtctacctggaaagcctcaaggcaataagatggggcaatcccagggttcagctcttgtttccttttttcagggatcactgtacttgttgtctgatgtccagagtcttctgttgtttttgtatttggtctgtttgagtattgttttttcaataagataagtccagtgcctgttactccatcttggctaaagcagaaaacttgataggtgctggggttttttgtttgttgtttttgtgacggggtgtcactgtgtcactcaggctggagtgccgtggcatgatctctgctcactgcagccttgacctcctgggctcaggtgatcctctcacctcagcctcctaagtagctgggactacaggcacacgccaccacacttggctaatttttggatttttcttgtagagacagggtttcaccttgttgcccaggctggtcttcttgaactcctgggctcaagggatctatctgtctcggcctcccaaagtgctaggattacaggcatgagccaccatgcccgacctgtcataggttttatatttaagaatttgccaagcagttttccaaagtgcttgtaccattttagacttctactagcataatacaagagttctaattgttccacaacctcacctacatttggtgatgtttagtttttttattttagtcatttattagtttgagatgctatcttactgtaattttgatctgtgtttgtggttgtcatgtgcttttaatcttacgtagtttggaacatttatgacattgccttttttttttttttttttttttaatttaagaatccaggctagttgttttatgccaccttagtttggatttgtttgattgtttcctcatgattaaattcaggttaaccgtgtttgtcaagcatagtacatggattattgcattagaatatgcattcgaatgcatattagtatattgcattagaaggcacatggtgtgaatttgtgcttatcattggtggtagtaagtttgatcacttggttaaggcagtgccttccagatttcccagttgtaaaggtactttgttctttttgtaattaataagcaatctgtggaatgatattttgacactgtgacaatcctttttcccgacagtctttcacatagttgttttagtattcactgattcttacctgaatcagtaatagtatactatagtgattgtaaaaatggtgattttctatttctgtaatcccttatgtatttattatttggctttcttctctaaagaagatgtttctcttcctcctgcctccacacttactttcagatcagtgtggacttgttctgtttttaattcatatattaactcataattttatcctttatagtggtctggccgggcgcagtggctcacgcttgtaatcccagcactttgggaggccaaggcaggtagattatgaggtcaggagttcaagaccagcctggccaatatggtgaaaccccatctgtactaaaaatacaaaaattagcccagcgtggtggtacacacctgtagtgccgagaggcagaggttgcagtgagctgagatagtgccactgcactccagcctgggcaacagagccaagactctgtctcaaaaaaaaaaaaaaaaaagaagtctccatgttggctggtgacatccttttcaagatggttcctgtttcttcctgacaggttcttttatttgttagaacagcaaggtgttccaagtttaccctgttatttttcctaccttggatttggccatttttccaaggagctcaggctttcctttaatggagaatgttaaagtctgagcactagaccattactatatatgtatgtcttaacttgcatgtagaagccagtgggggtggaagacatcaagatactactaaaatctctgtagtgccctgcacaattttagactcagagtattcctgctgtgtggtgtcatcaggttgttcatacataaggacaacacatggtggcactggaatcaagattagttttgtaaaatacagagcattaagcaagtttcctatttaaaaaaaaatgttggcatttacgtttttgaggtttaagtctttcttgtacattcatctcttctatagttaaggaataatttgtttttccttgctttgaagctgtgagagtgggaatttttaccctggacaccaattttgatattagggaagaaactaatttacctgaagctaatcaacagcttgaggcttgagcctactgctttctttcactatttgcatatgtaggtttcactttttcttttaccattgagtattttaatgtacataataatattgatgaagccagccgcccacaatttaatgtttcatgaatgctttcattgactatagcattagactttgaaattttagaatattaacagctacatatttattcattcaagctctgtaactttttatactgaaagaaaataatacataacatttaatagggtggaattcacagcttgtcttgccgtgttcttcttttgtgccgttttttccctccttaatgaattcctagatatctgcatggtatttgaagttttggggcatcatctgctcaagtggatcatcaaatccaattatcaggggcttccactgccttgtgtcaaaaaaattattcagcaagtatgtatcttgaatcagcaagtatcttagtcttgactatgtagtgattttttaatattcttgaagtgtcaggactttattttttccaatagaatttttgttttaaggccgggtgtggtggctcattcctgtaatcccagcactttgggaggccgaggcgggcagatcacgaggtcaggagatcaagaccatcctggctaacatggtgaaacctcctctctactcaaaatacaaaaagttagccgggtgtcttggcaggcacctgtagtcccaagctactcgggaggctgaggcaggagaatggcgtgaacccaggaggcggagcttgcggtgagccgagatcacaccactgcactccagcctgggcgacagagcgagactccgtctcaaaaaaaaaaaagaatttttgttttaaaattctttgttttaaaaagtaagttattggctgggcgcggtggctcacgcctgtaatcccagcactttgggaggccgaggcgggcagatcacctgaggtcaggagctcgagaccagcctggccaacagtgcgaaaccccgtctctactaaaaatacaaaaattagccgggtgtggtggtaagcgcctataatcccagctactcggcaggctgaggcaggagaatcgcttgaacccgggaggcggaggttgcagtgagctgagatcgcgccaccgcgctccagcctgggcgacagagcaagactccatctcaaaaaaaaaaaaaaagttaattgctaaaattaaatatttcattcaacctttagaatttattgtgcttattctctttttaaatgttttagcataaccattttcccccaggtttgcctcctataataattagaaagggaagctgaggttcctgacttgggaacattggagcccttatccagaagttctggttgcaaatagtaattttacatgaatagataattgctatgtcagattattgccatctctttatacagcatgattcataggcattttctaattttctaaagagccttcaatatacagtatagattttaccatcaggaaaatattaatacttcaaggtgcaaaaatttgtttggattatatgtcctggaaagagctccaaactgggcagcaagagacctcaattcttcctcagtgaggaaatttgaattaaagatatctaaatgtctgtcagcacctacattacaacacttagagggtgtgtgtgtgttgaagtttattctcagtctttgcattgtacatagttgaagaatatctccaaatagaatcagctttgtaaaacattgaagaattttttattgtaaataatttcttgcctttttcatagtttaatctttctgagaaagtttatttgtgcttttttaaaaggtgcttttattctctatagaaaacgctatcatatcttttttttttttttaatgtcatgttataatctcttacttctccagaaagcctgtattttgtgtttgcaagtctgccactctatttccattcaggtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcaggtgtattttcttttagggacttcgctatcattagaagttaaaaagaaatttctatttttattctgttaccagggaattaaacaccactcaatccatttcaacaataacatatttaagaaacattatcagcttccaagagacattctcactgttacttccataggggaaggagaaaactagatattgtgtctttgtgttgtatgttataaaagctggtgtgtattgtttaaaaatattttttcttatgagttgatgatttttgaagtgtttacctctaactgtgatcacacatgctcatttataggactggtagtctgtagagggacaagataacattgctattaatagtttaggtttaaacactggagtagacagacttggtttgaatttgggcttcatcctagactgagaaaccttagctgagttattttactttattttccctcaactgcgaattattgggattaaatggtaaagcagttagtagtgtgccacacaatattatataccaaataaattgcgggaccaggcacagtggctcatgcctgtaacgcaacactttgggaggttgaggtgggtggatgatttgggcccagaagtttgagaccagcctaggcaacacagtaagaccctgtctctacaaaaattaaaaaaattagccaggcatagtgatgcgtgcctgtagtccatttactcaggaggctggggcaggatgattgcttgagcctaggaagtcaaggctgccacgagttgtgatagtaccactgcactcgagcataggcaacaaagtgagaccctgtctaagacataaaattaaataaataaataaaggctgctttatgattttttttcttttgagatacagattttagttttagtagtgtgtcattttttaggaacttgcttgatcctcaagttgagttattagttatacacttctttaaaaaggaagactaaagaagggggaaatggggagttggttgttaaatggatgtagtttctgttttacaagatgaaaacattctacagatcctgttatacaacagtgtgaatagtgttaaaaccactgaatgtacacttatctagagtataaatttttattatgtgttttttgttaaccacagttattatactaatattttaaaaagaggaagactgaagatcctaccttccagctaagctacactgttatccatgacatgctgtagagcaaattactatagctcttgatgtcacctagactccccttttaaaactgacagattctgggtagcatttgaggtgaagaggttgttgcttgtcccattctattttaagcagtgcatgggaatggaaaataggtgatttttagcaactttagtttacctggggaggaagaattttatttatcccttttttttaagtttggcaatttctattcattattttctttaaaaatggtaataatatagcttctacttaagtcatttaaaaacaatagttttctctgcaatgtagactacataagaaagacttttcattctggtagagtgttttatctgagccttagtttatattgcctgatgaatgccagaattcttacttggttttcttttcttttcagtcagtactgctccccagcctaaaccagtaagtataaggtgtttttatatttaattttgatctatggactatgggcatgggttcttctgttgtggatggtaacagtttgtttcaagtttgagaaccaaaaggaaaaaaaattcctgcgcttctataattttctccagtaaattcccatgcaccttcatcacatttgtactggtgaggcctctaaaaaattcgagtttgtctgaatgtaaaccaaccccacggactgctcagaagaccacactttgttatttattctgtttttatttgggtttataagagtatcccgcatcttttaatttaatgaaagacttaagtgctatgttagggaaagatttgtgaaatttaattaggaagtaattaaagttaacaactatctccaactgggggtaattaattagccacctgaaggctttatctgtttgtaatctccgcccaggctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttggtataaatagaacatcacgaaaattactgtacaacacactttaacgttaatttatcattgctatataatacagtggtttcatacatacaacacatctctgggggtatctttataagaatatggatcttgtcataaatgttaggcaggtaatatttaaatgtaatttgtaacttttctcaggaaatggaacatagatttcatttaacaattgggtaaaagtaagatcttggcccttccggaaataggttttagatgtttagtcatgtttttatgtcactcagtataagttctagaaaatgttttaatcttgtgagaaatgtttctgttctttcactcacacacatatgcatatatctttttttgttcgtttgttccttagaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggtacctatgcagctatacttcctcaacactccttccctgcacaacacattcacagatttctagactaaaagtatgattgtttttgtaactatagctttacaacaggtgtgtctaagttacgtttaaattgtaatctgtagctaactttatccatcatgtactgagtacacagcacttcatttgttgctgtgagggcagaggtttttaattctggaaactcaaggcgttgctgtgctctttttgtctcagaaaatgtaagttgtcacttgggtattgctgactgtattactcttaccttggagagctttattactcattgagtatttctctgttcattgaacagtcttattgatgatgcctgttgtctgtaggaaaatccacggctggaaattttcttgttaatccccttgagccaaaaaatgcagaaaagctcaaggtgaagattgctgaccttggaaatgcttgttgggtggtaagttaaacttgccttaatggtgttttgaagtgactgggaggatgaatgagaatttggacttagttatgcaaaacatccataattctgtacccagattgatacaacacttcagtgaatatttttttacatttaaaaaaaccttttactatggaaaagtttaaatatacttacgaaagtagaatggtaatcgtgatcatgaaaagtccttctgttaccccaccccactccagatacccatcacccagattcagtaatgtcaactcctggccaatcttgtttttaatatatatatcattattaactttcagacactcagtgcctatgttcatactcccctactcccattttcaaaattgatgactaacttataaattgtaacctccttttaattcacttaacatattttggacactttgctttgtcagccagaaatttaaatacaattcagttcattacattgtttccctagtacactttaatctacatatttttgacagctctttgtgatgagactctgcacgcaaatctttgtatagtttttcttaggacatgtcctagacatagaattgctaagtcagaagttctgtgatttttaaaagggctttatgatgtatagtgtcatttaacttatttttagttattcgtaatgacatgtaattagaaataattatatgttttttgatgtatagtgtcatattacactctagaaaggatacttcagttagccaggcacggtggctcatgcctgtaatcccagcactttgggaggcggaggctggcggatcacatgagatcacctgaggtcaggagttcgagaccagcctgaccacatggagaaatcccgtctctactaaaaatacaaaaaaattagccaggcgtgttggcgcatgcctgtaataccagctacttgggaggctgaggcaggagaatcacttgaacctggcaggcagaggtttcggcgagccaagatcacgccattgcactccagcctgggcagcaagagtgaaactcccatctcaaaaaaaaagaaaagaaaagatacatcagttattctacctttaacaactcagaaaagtattttcttgtatgatcttcaggctaaatagtggaatctcattttaattggcgaattatttatactgttgttttttactgtgtatctaataaagtgttttaaggtttttttgtttgagacggagtcttgctctgtcacccaggctggagtgcagtaactcaatctcagctcactggaacctctgcctcccggattcaggtgattctcctgcctcagcctcccaagtagctgtgattacaggcgtgcgccagcatgccctggctaatttttgtatttttagtagaggaggggtttcaccatgttggccaggccagcctcaaactccggacctcaagtgatctgcccgtctcggcctcccaaagtgttgggactacaggcatgagccaccatacctgaccaaggttatttttaatggacatctttttaaaatttataatagaatgattcacacataaatgacagtactcaaagagccatatgcttttaaatgggacatggttcagacctcagaaggatcttacttcccatattgattgtagaatattgtgataaccttttagaaaaaacaaagccagcttagcactgactaataagaatgtggagcagctttccaagtaattagaattactccactacgctatcatctggtccaggtcaccctggatgacttcagtagtgactgcaatagcttcttcactttctcccttctgctgcccttgctccccgtagactattggcaacacatctatcagagtgatacttttttttttaatttgtatatgttcatgaggtataagtgcagttttgctaggttgatatattgcattgtggtgaagtcagggccttcaatggatccatcactggaacagtgcacattgtaaccaccaagtaacatcccttcatccaccctttcaccccaccctctgagtcttcattgtcgatcattccacactatacctccatgtgtacacattatgcagctcccacttataagtgagaacatgtggtatttacctttctttgagttgtttcaattaagataatggcatccagttccatccatgttgctgcaaaacacatgatttcattcttttttatggctgaatagtattgtgttcattccataccacattttctttatctactcctagacacttgggttgattccgtagttgtaattatgaatagtgctgtgataaacatacaagtataggtatatttttgatatgatttattttcctttgtgcagatacccagcagtggtactgctagatcatgtggtagttttatttttagttctttgagaaattttcatactattttccttctttctttttctttttttttaaatggagtctcgctctattgcccaggctggagtgcagtggtgcgatctctgctcactgcagcctctgcctcccaggttcaagcaattctcctgcctcacccttcccgcgtagctgggactacaggcacgtgccgccacagccggctaattttttgtatttttagtagagacggggtttcaccatgttggccaggatggtctcgatctcctgaccttgtgatctgcctacctcggcctcccaaagtgctgggattagaggcatgagccaccgcgcccggccattcatactattttctatagagatggtgctgattttcattcccaccaagagtgtgtaagaagtcccttttctccacatcctctccaacatgttattattttttgtatttttagtaatagccactctgattggtgaaagatacctcattgtggttttaatttgtatttctctgctggttagtgatagtggacattttttcatttatttgttggccatttgtcttcttttgaaaaatccctattcgtgtccttagtctaccttttaatgggattatttggttttttttttaattgagttgagtttcttgtaaattctagatgttagtcccctgttgggtcatatagtttgcagatttttttctcccattttgtaggttgcctgttgactcttgattatttcttttgctgtgcagaagcttttttgtttaagtcccatttgtctatttttatttttgttgcctgaggtcttagtcatgagtttcaggtcttatattcatgtctttaattggtcttgggttgatttttgtatacagtgagtgatagggatcttttattcgtctgcatatggcagtccagttttcctagaaccatttattgaaaaggatgtctttttcccagtgaatgtgcttgttgacttttcaaagatcagtttgctgttaagtatatggctttatttctaggttctctattctgttccattgatctgtgtatctattttaatactaatacatgctgttttggttgctgtaaccttgtatagttttaggtcagacagtgtaatgcctctagcttttttctttttgcttaggattcttttggctatttaggttctttttttattccatatgaattttagaattgttttttgtaattctgtgaaaaaatgacattagtattttgaaaagaattgcattgaacctgtagattgctttggatagtgtgattgttttaaaattttttttaatttttaatttttaatgggtacatagtaggtgtatgtattcgtggggtatctgagatgttttgatacaggcatgcaatgtgaaataatcacatcatggagtaaaatagggtatccatcccttcaagcatttatcctttgtgttacgacaatccaattatattcttctagttatttttaaatatataattattattcactatagtcaccctgttgtgctatgaaagagtagatcttattatttgtaagtaatttttttatacccattaatcatccttatctccccacttctcccatgctacccttcccagcctctggtaaccatccttctactctctgtgtccttgagttctattgttttgatttttagctcccacaaataaatgagaacatgtgaaatttgtctttctgtgcctggcttatctcatctaacataatgatctccagttccatccatgttgtaaatgacaggatcccattcttttttatggctgaatagcactttattgtgtatatgcaccacatttttttaattcatctgttgatggacacttaggttgcttccaaatcttaaatattgtgaatagtgctacaacaaacatcggagtgcagacatcttttttatatacagatttcctttcgtttgattatatacgcagcagtgggattgctggataatatggtagctctagttttctgagggacctccaaactgttctccatggtggttgtaaccagtttatattcctatcatcagtgcaggagggttcccttttctccacatccttgccagcatttgttactgcctatcttttggacgtaagccattttaactggggtgagatgctcttgtagctttgatttgcctttctctgatggtcagtgatgttgagcaccttttcatatgcctctttgccatttgtatgtcttcttttgagaaatgtctattcaaatctttggcccattttttgatcagattattagattttttttttttcctatagagttgcttgagctccttatatattctggttattaatcccctatcagatgggtaatttgcaaatattttctcccattctgtgggttgtctcttcactttgttgattgttttctttgctgtgcagaagctgtttaacttcatgtgatcccatttgtccatttttgttttggttgcctgtgctcgtgaggtattgctcaagaaaatttttgcccagaccagtgtcctggagattttcccacatgttttcttgtagtagtttcaaagtttgagatcttagatttcagtctttaatctattttgatttgatttttatgtattacgagagatagggattgagtttcatttttctgcatatgggtatccagttttcccagcagcatttttgactgtctatatcttgaaaagttgttgtagttatttttgattggttgatctttctacttagggtaagagtagtttacacactacaattaacggtgttataatattctgtgtttttctgtatacttactgttactggtgagttttgtaccttcacatgattacttattgctcattaatgagtttttctttctgattgaagaaagattttctctcttctttaagatttcttgtaaggataggtctggtgttgataaaatccctcagcttttttttgaaatccctcagcttttgttttgtgtgggaaagtctcccctccccctccacctccccctccccatgtatttgcctggggatcagtgggcctcctgtatctggatgccttaactctcttgttagacttgggaaatttttatctactattttcttaaagaggttttctaaactgaaaaaaaaattatttattcattcatttaattaattaattaattttttttttttttttaagaaacagggtctctgttgcccaggtagaaatgaggtggtgtcatcatggcttgttgcaacctttaactcctgggctcaagcagtcctcctgccccagcctcctgagtaactgagactacaggcacgcaccaccaggctcagctaattttttttatttccttatatttatctgactagaatatttcagaggacctgtcttcaagttctcagattcttctacttgttccagtctattattgaggctttcaaatgtattttgtatttcctagaataaattttttatttaatttattaatttatttgaaacattgtctcactctgtcacccaggctggaatgcagtggtatgatcacaactcactgcagcttcaatctcctgggctcaagcgatcctcctggctcagcctcctgagtagctgggaccccaggtgcatgccaacacacccagctaattttttttagtagagacaaggtctcactatgttgcccaggcttgtcttaaactcctgggctcaagcaccttagcctccaaaagtgctaggattacagatgtgagcaactgtgccctgcttcagtgaattttttagttctagaatttctggggtttgttgttgttgttgttgttgttttaagatatctgtcaccttggtaaatttctcattcatctcttgaatggattttctgatttcctagtattgattgtcagatttctcttgcatcttattgagcttctttaaaatcagtattttgatttatttggcatttcaaggaattcttttttattgggatctgttgctggacaattgttgtggtcctttggtgctgtcatatttacttgtttatttatgttttctgtgtccttccgttgatatctgcacatttgttgcagtagtcacttgttccaatttttttgaaattgcttttgtaggggagaatatttttctgaagttgtatatatgttgttggttaagtaagatactttttgattttgattttgggtacctctggtagtatggtttttgtataacttttttggcagtacacagggtcaggggtatctgcaatttcctctgtggcttagggtacagtttaggttgtggtgaggttttgctggggacttggatgccagctgagccagtctttggaccctgatggtggcattagtgggctgagtgttcctgtttttaggccccagagcgttgattccagtgttagtgggtcctggaggtgtgattcttgggtctctgactgggtatatgggcaggttctcaggcccctgggcagctggtataatgtgggggatggcagttagagtggtggagcaacccgctgggacccaagcaagcagtctgtgttgttgttgttgttgttgttgttgttagctgtgatgggtcggagggggctagtccctagttttacagccaccgatagcagggcagtgggtattttcctaagtgtgcttagagaagcttggtctctgctgttcctctcccagctgggtggcagttgcagccgtgtcgcccaagggcaagcgcatagcccagctttaaactctcaaaatggtgccagctgttggcctgtgactgagagggtaggttccctctcaaatgaacagcatgggcaagaaactgtggggagttacagtacactcaagtctcagtctcaaaaaagcctgttgtcttaggtatgcataggagagcctggttttcctgtccctcctcagccaagtggcagctgcagccacgtcagcccgaaagggcaaggcgcaacctagcattaacctctcaaaatagcactttatgcctgggaccagagcggggagggtccctcttaggccagcagcatggggaagaagctgtggggaatgtggtccactcacatcttggtctcaccggcagcccatggcagggtgatagggaccctcccaggagtgcatgagagtgcctagcctcccctcttcctcctcagagcagtggagtgacagcagctgcatcttcagatccctggtatcaaggctgtcaaaatggcacccagctgaagccgcttagactcagatgcctgtgggattctctgtgggttccctgtttggagcaacatctgtccaatctttaggcagttctgcatgtcaggcccgaggccctagttggttcagggtttctcccataaccaagatcataaaacccattttcagaatgtgggatgctggggatttctctcttactgtatgcccatgccagcttcctcagaccctttccttctggtgcttcctatcacttctctggtgaatcttagcattccttcctggacaatctgttcaaaatgtgggtatcttctgactgttctggttcctttctgtggatgaggcacatactacctgtgtctagtcagccattttaaatgtaagtcaagtcatatattcgctaaacgttgcagtggctcccttcagaatgaataccaaagtccttaccatggcccacacaccaccaagcaaagagagcttactcttccttctgcttggaatcctcttcacgtacaactccttcaatttctttaagttcttacccagatgtcacttatcagggagctcttcccctgaacacctaatgtaattagcaaaccgccactctccaaacacttatacctttatcatattcactcaggtatttgctcactcttcctttctccctgtaactttttttttctccacaacacttaacacaatctaatattatatgtttatttgcttaataagcctctcactagaatgtacatcatatcacaacaaagtttttctggtttaccactgtatctatatttagtacttagaacagtgcctggtacagagtaggtactcaataaatattttagcaagtaaattgtggagaaacgtattgactctgtaacaagtatcacaccgtacaaacatcaaatgcttgccaatttcctgcccacaccatgtttcaggctctggtgcctttatgtttggaacaccttcatgtgtgttttcttacctatgtggcacactttattccggtggagtcttctgttacttacatcacaacagaattaatctctcttcaacttttataacaagcctactctgttaattcattcacaccctgtgataacccattaatccattcatgaaggcagaccccctcatgacccagtcacctcttaaaggctaaaaggtctcacctcttagtactgttaacattggacattaagtttcaatattagtttcaaaggggacaaacattcaaaccatagcagtgtctctgcatttaaaatgactgcgttcttggctcgcccctgtaatcccagcactttgggaggccgaggcaggcggatcacgaggtcaggagatcaagaccatcctagctaacacagtgaaaccccgtctctactaaaaatacaaaaaaaaaatattagccaggcgttgtggcaggcacctgtagtcccagctacttgggaggcagaggcaggagaatgacgtgaacccaggaggcagagcttgcagtgagccaagatcgcaccactgcactccagcctgggtgacagagcgagactccatctcaaaaaaaaaaaaaaagactacgttcttttcagccattcactcattcagcaaacatgctggcacatactctgatgtaggcattaggacacagcggtgaacaatacatgtgtgttgcaccccattgaattcagattggatctcacttcttgatctcttcagcacatcagcatctggcattcagtaatggaattttacataatttttaacgagctgtattattaaacatacagtcaacttttgaacaacataggtttgaactacacaagtccacttatgcacagatttttttaaccaaacaaggatcgaaaacaatattcaagggatgtgaaatgcacatatatgaagggctggctttttgtatatttgagttctgggccaactgtgaaacttgagtatgcacagattttatactcgggggattctgaaactaatccctgaagtacactgatggaccactgtactaagctttttattcttttttctttttttgcttatcaatcatgcgtgtacacagtgggggagacagttatataagcttttatttaaaaatctgcctacttctttcaccagtttttcactccccttaacagtatttacctttatatcactaataaataacaggttatattaatccaattttgttttcagtgttacatattatttttttcctcccggaaaatggggcttatctagcaccacagcacgaattcctcatttccccaatgtaatctaatttttggctacatgatcataccatgtttatatcattgagactctaaggctatcctcagctgaactgagcatatattatggttccttttcctttctacataacatgtttcacttgcttagttttctttgtactgttgatcacttaattcaatcccatacttttacccagtgttgtaaatacactttaatatgtacagatacattgagtgttctttctactattatctttctaaagcgctgtgtcctagaacctggagtcttctaatctgtattgatctgattgggttgccctataggtctgctacattacgtcatttgggatttcccttcaccatcatcctggagatttattgttttctctatatatatgtcccctgttttccgtgtctcctatctttcttggtttatgtcatcttttttgtagagtacatgcaacaagcaatagtttcctgagaaagggtatgagattgggtgggggaagggtgggatttgcacatctgatagtctttattctgctttcactctcagttggctttgtagagaattctaggttagaaaacattttctttcagaatgtcgttgctccattgttttatagtttccagttttgatggtactaaagaccgatgccattctgattcttgatctttatatgaaacttttcccccagtggaagtctgtaagataatttcatagtgatatgcctcactcagcctgttttcacctcttatactaaaaatttgatgtgcactttcaacattgaaactctgattctttggttttgcatcttaattttttttttttaggtgacaaagtgtcacagttaaaaagaatgatctttcagaaagccatatttatgaatgaaaagaaaatgtctagtatgtacttcaaaatctggtgtaggtgtggtggcagggttgggatacagttgaaaatagactggcaatgagtggtaattgctaggtgacactagtataataaatggcatggggttcatgattctttctacttttgtatatatttgaaattttccatgataaaaaataaatgaataatgaaggacaaaaagaagcttagtatgagtcatatacaggaaacaaaattcaaatattcaaatgtgataggaaagtgtggaagacaattctctaatcctattgaaatttaaaaacagggaacagtatttgtgaaaagaggaaattactcagagaaaacttcaggtagaaaactagtatacaccagggcttcaaagggtactagatgaaatttgaccaaaagagcaaaaaatactctaggtagaacatcaacatcccaataaaggcacagaaagatacttattaaagacaagtatagtaaattgcaaggttaaagagtttggattccttggtgtggtagctcacgcctgtaatcccagcactttgggaggccaaggtgggtggatcacttgagcccaggagtttgagtccagcatgggtaacatagcgagaccccatctttactaaaacaatttttaaaaagaaaaaagctgttgttgtttcctagacctgtgtatattaagtttaggctcatttgtttgtaaaaataatttggagtagctgtgtgtaaggcaaaggattgttggagctaataacataaaaatgctgtttaagaaataagcaaagtgagaactttggtttgggaaaaacttcagagagtttattttcatctccattattaagcagtattgacttgttactttttagaatgaagtttaaaatattgtttccttcattttctcagcacaaacatttcactgaagatattcaaacaaggcaatatcgttccttggaagttctaatcggatctggctataatacccctgctgacatttggagcacggcatgcatggtaatgttttttccccttggctttcacttgttaagtggtacatatcttgccctgtttgctaatttcagtaaaccagcaaattaactagcagaaaagaacgtaacacagatgatttaccataggtattctaaattctatgtctagagaggtccgaattcaaaaacctgtctggcatttcatttggttactgctaagttcctgttaggtgaaggaaccaaaagtttcttactacagattgttagtggggggaaataatgaaaacaactactaagaggtgttgttggttttgattaggagattacaagtatctttgcatttttagcactcatctattttcagaccaaagaaacccctggaaactgcttcattttgtacaattcagcagctcctcagatacctttgcagctcccaagatgtgaatcccaatcattcatagattcataaatggctattttgcctctggcaagcaactgttccagtggtcagatttagttgatgataaatgatttcctactaatatcctcatgttggaatgtgttacattgtttcttaaaatgtattatactccttaatatctttaatcaccacaatttctaatcgtgtttgtttacttgtttctcttctatgttgtaagccccatattgtcaggaatcatggctgttatgtataactgtctggattcattgcctgacacattttgggtgattgcttacaatgtaattctgatgctaactacccagagttatcacagacttcataggttaagagcatggttcctcacaagattgccctcacttcagacactaaccacaagcctcaggatccacaagccacctgcacttctaatcaactggctacaaattaagaggtttgcattaccccctcagaaagtgctaagcttgctatagttttattataaagaatacaaatcaggacacataggggaaagtctgagagcgtactaaatgtgaagcttctgtgtcctcaggactttcaccctcctggcacattgatgtgtgtcaccaccgagggatgctcacccaagcttcaagtattcagagttttattgagatgtaattaattaggtattgattgaatcattggccatgtgattgagctcagtcttcaagctttccctcccttccctggaggttgggaagttggaaagccccagtcttctgatcatgtggttggtctttcccgtatgtccaactttcatctaaaactatataggggctggccacggtggctcgtgcctgtaatcccagcactttgggaggccaaggcaagtggatcacttgaggtcaggagttcaagaccagcctgaccaacatgatgaaaccctgtctctactaaaaattagccagacgtggtggtgcatgcctataatcccagctacttgggaggctgaggcaggagaatcgcttgaacctgggaagcagaggttgcagtgagccaagatcgcaccattgcactccagcctaggcaacaagaatgaaacatcgaaaaaaccaactatatagggccccaacatgagtcactttgttaatataaacttagatatggtccaagggacccaccatggataaagacacctagcacttggaaattccaagggtttagagacttcctaccaggaaaaagggacatagatcaatttcttcattattcaacagggtttaataaatatttgtatactacctaatgaataaacagaaacatattatgctctcatttcaagtaacatttaatattcacaggcaactctgggaaaaacttgagaaagagggcagataacaattccaacctgttttaagtcatagatttcttgctgtctgcattcctgaaaaactttgtcttcaaagctaatagagatgatatcatgttgttaatgtggcatgaccttatagagcactttgttgtggcatattattgggtttttgtttgttttttttttctgagatggagtcttgctctgtcacccaagctggagtacagtggcgcaatcttggctcactgcaagctccgcctcccaggttcacgccattctcctgcctcagcttcccaagtatctgggactacaggtggccgccaccatgcctggctaatttttttgtatttttagtagagacggggtttcaccatgttagccaggatggtcttgatctcctgaccttgtgatccgcccacttctgcctcccaaagtgctgggattacaggtgtgagccaccgcgctgggcccatatcattggtctgtaaagctggtgaactgtctgaagtaaggttttaatattgttgcacaaaatgagagaatattggaataaaatctcaggcttctttcttgccacactttaaagctttgcttattgaggaattttatttgagttgatttgctatagaaaatcataaatgatagagatgccaccaactataaagtgtagctggttaatagatggcatctgatttattaaaatgtggatttgctaagatgtagtttttagtagtggattagttgtttactgtaagaaaatgacattttttttttattccacatttctgttttgtttggggggcagtagatcctgcttgatatttaataaagtatttctaatgtcaggcttaagaagtaaggctgaaagataaaggcgtaattaatctcacctcatagttctggacccactcacatgtcagaattttcttgaccaaggaatggaagtacttacctgacatgagacaatatcatgaaaaattgagccccatttgatcctcaagtttttattttgccagtcgacatagaaaaacaaaatgttgctttaaatttgatcatagagcaaaaattctggaatatcggaagtgcctgaagagatggatcatcctgcatccaatgtaattaattgatggaaagattaggaccctctctgagaggtaatgagatggaacaagttgagattgcctctacattgatgattgaggaatagttagaagggcagttataaaaagggaaaagggggcccaggtgtagtggcttatacttgtaattccagcactttgggaggctgaggcaggcagattacttgaggccaggagttcgagactagcctagccaacatggagaaaccctgtctctactaaaaatacaaaaattagctggccatggtggcacatgcctgtaacctcagctactcaggaggctgagacacaagaattgtttgaacctgggaggcagaggctgcagtgagctgagatcacaccactgcaccccagcctgggcaacagagcaagactccatttcaaaaaaacaaaaaaaagggggaaaggggaaaatatttgtgaagaacacaacagtgagactctgtctcaaaaaaaaaaaaaacaatctccgaatgctggagtcaggacaggtaggaccataactggcaggatgagattatcttcttctctggcctttgaatgcccttcctcccactgtgggaaagtatgtttgtagtccccagttgtcttccttttctggtaaattcctcttctgaagtgattgctttctgggatatgttccttttcttcaccttttgctctctgaaattcagggcaggatttgtaggactcccactggcacttgtgagaggttctaggagtatagctacacatatttaggacatggggtgaagtgcatgtcttcataaaccccagaagttggccaattactaatcaagggaaagattagggaaaaaactagagaatattcagtcatcccttaatgtcctcaggggattggttctaagaccccctgcagataccaaaatccacaggtgctcaagtactttacataaaatggcatagtgtttgcatataacatatataaccatatggcctctgtgtacttaaattgtttctagattacttataatacctaatataaatgctatgtaaagttgttataccatatttttttaacttcttttttttgttgttgttgtttcattttgttttttagggatggggtcttgctctgttgcccaggctggagtgcagtggtgtgatcataactcaatataaccccaaactcctgggttcaagggatcctcccacctcagtgccctgccccttccccccgccaacgagtatatgggcacatgcctaggactataggcatgtgccacccactcggctcatttttaaatttttttgtagagaccaggtcttgctatgttgcacagactggtctcaaactcctagcttcaaacgatcatcctacctcagcctcccaaagcactggaattacaggcatgagtcactgtgcctgtcctttacttgtatttttattgtgctgttgttgttgctgtttctgaatattttcaatctacagtcagttgaatctgagcatgtggaacctgcagacacccagggctgactaacttaattcttggtcaggtgtttcagtaagggagtgaatctttcagaaatgggatccaaaggggtttatccataactgtcttgtctgtctagaactcttaaggctactaaaatccttaaactatcaaaatccaaagtgtagtaatttgacccaagagctctttctccatcatcaccaattcccaatctgagctgcccgaatgaaacggcagaaatgtctgcaggtggttataacttctagcactatgcacaatagctctttagatttcaccaaagattgtcacctttattcaacagcagtaagtcactggaggctggattttgaatgccattttagtaagtaatattttgagttctttttgtacaatttccttatcctatacaatgaaagctataggtttgcttttgtttacttgtttttgctgccagtgttccgctaaacagaggtaatacaaacaccaaaaaaacagagtataatctcatctctttcacagttctgtaataaaatcactaggacctgtgtctttacagtagatccctgcagttggtatgtgcagaatcccaggcattgctctcagtgaaggtaaaggagagctgggtatttgctgtattcaagagatgggagtgattaaatgcacagctccccaagtcagacattctaaacagggaaagaagcaggaggaattgagagaggcaagcatttgttccccaggaatgatggagttatagttaattaactgtaggaccttcattgtaaccccattgaatagcacacaattgagaggaaggctttcagctttcaccagccagggtgccctagatcgctggggcaagatagtctcattcatagcttgtacatgtcagttcatataactgtatgttggcatatttattttaggcatgctttgattaccgaagaaaaactaaagctttaagtctatagcagtgccttgcccttattgtttactttttgcttataccaattaatgagaacttaaatagataggcccttcctcttaattgaaaaaggactcagcccttggccctcctctcttcctgggggatttcatcaagtcccatgatgtctctagcctcagttcatctctatacttaatccaactttttatgtccaactgtctgcttgacgactccatttggatatctgataaatatctcaaatgtaacattttcaaaatagaatgcttgtttcaccctacacatcctgtttttgtaaattatccccctgttcacccagccattcagactaaaagcttagaacctgaaccttttaggttaattcttaattctttttcctttgtctacacctagtccatcagctgtttctatgtgttctaccttcagaatatatccaataccggctgggcacaatagctcatgcctgtaatctcagcactttgggaggctgaggtgggtggatcacctgatatctggagttcaagaccaggctggccaacctggtgaaaccctgtctctaccaaaaatacaaaagttagctggggtggtggcgtgcaactgaaatcccagctactcaggaggctgaggcacgagaatcgctagaacccaggaggcagagattgcagtgagccaagactgcaccacagcctgggtgacagagtgagaccctgtctcaaaaaaaaaagaaaaaaaaaatccaataccaaccactttttactttttccattaactcattatagcccatgccatcatcatttcgcaaatggatcaatacagtgacctcctaatttcctttctctgcttctgtttttctcccttcatgttacattatcacatagtggcctgagtggtcttaagtgttaatcaaatcatattacttccccgttttaaatcctttaattgcatctattccactcaaaatcctattttctttccctagtcttgtgaagctcatacttaccttggacctttggatgtgctttctccttcacctaatgcaggtctttgttcaacataatctctttagagatgtcttcctgactactttatttgaaataacccccactttatcacttttctttgtcacatagaacttgtcactccctgagatacatggggttttttttgttgttgtttgctttctatatgaggcagagaaattgtctatgattcttaaataggaaagggatatgtgcagtagacatatgcattttggaaaagttcttcggcaattcttacgtacatctttgatatagaaccatttatttgctttgattaatataatttacagctgtgttaagactggaaaaactctacttttaaagctggaagtgagtggtagaatgtatttagtaacaacaaaaaagctaataactgaactctggagtttcccaaccttcctttttgatctgtggctattgtaaccctcttttggcctttctggtgctgaaacattgcttccttgctgttaagacatctttcgtttgcttcattcccctgctgttggttgtttgcagagcactaaacaccaggactggttacttaattatgttacttctccatatctaagacgagcagtaagtagacttctaaacaaaatttgaacaaaacttggcatatctggtttgaaatgagtttcaaagccaccttcaacttagtatcttcatgatttgagcaattaaatatgattagtaacagaaatgaggtacgaatgtactcgtcagatgtttctagaaacatcgttatagttaaaactaaatttcctttttcccttttttttcttttttaactctttaatcatctcccgattatcttcaccccccagtctctgtaaccaccattctgctctctgcttctatgagttaaattgttttagatttcacatataagtgagagtgttgcagtatttgtctttctgtccctggcttatttcacttcatattgttttccagttccatccatgtcactgcaaatgactgaatttccatcttgtttttaaggctgaatagtattccattccattgtgtatacaagttgaatatccctaatctgaaacacttggtaccagtttcagtttggggaattttttagattttgcaatatttgcagaatacatactggctgaacatttcaaatccaaaaatctaaactttgaaatgctccaaatgagcatttcctttgcgtgtcatgtcagttttggattttggagcaacctgtatataccacattttattgtctgtttatctgatctgtatagactcaacttagattgattttaaaatcaacttaggttgattccataacttggctattgtgaatagtgctgcagtgaacatgggaatgcagacatcacttagacaaactgattttaaatctttgaggtaaatatccagaagtgggattgctggatcatatggtaactctatttttagatttttaaagaacctccatatagttttacatgagggttgtactaatttacattcccaccaacagcattcaagacttccctttgctccacatcctcaccaacactaaatatttcgtctttgtgataacagccattctgacagatatgaaatgatatctcattttggttttaatttgcatttccctaatgattagtgatgttgagctttttttttaatagatctgttggccatttgtgtgtcttcttttcagaaatgtttatttaggtcctttgcctgttttttaattgggtttgtttgtttgttttcttgctattgagttgagttccatattattttggatattaacccctatcaaatgtatagcatgcaaatattttttcccaacccataggttatctcttcacactattgtttcctttgctgtacagaagttttttagtttgatgttatcccatttgtctgtattcacttttgctccctgggcttttggggtcaaatccaaaaaaatcattgctcagaccaatgtcatgtgggtttccccctgtttcttctggtagtttttcagtttcaggtcttattaagtctttcatccatttcgatttttgtattcggagtgagatgagggtggtccagtttcattctttttatatccagtttttccaacaccatttattgaagagactatccttttcccattctgtattcttggcaattttgtcaaagatcacttgaccatacatgcgtgggttcatttctgggctctctatattgttcctttggtctatgcgtctgctttttttgccaggaccatgctgttttaattactgtagctttgtagtatagtttgaaatcaggtggtttgatgcctccagctttgttcttgttttgagacagagtctcatactgtcactcaggctggagtgcagtggcgcaatcacagctctcttcagcctccgcttcctgggctgaagtgatcctcccatctcagcctcccaaatagctgggactacaggtgtgccccaccacatccaactatttttgtattttttgtagaggtggggtctccctgtgttgcccaggctggtctcaaaactcctgagctccagtgatctgcccacttcagcctcccaaagtgctgggattacaggcgtgagccaccatgcccagcccagctttcttctttgtgctcatgattgccttggctatttgggatgttttgtgattccatgtgaattttaggatgttttttctatttctatgaaaaataatattggaattgtgataggaattgcattgaatctgatagatcactttgagtagtacggacattttaacaatagtaaggccgggcacagtggctcatacctgtagtcccagcattttgggaggccaaggcagatggattgtgtgagaccagcctgggcaacatggcaaaatcccatctctacaaataatttaaaaattagccaagtgtggtggtgcatgctacttgggaggctgaggtgggagaatcacctgaggctgggaggcagaggttacagtaagccgagattacaccactacagtccagcctggatcacagagcaagaccctctctcaaaaaaaaaaataaaataaaaataaatcttccaaaccatgaacataagatatattttcatttatttgtgtcttcaatttcttttatcagcattttatagttttcagtgtacaggtcttttacctccatggttaaatatgtttctaagtattttttttttgtagctattgtaaatgggattgttctcttggtttatttttcagatagttgttagtttacagaaatgctgctgatttttgtgtgttgattttgtatcctgcaactttactgtatttgtttattagtcctaacgggtttttgctggagtctttagggttttctatatataggatcatgtcaggccaggcttggtggcttatgcctgtaatcccagcactttggaaagctgaggcaggaggatcactggagctcaggagttgagaccagcctggataacatagcgagaccccatttctaccaaaagaaatgaaaaaattagccagatgtggtggcacatacctgtagtttcagctacttgggaggctgaggaaggaggatcacttgagccccggagttgaggctaccgcaagccatgattgtgccactgcactccatcctggatgacagagcaagactccatcttgccaaaaaaaagttatgttatcagctaactgacatttgtacttctttcttttctgtttggctgccttttaattgctctagtaaggactgccaatactacaatactatgttgaatagaagtggggagagtcttgttctggattttagaggaaaagctttcaatttttcaccattgagtacaatgttagctgtggccttcttaaatatggcctttattgtgttgaggtacattccttctatacctaattgtgtgagcatttttatcatgaaaggatgctgaattttgtcacatgcattttctccatctaataagatgatcatatggtttttgtctttttttggcagtagcaggggcagtttgagacagattgctgttacttcttcgttatatgtttggtagaattcagcagtgaagccatcaggtcctgggcttttctttgatgggagacttcttattacagatctaatctcttgtttctatttcttcatggttcaatctttgtaggttatattgtcaaggaatttttccatttttttctgggttatccaatctgttgccatatgattgtgcatagtagtctcttatcctttgtagttctgtggtattcattataatgtctcctctttcatttcttcatttctgatttttttagtcttttttttttttttggagacacagtctcactctgtcatgcaggacgcaggttggagtgcagtagtacaatctcggctcaccctcctgagtagctgggaccacaggcatgtgccaccatgcctagctaatttttttgtatttttggtagagacgggattcaccatgttgcccaggctggtctcgaactcctgagcatgagtgatccacctgcctcagcctcccaaagtgctgggattacaggcatgagccactgcgcctggcctatattcaaatttttatacaacatatctttagattttttttttttcttaagagatgggatctcactgtatttcccaggctggtcttgaactcctgggctcaagcaatcctcccgtcttggcctcccaaagtgctgggactacaggtgtaagccaccctacctggcctctttagaaattttttatctttctaaactgaaactctatataccattgaagaaaaactccgtgtttcccttttcccctattctttggcaaccttttaaatttaaaacagactttattgttccagcctccagccctgctctggaattttacttccctttggtatggattgttgaagacaggaaatttgaatcatctgttaattccttttttctaaaataacatttccagcacttcagcctttcttaatgtggtcaaacctggggtcaagataagggcccttaagttaatacattgagcacacctgcatctctgcagaaggccaagcatcaggactctgacttgtcttcctcactttgagacagccattggccagcccattgatacagatgatggacatgttactttatagaaacagctcttacctgaaactcctcattttctgtttggtaatcactccttggcattctgaccacacacaaccatattgcttatgaaatgctagattgcccctcaagctgtgtcagtattcctttctgctacctggagtttgcaatttacttctggatctgaatgtaattagtctgtttaaattgtcattgttttaacttttccatgcatttcatgctatcttctaagccattcttctcaaaggcaatagtctagagaaggttaacaaaggatggtacactggttttatttgggtttgtttcttaatagactttattttttagagcagttttaggttcacagaaaaattgaacaaaaagtacaaataagttttatatgctccccacacacagagcctccccaactgtcgatctgctgctccagagtgatacatttgttacaaacaatgaacctacattggcacatcattattaaccaaagtcagtagtttacatttcatttcactcttttagaagttttgacaaatgtatctatcattattatatacaatatcgtttcactgctctaaaactcctctgtgctctgcctattcatccctcccgtcccccactcgctggcaaccactgatatttttattgtctccataatgtcaaatagttggaatcatacagtatgtagcctttttagattaggttctttcacttagtaatatgcatttaaggttcctccatatcttcacggcttaatagctcatttctttttagcactgaagagtatttcattttctagcctcctgaatagctgggaccacaggcgtatagcactgccgcggctggctctgtgttttttgttttttgttttttttaactttaatttcagtatttttactgaactctatatatgagaccatgagatttttttttaaagtactggtatcaggaatgattgacaagttttggtgaacaagaatcatgatttgtttctctgttgctttgggactataaacctcggaacaactcagggtagaacaagtatctgctctatcactgtggttcagtttcttaataaacaactgaaatgtaaaataagcaatgccaagcaagaagccatagcactgctgacatttagagatagtatttgattcctaaacctatcctgaaacttctggttttgtggtctccctctggacggtagtacagttttgagaaaggctgttctgtcatgaaactgcagaaactgacactggtgagccaccaggacctaaacttgggtctaaattgagaatatgccccaactaagtcctggactctacagttcttgaggttgtttggactgcttagtaccattgatttaatcaaaattgacctatgactagcgcttattttataactgtgcttccctatcaataaggtcattttttaaaactgctgttggccaggcgtggtggctcacacctgtgatcccagcactttgggaggccgaggcaggcggatcacgaggtcaggagatcgagaccatcctggctaacatggtgaaaccctgtcctactaaaaatacaaaaaattagccgggcttggtggcgggcacctgtagtcccacctactggggaggctgaggcaggagaatgacatgaacctgggaggcggagcttgcagtgagccgagattgtgccactgcactccagcctgggcgacagagcgagactccatccaaaaaaaaaaaaaaaaaactgctgttgtgtactaatttttaaaactccatttgtaatcagtgaggatttatgtagccctgcttttcattctgcatggcacttattcccaaggatatcatttcctaagacactctcgagcactgtaagaggtttttctattaaaggagacaggcttttcttttcctaattagggagtgctgacttgccagtcacataggctaggctcctgactccctttacacttaatcttctgattttctaaagacctacgaattggccaggcatggtggctcacgcctgtaatcccagcactttgggaggcagaggcgggtggatcatgaggtcaagagattgagaccatcctggccaacatggtaaaaccccatctctactaaaaatacaaaaattagctgggcgtggtggcatgcacctgtagtcccagctactccggaggctgaggcaggagaatcacttgaacccaggaggcagaagttgcagtgagctgagatcatgccagtgcactccagtctggccggcagagcaagattccatctcaaaaacaaaggacctaggaatcaggaacttcccatctgggacaatctagggagtacttcctatgcaaaagttaatgatgtacttgtcaaacactaaagagtcataagtagaagtctgaatttttttttttttttgattttttttgtttggtacagaatctcaatttctagccatgtgtgattataatgtaagaaagacctgggctgggcgtggtggctcacacctgtaatcccagcactttgggaggccaaggttggcagatcacgaggtcaggagattgagaacatcctggctaacgcagtgaaaccccatctctactaaaaatacaaaaaattagctgggcgtggtggtgggcacctgtagtcccagctactcgggaggctgaggcaggagaatggtgtgaacccaggaggcggagcttgcagtgagccgagaccgtgccactgcactccagcctaagcaacagagtgagactccgtctcaaaaaaaaaaaaaaaagacctgttcttctcatgaataataacttagaatcaccttaatatccaggtatgcccctttccggccaaaaaagggaaactcaggagggctgaattgctagggtttagggtggggaggtttgggcatgaaataacccacatgttagtatttactgagtctttgctgttttctccattttattaagatagggatgtggaaggaatgctttaggaataatcttaagtttttgttttttttttttttttaatgatctataagttttcccaagggaacaagagttacttcatattgagccaaatagcaatcagctttccaaaggccttcttttcttttgtgctttcatatactgtcctcttttttttttaggcctttgaactggccacaggtgactatttgtttgaacctcattcaggggaagagtacactcgagatgaaggtgagtccccttaaccatggatgtgtgtgcgtggtatttacactttccacattaagctaacatcatttgttagtaccgaagagccttagtcttgttagtgtgcaaaacatgtaaatcccagaaaagttagaaatataaaagacattttatattaggtttttagatattttctgaaagatactaaagagctctgtcagagtcaaaaggccacagttcacctaaaacttctgtgtgctggacaattttttcttcaacatctagttatcttcctttctgtatatatcagtggttcattctttacccagttttttacctgctcatcaacctgttgctcaattatgcctccaaatttatttagaggtcagttattttaatatacacacactacttgaatgcagagactatatcctatttctataaattctgccaaaatttagcattcttttttcccttttctgaatataaaactaattttttcttttttggaattccattttaaaacaaagtagaatggatttacatgttgtggtagccagtgggaaaagcctaggctgccagttactttgtctgagagactgtggaagcagcaactgtgtgtgtctgatttttctattatgatggcatccagataactaaatgagttaataatttgaatgaacaaacaaaatggttttgtgattttttttttttttttttttttttttgagacggagtctcactctgtcgccaggctggagtgcggtggtgcgatctcggctcactacaacctccacttccctcgttcaagcgattctcctgcctcggcctctcgagtagctgggactacgggcttgtgccaccatgcccagctaatttttgtatttttagtagagacggggtttcaccatgttggccaggatggtctctgtctcttgacctcgtggtccacccacttcagcctcccaaagtgctgggattacaggcgtgagccatcacgctcagccaagaaaatgttttatacagttgaggcagcttatgttttagttgtaggattaatgaggattattttgagatatcactacagcatctaccctcccaatgtagagcatgttctttactttttgtgctttccttgaatctttgggaatgcatatttcatgctgtatggaaccaagagtgctctttgtttctcaaaatgtggtcttctgggatattaataggtaatgttagtaggacctgctaatattcctaatgaataccatttggaaaatgctatgctatgtaattcccatgaatgcctatttaagtgggtagagtttggacatattttgtatatataagccccatgttagaggatactataattactacttgattttacctactctctgcttgctatttttctgggttataggtttagggttataggcttacagtgtttgggattataggcctagagactacctactatgtttgtttgggagggtaattaatttttttcccctttacttccctagattctccataaatggtagtgtgtggtacagaacacatatagtggctagaattatatcgggtgttaccttatgctaccaaacctgaaaattttaatacatatgcagagtcccaaataaggggacaaggaaaaaccatcttccctagatgtttaaattctaatttattccatcctataccagttagtactaatagtccttaggtcaaacatcagccccaccgatgctgttctgctgcagtttgacctataagagcaggaacaagcaaacccttacccctgactagtgtgtgcatagtttgttacgagtcgtggtaggacagaagcctgagtaccatgtcctctactctggctttccacagccctaactcatgggataatacctgataattttatctgtcaagtatatcaatcctatcataagccaaaataggttgcaagaattaagtgtaaagtaacaatttcaagggaattccttggtataggaaaaatatttaaaggaccaatattttacttggaagtttacttaagtttctaagaactttaagaagctctcttagaaattatagtctaagtttttccttagtattcttatttttgttattgttaatggtaaaaacacatttgcaggtcctgccaaaaaccagcagaaaattcttggcatgcaggtacttgttaccaaaccataaattcagtcaaaactgctcaaaggttgtagggaagtcataaatgtgaagtcccctttaaatgacaccactaactcctttacatgagaaagataaaacctgaaaccttcacaaattcccagataatatggacgtctctagcatgttatttcccctataagatacataactggaagtttaaaccttaatgattctgtaactacacgataaaagtattttctaaagctttttttctggccaggagtattatgcccgggtgtggtggttcacgcctgtaatcccagcacttcaggaggctgaggtgggtggatcgcttgagcccaggagtttgagaccagcctgggcaacatggcaaaaccccatctctacaaaaaatacaggccaggcacagtggctcacacctgtaatcccagcattttgggaggccaaggcggcagatcacttgaagtcaggagttcgagaccagcctggccaacatgtgaaaccctgtctctactacagatacaaaaattagctggacctggtggtatgcacctgtaatcccagctactcaggaggctgagacacaagaatcactggaacccaggaagtggaggttgcagtgagccgagatcatgccattgcactccagcctggcgacagagcaagactccatctcaaaaaaaaaaaaaagttttatattcttaatttctgtcacctgcagagagaaaaaaaaaagggggggggcagtagatctacctgaggtgtgtgtactggttggtcccagactcacctcctggttaagaggctgcatgcctccctggttgtgctcatggtccatattcatactgtgatgtttacagatcatcaagcagctatactttaaaatgtttgtgctaatctttacttttaaaaagtgattttaggaagaaattaaaagctttagacaagacataagatcattggttttcatctgagttttagctcatattagccctgaagtttcaagttaggccattcatgctttttgaagttctattttctcatctttaaaatggggtatcagccaggtggtggctcaggcctgtaatcccaacacttcgggaggccaaggcaggaggattgcttgagcccaggagtttgagaccagcttggcagtatgccaagacctcatctctacaaaaaatgttttaagtcagccaggtgtggtggcacatgcctgaaatcccagccactggggaggctgagacagaatgatcacaaataatagttctagaatgcctaacacatatttggacagttttttatcttacctaaagaacctacctgaacctagatatatagacaaaatagaactaaagatgaagataagcctccaaaatccagaatgggacttgccagacactatcgggtgaccaaccacctgaaataattcttggccttcccagtcagtcttccttcagtatccttggttttatttgtagttacttttaaacagctagtccttgaaaaagctattcatagaaaaacctcttttacagcttgtccttgatctgttcttcttacccttctattttagaccacattgtgcacattatagagctgataggcagaattccaagacgcttttccctcagtgggaaatattcacaagacttcttcagtcacagaggtagtattgttatgtaggacccagggatacttcaggaagcagagcattcacaccaagattgtttttagttatcactgaatccacaaaaatttgactttgtgaattctccattagatggatagagtcttcctcttcccatttaggatagaaagtaagcctgataggctttacaaagagatgtgcatgctgctccttctgctgttttctagagctgcatttgttactcttgttacggatcttttttttcccccctcttgaaatgtttgaaatatacagatcacattgcattgatcatagaacttctggggaaggtgcctcgcaagctcattgtggcaggaaaatattccaaggaatttttcaccaaaaaaggtaaagtaaatgtgttcccagacattaaggaggcagaagtgtttaaaaatgaagaggtaagcacatattcccaatgtcctacagaatgatgggcctgccttgaatgctaacctgtgacttagcaaagagataaaaaagaggtaaaaaaagtggtcaagagcagagactgagccgggcgcggtggctcatacctgtgatcccagcactttgggagaccaaggtgggcgaatcacaatatcaggagtttgagaacagcctggccaacccggtgaaaccccgtctctactaaaaatacaaaaaattagctgggaagagtggcgggcgcctgtaatcccagctactcaggaggctgagacaggagaatcacttgaatctgggaggcggaggttgcagtgagccaagatcgcaccattgccctccagcctgggcaacaagagtgaaactctgtctcacaaaaaaaaaaaaaaagcagagactggagccaggcatggtggctcacgcctgtaatcccaacactttgggagtccaaggcaggaggatcacttgagtctaggagttcaagaccagcctgggcagcacaggaaaaccctgtctctacaaaaaaaaatttttaattaactgggcatggtggtacacacctgtggtcgcagctactccgaaagctggggtgggaggatcacttgagcctgggaggtcaaggctgcagtgagccatgattgccactgcactccagcatgggcaacagagcaagatcctgtctcggggaaaaaaaagagcagagactggagccagactgtcaaatcctggctactccactagccatgtgacctttgacaggatctaactgtgcctcagtttgctgatttcttaatggagataataataaagtatacttcttactaacagttaatatgtatagtgcctgcatgcagttggttgattacttctatagcacttctgaaaaatgggcaaattttttgctggcgtttggtctaagaactgcctctaccaaagggcaggtaatttaagcttcttacataagggcagggactacatctcactcatctttgcatcccagtgacacctaacacagtcactcgaagtacattagtcatacaaacgaacttcacactttttagttttatgtatttgttattacaaaaaaaaccacaaaaacaaaacttccaatttttgacttgataatatatttcttaagcattgcaaaaaaaacctgaaatgtgaaaacctgacctagaagcatctaggaaatggtctggtttttctacccccattgtgccatggttccctttttcctcacaacttctacagaagtgctgagaaaaatgacttttctcaatccttggcaggagccatcctcagaaacattaccctttcttaaacctctttttaggtgggaaaattgtaaaatgtttcataagagttcctcctcatgtgcagtcagattaaggcatgtgtgtttaccaggtaggtaatcaaataggcactcactgctcacaaaagagacttaaaatttttatgtttaaaaaaaattattattattattattattattattattattgagacagggtatcactctgtcacccaggctggagtacagtggcacgatcttggctcactgcaacctccacctcccaggttcaaatgatcctcctgcctcaacctcccaagtagctaggaccacaggcatgtgccaccatacacagctaatttttttgtatttttggtagaggcagggtttcactatgttgcccaggctggtcttgaactcctgagctcaagtgatccacccgactcagcctcccaaagtgctggaattacaggcatgagccactgtgcctggccaacttaaaattttaaagcagcatttgccttagctattaataattgactatcttttaaaaagttgtcacttcaaagaagcaattaggttgatactccagtatagtgtagagcagcggtccccaatctttttggcaccagggactggttttgtggaagacagtttttcaatggatgggggggttggggggtggtttggagataaaactgtgtcacctcagattgtcaggcattaggttcttttatggaacatgcaacctagatccctactgcagttcacagtaggattcacgctcctgtgagaatctaatgcagccactgagctgacaggaggtggagcttaggcagtaatgcttgctggcccaccactgacctgctgctgtgcagacctgacagaccgcagactggtaccatagggggtattggtatagagttggggacccctggtatagagtatatgaagctgttgtatctgaaaactgtgtaggatttggggttttttttgttgcttttatccatgcttgacatgatgttttaactttactgcctcactgtaaagcaacatttactaaactattgagcacatacacaaaaaaagagtataagcaaattattctcggtatgtggtactagagtgtctctgcacaccatataagaccatgttgaagacataggcatttcatgtttattttagtagtaaatacctacttcttgattgtcacacccagtttgactgggaccaaaaaaatcctagaataggggagaaaacaaattaccttaaatttttggagccgtatgaagaatagaggcacttctttctgaggcatatgtcagaaaagaaatgctttgtgaatgaaggattagattctgattgcaaaatttgattcctcatagactacatgggttagtttgtgggtttccacaagagtaccttgtcatttgtctgtgttgatcagtggctttttctgtactgtcttcactgcaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttcgttattttttaagattagccattctctgctgctatttccctacataatgtcaatttttaaccataattttgacatgattgagatgtacttgaggcttttttgttttaattgagaaaagactttgcaattttttttttaggatgagcctctcctagacttgacctagaatattacatattcctccagtaagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggaggaaaagattggttgagtatgcttttttaatttaaatatgcaatgaaagtgtacaaattgcacacttgccattttgtggggttcatagttttgcttctagttttaaattgggagtggggtagaattaacagccaaattaacatttttggaatactgtttttcagcattttttttttaattgtttttccctacatccaatagcactttcttccagaagatttgtcaggggtggttgtttttctcaaattataaatgcacggtacgtgcaaaattcagaagacttagaaatataagctcttattaaggcaatggcatgatgtattacacaggctttcatacacttatctcatttcttggatagattcttgaactgtctgggccagagagcacatttttgaggcttttaataaatattgccaccgggcgcggtggctcatgcctgtaatcccagcattttgggaggccaaggcaggtggatcacgaggtcaagagattgagaccatcctggccaatatggtgaaacactgtctctactaaaaatacaaaaattagccaggcatggcggcgtgcacctgtagtcccagctacttgggagactgaggcaggagaatcacttgaaccttggaggttgcagtgagccaagatcacgccactgcactcctgtctgggcaacagcaagactccgtctcaataaataaataaataaataaataaataaataaatattgcctaacttatctggacaactagcagaatggttggactgtttttctgtatacaccaatgtatgaacaggcctattatgaatcgctagtttgtgccctgccccctccccacaggaatatcgttataatttgcatattggattactggtgaggtcataaacttttcataggtatttgcattttttgattatttatgtaaattgtccagctttctgttggagtgcttccgtatttgatgacttggtcaggactcgttatatactagagataatttattttttgcttcatacacttgtctagtttttaatttacttttcatttttatttgtggtagtttttagtgttattcatctttccccacctacacctgaactacataaattgttctagttaatttgttttaattgtgcaatacttagaacacagtgttttcatagtgttaaaatgtaacctattggaatccatgaaaccagtttgttcaccagactgaccaacctaggcaggccctcctacaccttgtgttaaatatatggacctagaattcccagaattgggggaaaccttagtgctgttacaggagagcttgtagctatctcaaaagagccaacaaacaggtgggtttacaaccccctttaattctgaatttgctctgcgtgtccacagggaaactatttagctgctgcagagcagtcccagcttataagtggacttcgttactgcccattcttttcttttgaaacctgtactcttaccagtttagccttataaggaaactgctttgcccttagattattatatcacagaaaattggtgatttgctgataatcgaacttacatttgctttaaaataaggccttatggccgggtgcagtggctcacacctgtcatccccacactttgggaggccaaggcaggaggagcacttgagcctagggattcaagatcagcctgggcaacatagtgggaccctgtgtctataaaaaattttaaaattagccggatgtgttggctggcacctgtagtcccaactactcaggctgaggcaggaggattgcttgagcccaggatttcaaggctgcagtgtgctatgatcacgccactgcattctagcctgggcaacagcatgagactccatcactacaaaaaaaattttttttaataagaccttaaggcaccagagaagcttgaatagtcagtgcagtttgggagatagcaa

SEQ ID NO: 17164 - DNA, 6344 bp, Human
aactagggacagggctgatggttttcacagctcccttcatggagagaaatcactcctctgattcctttgccagtctccatcttgacttgtgagaagggaatagtgattcccttctctgtggctcacctcacagaggtcctgggggtggggagcaggtagagaaaagagaaggaaggatcagagtgaactcataggaaaaagtgctttcaaacattgagttctataaaagagaggggggatagtgttctttcatcaatggtatttctgcatcgctggaaccaaattggtttttctcattttgagagtctcctggttgttcctccagctatttctctacattccacaccccagggatgtaaaggtgagaggaagggggtcatattacatggctgggcacccaccatgtgccaggcacttccgaaggtgttccacgtgcattgtcttaatcatgacctcaggaagtaggaggcgttatccccctaagataaataaggaaagtgaggttcagggagcttcactttcaataatgtgtctgaggccacgtagctccagtaaatgctgaattttgaagccagcttggtctggatcaaagctgtgcttgaggctgggcacagtggctcacacctgtaatcccaacactttaggaggccgaggtgggaagattgcttgagcccacgagttttagacctgggaggcttagggggaagattgcttgatctcaggaggtggaggctgcagtgagccaagatggcacaactgcacttcggcctaggtgacagagtgagaccttgtctcaaaaaattaaattaaattaaattaaaagctgtgcttgaggcctgggcctctcagtggagctgtcttctacctcctgggatggagaggggaagggcaggggcctctggctgccatgactagtccttcaggaaaagctgctctgttcccatgcctgagcaaactcaggcagctgtgcccttcccagcttcctgaggcccctgctccatctgaggctcatgagacctcttcattctcagccaggactagcgactgctcacgcgcgcacgtggccttgggtagggggcagcgtgagtggaaaccttaactaaaggggtgagtatctgatgctggaattgcagatagtaagtgaggtagaaaggaaaggggagagaggcatttaggaagggcctcctaagggcccttgagtcaggcctgcaggcagcccctggtgtgagggcagggggagggtgccaaagtgaaagcacacacaccctggcctgctgggggttgcagaactgtcagccccagggatctgggcatggcctggaatcccccgaggagactgaaggaaggttgaggggtgggaggctgggatcctcgtccctggagtctgacactgctagacacctgggcttgggtgggccaaaggcaaggcctgactatagtgaggcagagaggccccaagtacacagaatgtaagcaggcactcacaccataggtgcctctcttgccttggattcgtccaggcactgcccaggagctcaagacacaagggcagccacccttacccactgcttatgtggcatatgggaatatacaatataaatatattcttataattgtatataataatgtttatatatatgtaacacataaaatgtgtattaattcaaccctcacaactctttaaattatccttagttgacagataagatgaaaggcagaatagttggaacagatagtaagtttgcctcactaataacttgtacacagtccatactcttaaccacgatgcaacacaattatcaccaacacacacacacacacacacacacacacacacacacacgaaaaaggccaccaggtactcacccagtttccttatcaggaaccgccccacagcagattggccacagctgtgcctctgcccacggccagccctgtgggatgcaggtggatctcgtgaggtcagggccccttttatagccccatcaccacagctggctctgtctcccgccacccacaccagctgtcccactcaccatggagaagatcctgatcctcctgcttgtcgccctctctgtggcctatgcagctcctggcccccgggggatcattatcaacctggtaagagggtcttcaggggaggcgcctcctgagtccccagatgaagacttcctaagcttggaccttgacctctgatgtctccacctggactggcaggggctgggaggagtggcatcttgcatccctctgtttacttccatgtcctgtcctatgcctcttcccagaggccacaggaaaggctgatcagcccctctccagctccaactggagcatgctcagagcagcagctcaacctggctatgagggaccttttttttcttttttttctttttgaaacggagtcttgctctgtcaccaggctggagtgtagtggcacaatctcggctcactgcaatctctgcttcccgggttcaaatgattctcctgcctcagcctcccaagaagctgggattacaggtgcctgccataacgctcagctattttttgtatttttagtagaaatagggtttcaccatgttgcccaggctagtctcaaactcctgacctcgtgatccgcccacctcggcctcccaaagtgctgggattacaggcatgagccacctcacctggccctacgagggagctttgtaaaaatccagagccctgggcttccatcctgagaaaatgctttgcgccaatcattccagcttctgacttatggagatgcctcggagatgtttactcattctgttctcataataaccactgagggaggtgttttcagagtcagccctgtcttcagacagagagagggtgagcaacctgcctgaggtcacatagctggaaagtggttcagctggggccccaccactgccccacaccacctctccaccatgggtcttggctgggaaagcccttccagaacgtccatgcggttgaaaggttctgaactctcttaacttggggccatggctggacttggaggtccaggacccttggagattatagatcagatctgttgggggaggaaggagtcttgcagggagatgcaatcttcaccgcctccttaaagaggtgtgggacccagagtggtttggagaacttgtctaggggccttgtgtgcacattccaaatgggaacactgaggcttgggaggcagtgacttgcccagagtcacacaggaggttggtagcacagccggtactagaacccaggggtcctgaccctctgtgcaagtctgcttctctgtcaccgcatgcccacttctcacgtgggtggggggcacagaggccaccagacccaggggatggactccttcacacacatccctaccaggggagacactgttagtggtagtgtgtggtgggtacaggtctgaatggagaagggacctgagggagtggggcctgggctgactggctgctcctggcaggagaacggtgagctctgcatgaatagtgcccagtgtaagagcaattgctgccagcattcaagtgcgctgggcctggcccgctgcacatccatggccagcgagaacagcgagtgctctgtcaaggtgggtgcctgaggacttggcgtgggtgggggagaatggggagtagggccctgaacacttgtgagtgggatcagggaggggggtcagcctggacactgaatgttgaggagacgagagggaggtcgacaggtgtcaaagcactttcccatcccatcatctctcttgaccctcccgagtgaccagtgagatgggtgggggtggggatttgttatccccatttcatggctgggtaaatagaggctccccagagagatcaagctagtaagagcaaatgagccagagcagaggtcagagctggggtctccagggcccacggcacccctggggaggcaggtgggagaggcactccccgaaaacacaggctggcctactggttctctaggtcaggcaggggacaagtgatgtccaaagtatctccccatagccttgactccattggctgtgtctctgcagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaacctttcccagtctcctgcatattctttctgactcagcatcttctctgaagttgcatcaggcctttggtccaccagggcaggcttcaggcaggtcagaagaacaagggatgggtctggggctgaagaagttgtggccaaacagattggagactgaagacaaagctgtgaaggagacccagccagcctaggaaaccctccatttctggggagaagtcacacctacctgggatgccctccttgtccctccggttctcaaagagacaagcgggcacatgtgcatgcgcgcgcacatcacacacacacacacacacacacacacacttgtgggtaaggagttttaatggcccatgttcgtcaccctgcatcagaggcatcagaatcctgggctctcacctcttttctggacacaattctcaaatatgacagctagctgacacaactcatgtgttaaggggtcagaccactctcaattgctatgagcttactctctgccagcaaatgctcacaaggatcccaggagggagaatttctcatctccactttatagatagagaccaagtttcagagaggagcttgcccaatgtcacataatcagaaaatgttggcactctaccatctaactccactgccctgcttctatgattcctttttttttttttttctgaaacagagtctctctctgttgcccagactggagtgcagcggagtgatctcttggctcactgcaacctccacctcccaggttcaagcgattctcctgccccagcctcccctagtagctgggattacaggcgcctaccaccacgcccggctaatttttgtgtttttagtagagacggggtttcatcgtgttggccaggctggtctcaaactcctgaccccaggtgatccaccacctcagcctcccaaagtgctgggattacaggtatgagccaccgtgcccggccttatgattcctttttctttcccaattattcgcattaagaaaaatgggtggaaactgcaaggaatttaattttgccttaatataaaaattgtatatcccctggagccatcaaacatgagttaccttaggcagtactgaggtgcccatcatccaggtacgcaggtggaagctcactgacccctcggtggagatgctagagaggagattcccacagagagtgagggacagtgaactgaatgaaacttcgatgtcgtcccagccccaggatcttgcagttctgtgatcaatgaatcctcctgtaaccacaggcttatgagttaggattgcattcaactgtgagtagcagaaaaacccaagtaattatggctgaagcaaataggaacgtatatttctcatgaatccaaagcaaagacacaggaagtgctggcattcttttggtggctggtagctcttgaccttctcttcaaggttgccacatgccttagcagcagctcatgacttcacgttctcaccgtattcgaaggcaggaagcatggagtagctggcagctgggaaggcgggagaaggagcagagagtttcttcttgcataccctttttttttttttttttgagacagagttttgctcttgttgcccaagccagagtgcagtggcacgatctcggctccctgcaacttctgcctcctgggttcatgcgattctcctgcttcagcctcccaagtagctgggactacaggcgcctgccaccacgcctggctgattttttgcatttttagtagagacagggtttcaccatgttggccaggctgatcttgaattccttacctcaggtgatccacctgcctcggcctcccaaagtgctgggattacaggcatgaaccatggcacctggaccataccctcttcttatctttcctcaaatcctcaaggccgacttctcttcatatctcagtggctagaactaggttatctgactacttctagctgcaagggacgctgggaaagcaaagggaataagatccttctcctggggccaggttcattgatgcccaaacaata

SEQ ID NO: 17165 - DNA, 33519 bp, Human
gtgagccgagattgtgccgttgcactccagcctgggcgataaagcgagattccatctcaaaaaaaaaaaagagccgggtgtggtggcacgtgcctgtagatctcaaaaaaaaaaaaaataaaaataaaaaaaaaaaaaattgagccaggtatggtggcacgtgcctgtagtcccagctacttgggtggctgaagcaggagaatggcttgtgaacctgggaggcagaggttacagtgagatggcaccattcaacagagtgagactgtatcccctcaccccccaaaaaagaaagaaaagtgatttagtaaatacagccaacaattctgtttcatttgcatttaagtatcttttaaagttgcctttcagatgaaatagcctatacaagcaagcatataaaaatgtacttagaactaggctttaaaatcattgtatcacagagaattaaaccagcatgttcaaaagtaatcaagcatattctgttacattgctctcagtacaaaatatgacattctactgatagaatgaaaaataatttttacatgattttaatcttatcctttcaggactctttttctataaatacatttgtaatttattaatacagtatcacatataacccaggaaaattataaaactggtatgtaacttataaatatttacatatatatatcgagtggttcatcagatttttttaaatggcgatatgtaattttattgtaaagttcaataatgatcatacctggaaaaaatctcacaaagatacgtagacccaaatggaggtaaattgatctagaccagtgtctctcaaaactttaaatcaccagcatgcttttttgatgattccatctaagatctattgaaaaaaatccttaggtgtgggaatagggctatggagtctgcattttgagcagatataacagcaaacattttatggtgtttattgtgttttaagtgctgttttaagcactttacattgactcattcttcacagcagccctatgaggtataggtacaggtgactaagaaatttgcccaaggtcacctagttagagtgtagggttagcattgtatgtagaaaacataccagagaattcttttgcatacttttgggaaccattactctaagtctaatctaagtcatttgaaattgggaaagctttattctataaaatagtaaagttgggtaggcggggagagggtgatgcatagtagtactttccaattctaaggattttaagtctttgtcagtcaacactgggtagctacttcatggattttaagttcagcaaagtgaagtccattttttagcaccatgttaaaggtatgtttttaacagaatcaaagtaatgataaggttttcagttttatagatatatagtaaaagtgataaaaccaaatgtgtgtagaatggagatttttatgttttaattgaattttggggttgtctttaggttcactgggaggagaaatcttgatttcaatacttgcttttgaaagtcttctaaagtatattagtataccttcctaccttgatttattgaacaagatgactcactgttttgaatattctcattgtccagtcttctgtaaacttacatgtcgaaccctagactcaccttgtaaattaaatcagaatgaaattattaatgaagttttatttcttgttttttcctttctcctagaacagtggtctcaacgtggctgcacatacaagtcaccagagaggcttttaaaagatgatatctgtgtcccatccctagggattctgatttaattggtctgattattcttacgcgctagggctgagaaaccactgttctgtaggatgtaggggaggaaatttcttgggcttttgttgttgctcccgtaaattaggataatactaaaaaaaatacttgaggtaggagttactagactatagagggaatattgtacatacattttctgtcaaatttaaacatttaacacctgcattttttatttcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaaggtatgtaaacttttttgtcattaaaataacatgttaattttgaaaagttacggtaggtaaagttaagctaacttaaaattttaaaacttttaatattttcacagaagctgtatattttgaagtactttaccagaaatgaaaccattgttttctttgccatccttgtttgtcccagccttctaatttgaaaattaagcttgataaatttgaggcatttgttgtcatttaagtacttcatagcttgttgctgtagcaaaagcatttacacagagtgactttttcttgacattggcagtaaccatcttatgcctgattatgaagcagcttgataaaatatgtatatagtagaattctgtactagatattactaaaagatcaagagccatgtgaaatattggaagatgtactagatgcctagcctgtataaaatttagtcctgagcctcctagcagtgaagacaaaaactgaaataaaaatatgggttgtatatttctcattgtcttctaaaagcagctcttatctggcaatacaatctaaaaaggatttacatgtggctctctaagtaatacatgacttggatagtatcttttgtagaagataaaattcttttcatatagatgtttttattatttctgattaaaaaccaaaggcttctataaaacataatcttgtgaaaaattcctgtggaacactaaagtttatttagatttgtaattttgtatgaatcattgcttgatacagtaatagaaaaaaagtccagagtaatagataattggcaatcctttgaatatctttaaaatactcagttgtttcaagtgggtttttgacagcatctatatataattcaattaaaatttgagttatctggccagtgtctggagtgtgtaagtatttgactgaaaagataccaaggtaaaactgacctttagttacatgaaataaataaagggtttgacttatttattctgtctagattagaaccactgtatctccctactccaaaatgtactgtggaaggtatgggcataaccagaaagtttttcagaaaggatctctgggtctctggaaatgcccagattttggttaaataccgatttctttttaatagaatggaaagaggcagttttaaaaacagaagatttaaaggccgttcttgtcagtggacagcctttttctgaaaggattttaatgatggtacctctagctcctctgatttttatttttaacacactgtatctttttacttctggatgagttaagtaaagaagtattgatggttgtcagtgatcaaatagtaagtgggtctaaaattatgtatttgtctttgaactctaaatgaagcaattctgacctgtagatttttgagacaagcataggcatatgtttgttgcctgactagctaatgaaaacagcattttccccaattataaaaaaaaggtatatacttactattggaaaaaaaatccagatgatgaagaaaatatagagaaacacccaaaattttgccatccaccctaagtcagctactttcattgttgtggtgtatattgttccagtcttttctgcctgcctgtgagtgtgtgtatttttataaaaccgagatgattatacttgttattctacagcctgccttttccaacaatatattgtagagagatctccatgcctataagtattgatctgtatcatttttcttggctgcgtagtattttattgaaagaatgaggttgtgagggaatagccaaaaaatctattaggtctgtaatttggactaaggaaagaagtttgtgttagtagattaactcacttatccattgaaaggatgctagtttttgagaattttgactcgacccttctgaatgaggtttaaatatttctggtggtatatcttcacttgctagcttttatcaatttagagtgattaaatgttcatgttgatggtgttaaaagattctagatggcatcctagaatctcagaaatgaggaatgataataacagacaagaagttggggcccatgattcattcaatgttaatggaagctgaccatcatagttccttctaatggagctgcattcaaattgaaatcagtttggaggtttgaattgaaacaaaacagacttaaaattatttttgaacctttgaaagttacttatggaaaccttcatttctgtttaacttcgtaattttgtctttccatttatttgtattgtaaaagcaagggttagcaataagatcaaatataattactttgaatttactcagaaaaattgtaagttaaaaattcatggaaagcacttagcgattgcacagtagttacctgctgtaagaggagaggaaacattaataagtagatgtttccctgataagagatttaaatgaagtcctagttttttctaacacctccatcacttgtcatactttcataatttataagcacttttatcttaactcattaaatcttgggaggttatcataatcataatcgtggtagtattagtaaattattgctttctgtaagccaaacactattctaaatactttacatattttaactcatgtaattttcacaaccatatgaggtagttaagatgacgaggtcaggagatcgagaccatcctggctaacgcagtgaaaccccgtctctattaaaaaatagaaaaaatcggccgggcgttgtggtgggcgcttgtagtcccagctactcaggaggctgaggcaggagaatgacttgaacccgggaggcagagcttgcagtgagccgagatcacgccactgcactccagtctgggtgacagagcgagactccgtctcaaaaaaaaaaaaaaaaaaaaaaaaaagataagcatttttcagggttgccagttaatattaatctgtaagtgttgtatgactgtggtcaggtattatcctatttaaattaggtatttaactcgaggggagaatgggagctaagaaagcaaccctcccattttatttgcaatgctggcatttatggtgtttactgccaactaatttcgggttgcttaaaatatgtaactgccacgtgcatagcttttcataacttgtaaatgatacatacttattaatcctcatagtaactttctgaggtgaacaaaataaaaagtttttttaatttgcaagtaaggaaatggaggttgtttgatattaaaagatatccataagtcatatacttggtgagtattgaggctgagactagttttctgactcaagtttagtatttttgttaacaatatttcccagaagggcctgataaaataaagaagagtgggtgtgggtgtgggtgtgggtgtgtgtgtgtgtgtgtgtgtgtgtaagtgtctgtctgtttcggttttcatggtctgagaaatttttccccaagggaaacattaagactaaattttttttgtaacaaatacagagatgtttgaagtaaagtgattccccttgatgtttctgctttccagtctcatctcacttagggaaccactgctcatggtttgctgtatatctttccaaatggttctctgtgattattgatagaaatgtataaacgtaaaataggattttttctttttttgtattttatagaaaaagatcatgctatgtttgttactttgtcacctgttttgtttttcttaaattataaaagtcggtattcttttaaattgttcttttaaaacattatttgattttccaaaatttcatttatataccatctaccagaagcctatttattttaaaacatgagatagtacctcatagttggataaaattgagggaaattatcattttccaaaggcaacatcattctatattaatttatataacatagaaaatgtaaccccctcaataattgtttagttctaaactcaggagaattgcttgaacctgggatgcagaggttgcagtgagctgagatcgcgccattgcactccagcctgggcgacagagtgagactccgtgtcaaaaaaacaaaaacaaacaaaaaactgtatcagattgttttctgtttaagtttagatgcccttatttatggcaggggcactggcgtctttgatctggtactatgattattaagagtgttaactgctgtgctgttgtaaaaagtaaaaagaacatgtaataatcaatttttatatgcagagctaatttctttagttatccaaactggatttagaaaaaaaaatgttttatttatggacttagtgaaaactttatactgattatacaaggatgttttgtctctaaaaaacaatggcacaaaggaaaggaccttttctgttgctgtataacagctactgaaacatattcatacttggtgtttaggggaaagccatctttacatagaaatagaagcaagccaggcaaggtggctaagaagcaacatcactgaaatcacacatgcctgagatgtaaatataaattatttcccttaaatgtctttggagaaccataaatttattggaactctctttcaattaattttccaaaagtatttatattttataacttacaaaaatcgaatggaaattagataaggaaatgttccacaatgctcatgttgttgttaccaaaaactcaaaagggttaaaagaaattagatttctaaaagtgtaaggtgttaattccgtttatgcataaaattgctttataaagtgtaattatgcttgattctttttttgttgttgtgttttagaaagggtgtctcactgtgttgcccgggctagtctcaaactcctggccttaaatgatcctcctgcctcagcctcccaaactgcggggattacaggcagccaccatgcccagctgtttgattcttgaatatccatggtgtactttaaaattatttttaattaaaaatttttgcttgaactgcccttatgacatttatacaagtatattcatataaccaaacacatacagtatttctaatataaaagttttggtgggtttcattaaggaatgaattaatttggccaatttggaaatggtttttccagataaccgggaatctaatgaaatactcaagttggttccttgttccaaagcacaacaatctgtgacaagttaatttattttgaagtcttctgaagacccaaccttcactgccttcaaactttactcccattgaattaggaggtgaaggcagaagttattcaaggccacctgtcttttgggctgtgtcatgtaggttctgaaaggcataagtctgaaccgagccatgcctgcctagattctagtcataataactgaaaagactagaaagggtgtggtcttggtttctttcacttgagttggcaaatttggcaaacactatcagacaaaatagcctaccacctccactgactttgttttttagagtgaacagaaaaagaaagtttgaaaaaaatcgttattccaagaacagtttcatctgctcctgctcttagaaactcagttaaagtaatatacctttagaaaaagtaatgagaacgtatttttaattgattgcacataatctcatggtactagagtagtatatatgatatgctttttttttttttgagagagagtcttgctctgttgcccaggctagagtgcagtggtgtcatcacggctcactgcaatctccacttcccaggcttaagcgatccttccaccttagcctcccgagtagctgggacctgggactacaggtgtgtgccactaagcccagttaatttttgtgttttttgaagagacaaggttttgccatgatgcccaggctggtctggaactcttgggctaaaatagtctgctcaccgaggcctcccgaagtgctgggattatagccatgagtcacagtgcctggctttatgctttttttttttttttttttggagacagtctcactctgttgcccaggctggagtacagtggtgcaatctcagctcactgcaacctccacctcccgggttcaagtgattctcctgcctcagcctcctgagtagctggtattacaggtgcgcgccaccacgcctggataatttttgtatatttgtgtagagatggggtttcaccatgttagtcaggctggtcttgaacccctcaccttgtgatctgccctcctcagcctcccaaagtgctgggattacaggcgtgagccaccgtgcccagtgtatgcttcctttttaacataggtaatttgtgatggtgtggttaaaagggagaaataaaatatgtccttaaattagctattttagccactttataaagattctgaaactacttgcgactatatagcaatctgatgtcttttcttttaaaagttatcacatgactacagttggatctcagttgtccagttacagtcccccctgttactgtgccctctgaatagtttcttgtattaatagttgtggggctgggcgcggtggctcatgcctataatcccagcactttgggaggctgaggtgggtggatcacctgaggtcagaagttcaagaccagcctggtcaacatggtgaaaccccatctctactaaatataaaaaaattagccgggcctggtggccgtcacctgtaatgccagctactcaggaggctgaggcaggagaattgcttgaacctgggaggcggaggttgcagtgagccaagattgcgccattgtgctccagcctgggcaacaagagcgaaactttgtctcaaatagtaataataataattgtttagtttagtattttgggtattctgccgaataacaattttcagctatgttaaattcatggagtcgtagcattgctctgaggcagtttaaaagctaagctggaaaacatttgcatatgtgtttgggaggatccattgtggacttaagccagtttgggaatagacaatcttgagtgggaaatagtttagaagatttaatatgtattgaagatatcttcatttctcagactggaatggctgtgggtaataatagttcaccagaattaaaaatacagaaatgcttacagatatacccatacctagacaccttgtttcttcaagttgtgtttttagtaattcattggaataaaaatgaatgtgttaaacataaacgttctggatgattaaataaactataattgcttaaagtattttgaagtaaataatagttgattgtagaaatacaattttttttcttttttttctttaatacacagggaagtcgagataacatgagtattgtactagtttgcttttcaaatgctcccaaggtctcagatgaagcggtgaaaaaagattcagagttggataagcacttggaatcacgggttgaaggtaagacaaatgctttttaaaaatatagacaggccaggcacggtagctcatgcctgtaatcctagcacttttgtcgcctgggcgacacaccaaggctctgtctcaaaaaaaaaaaaatttagagagggaaagtattctttttgtttatcaaatgattattttaaaatttcctggtcaggcgcagtggctcacacctgtaatcccagcactttggcaggctgaggcgggcagatcatgaggtcagatcgacaccatcctggctacacggtgaaaccccgtctctgctaaaaatacagaaaattagccgggcatggtggcacacacctgtagtcccagctactcgggaggctgaggcaggagcattgcttgaatctgggaggtggaggttgcagtgagccgagattgcaccactgcactccagcctgggcaacagagtgagactccgtctccaaaaaaaaaaaaaaaaaattccataggacaaacaagtatttcaaaacaagtccttgaaaaaacacatctatctgtctaaaatttactgtcttggaccaatttctggggattgattgacagggagaagacaaatatgtctgtttcaccaccaaagagaaacataatttgaaggtagttcgttagagcttgctggtttattttttctttctttttctttccctgcgtacattcctagtagtaagtggagaatccagtgaaatttcccctaacagtgtcatgaaaacaagtactcttaattccgctaatactaattctcccttttcgggttaattatcattggaattcattacggtatcctttcccttttattgatagagttaacattagtgtttcaaaagattattttacatatttttttaaacttcatttggcaataaatttttttttttttttttttgagatagggtcttgctctgttgcctaggctggagtacagtggcatgatctcggctcactacagcctcaactccctgggctcaagtgatcctctcacctcagcctctcccaagtagctggaactacaggcacgtgccaccacagctggctagttttctttattttttgtaaagatgaggtctcactgtgttgcccagggtggtctcaaactcctggactcaagcagtcctcccacattggcctaccaaagtgctgggattacaggcatgagccagcacagccagcctaataattttaaacatacagaaaagttgcagaagtattacaggatctcccatgtacatgtagtgtcctttacctagattccttatttgtttatgtaataccacgtttggcttatctctatatatactttctgtaacattctcattttctgtctccctccttccttccttccctctccacctctctctcctcttattcccctgccccccatattactaacctttttcctgagccaaatcaattgaaagttgcaaatatgatatatcagtactacttaataaaacgaagattacatgacactacataactgtagtatatccataaaaattaggaaattgacccagcacggtggctcacacctataatcccagcactttgggaggctgaggtgcacggctcacgaggtcaagagttggagaccagcctggccaacatggtgaaatcccatctgtactaaaaatacaaaaattagtcgggcgtggtggcaggtgcctgtaatcccagctactccggaggctgaggcgggagaactgcttgaacctggaaggtggagattgcagtgagccgagatcatgccactgtactctatcctggatgacagagcaagactccatctcgggaaaaaaaaattaagaaattaacgttgatacaatattactttgtaatccacagatcccatttaaatttccctaattatcccagtaatgtcatatgtaggtccaggatgcagtctagagcatgtgtgctgcatttagctgtcatgcctctttagtctccctcaatggaaaaagttccatagtcttttttatttctgttgaccttgacatttttcaagagtacaggtttgtggaatgtgcagcttgggttggctgatgtttcctcttgataagatttaggttatacattggcaggaatactgtggaagtgattctagattcttctcagtgcatcacaatcagggaggcatgtgatgttgatttataatgttaacatcttttgtgacttgcttgggttgttgtctttcaggttacttaattaataattatgttatacctaataagtatttaataaatatgttatacttattcataagtattctatggggaggcactttgagattgttaataacctattgctcattaagattttagcagatagttttagcatccatttgcgatttttgcctgaagaatgatagccaactggtgattttctgattctgtcttttttttttttttttttttttttatgatggagtttcgctgttgttgcccaggctggagtgcaatggcatgatcttggcttaccgcagtctctgcctccggggttcaagtgattctcctgcctcacccttctgagtagctgggattacaggcatgtgccaccacacccggccaattttgtatgtttagtagagagggggtttctccatgttggtcaggctgatctcgaactttctgacctcaggtgatccgcccgccttggcctcccaaagtgctgggattacaggcgtgaatcaccgcgcctggtttagtcattctttttatatgtattagcattttactgcaaggaaaaatgttcttttctgcctgtttgtttatatgagcacagactcacggattcctgttctattcattgtattatcaactgtttcaggcaatgagagcctcttaaaacttgttgtagcgtctttttgtcctgcctgcagctatacagtactacaggatttattatagttttctcccttttcatatttataactctcttctacagaaagaaacctgtcctctactgtcaacccaacaaatctgtcacggctaactctcatgcatatgccttcctcactccaaattgcccatcccagttcaccctatagccatcctaaagctatgcttactgtggttaggcatgaatatcccattctggatcaatttgtggccactatttccccctccactccctgaaagatttgttttgcttagctaagcaaatccaatcgtgttggacaaaattattcaggaacatgagaagggagaagctagtctgtttatctttaacataattgctgatatgtttgagtttaaatctgccgtctttcgtgtttcatctatttttttttatcctccattcttgccttcttttagatgtattccagttcatcctaggatttgcttattagttacacattctttaaaaaattccatttagtaggccagtcatggtggctcacgcctgtaatcccagcactttgggagaccgaggcgggcagatcacgaggtctggagattgagaccatcctggctaacacggtgaaaacctgtaactactaaaaatacaaaaagaaattagctgggcgtggtggtgggcgcctgtagtcccagctactcaggaggctgaggcaggagaatggtgtgaacctgggaggtggagcttgcagtgagccaagatcctgccactgcactccaggctgggcgacagagcaagactccgtttccaaaaaaaaaaaaaaaaaaaattccatttagtaaaaaggaaaaaatttagtggttaccctgagaaaatgaaaatttttcagtcttaaggccctttttttttttttttttcttttccactttcaaccctgagaagctaagtatcataatcttaatataaccttttggttttatatatgctgtttttaagatatgaaattactttttataaagttagattgtcaatcttttttcttttctttgtgggaggactttgatatcataccaagctcttccactcaaggttacatagttacctgtattttctcctaacacttttatgttttgattcttttttttttttttggagaaaatacatttgaatgatataacttacgatgatggtataatagtttgttgaatttggccattttgtatatagtataatagctttgttgaatttggtcattttgtatatagtaggccacagtaattggtgagagttttgaagtgtgaagatgtgtgatttctaatatgtaattacaattaaaagtataaaaccaagaagagagtcttttgcaaatttggagaatggggatttatcttttctgtctctacaactatctagctatgcaccctaaacaatgtgcttaaagttttttttgcacctacaatttcctcagccctaaattaatcttgtttttaggtctcaatgcttttgagtctcaatgagtcctgctttgagggtgatgaaaacgtgagaaacatgtaagaacacattgaagattatgtcagatgcggtcatattcctattgataatatcattaagaggagctgtttttataggagttaatatttaatgataaattgtagtatattggggttgcagattgctgactatagtttatcagaaggtgggaggaattctcttagtttccttcttcctcattcataaagaaactgggtagtttttattttaggaagagctctctagtttggtcagctggctgttatgtgaacttatccaacttgcttaacccctcaaggcaccagtttctttattggaaactaaagataaaaacaccaaccatagagttttttgttttttgagacagagtctcgcactgtcacccaggctggaatgcagtggcgcgatctcggctcactgcaagcttagctgcccgggttcacaccattcttctgcctcagcctccgaagtagctgggactacagatgcccgccaccatgcctggctaattttttgtatttttagtagagatggggtttcactgtattagctcaatctcgtgacctcgtgatctgcccgcctcggcctcccaaagtgctgggattacaggcgtgagccactgcgcccgaccccatagagtttttttttttcttaaataaattgttacaaaaaaagcttattgatgacacttgttaaagatggtaaggcagatattttttcgggggtggggggggcatggcagtagatatagggaccactatgatagaatcttgcagtggcagaaagaaattaaactcaacttggggtcccataaagataagtggaatttataactaaggagctgagtgcttgaagggagtgtcagtggatggaaaattattactaagaggaagcatcaacataaggggtttctggctaaactgacttgatagcatggcaggccaggctaaaatatccagagtggtcctatatcaagtgtgtgggggttttcagtaaactgactgagcaggattctcattcagcctggtttctacaaggacagagagggagcctaaagttctcctagtcagaaagaactcaagagtcttgctgaaggtttggtccaagcaaagagtttttgtcaaaataaatgagaattatgtttgttaagcacctattatggtgcctagcacgtaagtcctcagcaaactgtaactttatatgaactcttaacttctgtaatagccacattttaatttcttaaaggtgtggtcaattcagtttaacatgagttaataatttaatattaattttcttctgcatagttagtaactttctaaagtatatattatataggagagataacaaatatgtaatatgatctctagggcctgtagcaaatagttattattaatcaggagacaaaattgttagctaggcagccactacaaatcaatttaagttggtacttaaaatgtaacttcacagtagcttacacctataattcttgggatgccgaggcagaaggattgcttgagactaggagttcaagaccagcctcggcatcatagagctacaaaaaagttttaaagattagctgagcatggtggtgcacacctgtagttccagctacttgaagactgaagcaggaggatcacttgagtccaggagtttggtgttacagtgagctatgatggcaccactgcactccagcctgggccacagagtaagaacatgtctttaagaaaaaaaaaaaagtaactttttatttgtaaagcagtgttcttcaggagcattatgtttcttctggggttttaaatcatgtaatatgacattaaattttgtggtaaatacattctggtgtacttggtaaatctgtgtgtatgcttttaatgatgactggtcaggtgggaaaggaataatattaaaataaacagggaatagtagttcacctgaattgatgaattatatatttaatgattgctttctacatacaggtttactcagtgtttattgaacatgtgtcactgaggatatagcagaaaaagaaatctcatagaatttgtattctagtaaaaacctatttttttttaatagagaaataaaatagagtaagtagagagcaacaaggaatattggttagaaatgtctctgtgaggaaggatgtttgagcagccgtgcttggagagagaatatctgagggaagaacattccaggcaatgacaacagcaaagactaggagggaatgttcttagtgagtgcagctgggttagaataagccagtagaaaactagaggaaaattaagaggtttgtaggaggcatatcatgtgaggactttggactttgacttgtgggaattcattggaagattttgagtacaagagtgatttgttcttttttccaaaggatctctcttagttgctgtatggagaagagattgtataaaagggacaagagaagccaaaataccgattagaaattatgcattaatgcatggtagtggtaaattggactagagtagaggggtgtaaaaatgtctggtgacatttttggtgtcatagctgagggggtgccactggcatctagtgaatggaggccagggatgctgcttaatattccacagcacacaggacagcccccacaacaaaaaaattgtctggtgtaaaatgtcggtgttgttgatgttgagaagccttatactataagacacagatttaaggtagaaaacttacagtcctgctttcatgaagcttgcagtctatgacccaataaacatcgtgtatgtgggagtatatagcattatggtatacagtacatgtcatgcatatgggagtgtattgcagtgtacctactcagacttaggtcagagaaggatttgagaatgtgacatataaaattgaaacctcaaggatgaaaataggcattcatagctgggcgtggtggctcaggcctctaatcccagcattttgagaggctgaggtgggtggatcacgaggtcaggaattcaagaccagcctggccaacatggtgaaaccccatctctactaaaatacaaaaattagctgggtgtggtggcacatgcctgtaatcccagctacttgggaggctgaggcaggagaatcgcttgaaccagggagtcagaggttgcagtgagctgagatagtgccactgcactccagtgtctcaaaaaaaaaaaaagggacattcaccatacagaggggttggattagagtgaaaagtgttcccaaaccaacgaaaagagtatgtgaagatctagaagtagaagtctttgaatggatcctttggagatgagggaggcgggcagagttgaaagagtagtggaagtcaacgtaagggtcttgtgaggcatggtaaacagttgttttgaaagtaaggcctgggctgggtgtggtggctcatgcctgtaatcccagcactttgggaggccgaggtgggtggatcacctgaggttgggagtttgagatcagcctgaccaacatggagaaaccccatctctactaaaaatacaaaattagccaggcatggtagcacatgcctgtaatcccagctactcgggaggctgaggcaggagaattgcttgaacccaggaggcagaggttgcagtgagccaagatcacgccattgcactccagcctgggcaacaagagtgaaactccgtctcaaaaaaaaaaaaaaagctgtagaatgtaactatttcaggtaagtatcaacttgtaaaaatgatttttaatttctcccctttttcttataattcttatctagctaaacttttattatcctttagtaatggcattcataacttttatattgtttttacttaatattagatcagaagtatttttccatatagctgttactgtattcatcaagacacctatttcgtaatttttagtgattataaaccatttcactcaatggctacaccaaagtttttaactgtcctcttgttggtgaacatttagtttgttccagtttttgctttttatgaataatgctggaatgaacatacatatgcaaataactgttttttcttttttccccctgcatagcaatgtttcagtcaataagtagctttttgtattacttcttaaaaattttttgtgtgttgatggtaattttttttaatatattttaaaataggtactaccaaatagtatctcttgtttcacttcttggtgagtactggcttatcacattaatttaggaactttttttaaaaaacctacagagattatggagaagtctggcgaggaaggaatgcctgatcttgcccatgtcatgcgcatcttgtctgcagaaaatatcccaaatttgcctcctgggggaggtcttgctggcaagtaagtagaacaaaaagctaattttgagttcgttcataattagtaattaaataatttggggtaaaaaaacttaaatcagaagtacatcaattatctagaggtgaaatgggttagtgtttcttatactagagaagaactcttaaaacttcaaccaaaaacgattttttaaaaggaattatctatcatactctttgagtatgaaggtccttctttccttgctaaggagtacaaatggattgtgcaaaatcagattctgagagtaaagtgtagaaggtatgttcttgacaagtatagagtgtaccagttacttttttagtgtggtcaggatgaaatattgagatattcacaagcttaaaattctgtgtaatttaataaaactaaagcatgttttttttttttaggcgtaatgttattgaagctgtttatagtagactgaatccacatagagaaagtgatggggtaagttttattttatttcataagcatttgaagtaatttcacaatataaatactaaatatgaatacattcacattaacgaagtctataataaattatagtctgtagtaaattactactgcttttcattttaaagtgtcagttaaagtttaagaaaatgtattgaaatgaaggtagagataaaattttgttttgtagatagttttgttgtcactttctgggcatcaaatgaccttttttgtttgggctgtctttatttcttctctatatgtctgcttttccttcttctcctttaaaccttaattttgaggcaagaatgctcttttaaatatctcaatttctcctccagcaggctgctgccatcaccagaagttagtgatagtgagtgagttgttattttaataactagacctttcagtacccctgtatgcccacttggaatacccgaggatagtttttttctaatattattgttgtattatgggtacatgagtgttgagctgagataaccatttctgttgtaccttgctgtacttcatcagagcaagactctatgcccttaccttttattttgcttttcttcgaaatgtcagtgagctgccagctgcccctctatattgttttgttttgttttagtactattaccaggagacagaagtgtcctttttttttttttaaatccaagttagttcaaataagtatttttctcttgggttttcaagtttttatgtctaaaaataaattatttaatttttaatatatatgcttcaaagctttaagggaaccaaacagaaatgaaactgattgggaggaagagcccacctccagtctccagctcctcttggcagattgagagagagagtatccattggctagaaatcatatgtcatctcaattgcattatttgctaggattcattgttgcacagcaatataatatgatttcttttccttaacagtaaaagttatcctggcaaaaaggaaaatttaataattaatataattttagtgagtcatataaaagtgatgctatatattgctaattataatttatatcttggtctagagcagtgattctgagtctttttttgtggcaggttcctcaaagtattaagaattgtacccaaggccgggcacggtggctcatgcctgtaatcccagcagtttgggaggccgaggcgggcggatcacctgaggttgggagttcgagaccagcctgaccaacatggagaaaccccgtctctactaaacatacgatattaactgggcatggtggcgcatgtctgtaatcccagctactcgggaggctgaggcaggagaatcgcttgaacccgggaggcggaggttgtggtgagccgagatcatgccattgcactccaccctgggcaacaagagcgaaactccgtctcaaaaaaaaaaaaaaattgacccaaagctgagaaaattaatttaaaaatccaaatattttatgtgatccatcagagaaccctcaaagaaatgagtataggatgttgacatatgactaaaaggatggtggtaatttggaaggttgagagaagagaatcttaactcttcagctagattatagattcttcagggcatccactaccttgattagaggaaataagccctcagaagacagttattgattcattattagccatagaagtactcccatttcctcaggtgtttcaaagtgtcaaccctcatgtgtaatctttaaaaatacatatatatatatatatataccttgctggattttggggtccttcatagtctatttttactccaaacaaggttttctgtttaacatataccaaggataacttttaaattttttaaaaagaaaaaatgattacacatagtagctacataaacagggaataaataggcaacggaactatgaaactggggggaaatgctcaatatataaaccttaccttaaatagattattatttggctatagaaatgggatatatgtacttaattacctttatacataaatgttctatcaacatcagcagatcaaacactgacagtgtgttgtatagtggattcacagagggagaagactagaaaacgtaagacgtgaccccacctgtgtgtctagtgcagcttacactgtagttataaacacaccttaaatgatcaaaatatttcgtatagcttggtaacaaataaatgacaaaatccagaatgtgaccattgccatgtgacttggacagtgattgctgtaaaagttcagctgcttaagcagggggaaagtcagcttcttagagaaaagatagtatttgaagaatgatttgaatggtagaaatgacatgaggatgatgacctttcaagtggactagagaggcaaggacaaagtataagatatcttcaaaagaaaggacatcttttttggctaaagcagagaactgttgtggtgaaaaataagaatttaggttgcagaggtacttgctaagagaccagccttttgaacatcattttagggtaatggaccaccttatgtttagagcataagaatgatagattcaaaaaaatatctgtggtattttaatctgttagaaacatttaccatattagattaaagagatgcaggcagtcaggtagttgtgaaataattacagagaccaaatggtaactgtagacttattatcattacatagatatgtggattaaaggaactttccttgtttactgtgaaaactgactttacagcctagaattttaaatggggaaatattatatgcctttcacaataatcactaacttagaaaaatgttgaactataattgcaagtagcagaaatgtgctgaaaaataccgcagaaggagagagaatgaagaaaatacagacgtgattaaattctgagctcttaacttgacccactgtagcaaaaagctagccgcaaaggtgctccataaatgcttcttaacagtgtggatgatgtcgccaggagctggatgttaacttgcggggtgggaaagatgaaagtatgctagaattacagaagaggagaaagttggaaggtattataaaaattaagtttttttaaataacaaaaattatttttgtttagatatttaaacaaagaattctagccagagttaaatcagagggtttctttagactcctgaatgtctgctttatgtcggagagaattgttctgttgtaaatgattataagtagtaccactagaaatagggattcattcatttttcttataattaagacatcttttaaataaatatttttcagaaagtagagttgagtataagtcataaattaagtaattttaatatatattcagaaaggttactatttaggggaaacttcttaagttctttactaaatttgttttttagtatgtgttccatactaaactaactttttagaatgtgttccatcttcttaccacaaacaatattgatattttcccaacttttaaaatacaaatttgtaacaaagggtttagccagggattcttagtctagggattcacgaatccccagaaatcttttggaaaatttccagaaaaagcaaaactacattttgctgtaagttgtctttatattagacagggctctgggatcatactccttccctttttctaaaatgctagtttgtgttttataattagaatataaattctgtgagatctgggacttgatctgattcatttgtgtctatagtccaagcacaatcctggcatacggtgaaagctcagtaaatattttttgaataggaaatatttgtatttattcatttctagtaattttcttaaggctgtccttaagtcatatatttaaaaattaatttgaggttactaattggtatgaaagtctgtatttatagagttttatactttcatgcaaaaagttcttcccttgaaaaagactcataatgcttttgaattagtatgccactgatcaagtagttgcacaagttggtaattttccaagggtaaagttgagcaggggggtgacctgtatttacccagctcctacttgtgtcaggccccttatttatacacacacagagtcataggtaatcttctcagcacccttcttttacacatgagacttacagagatgaggtagtttgcacaggtcacaaagctaaataaatcatgcagccagaatttgaattagtctgactcctattctctttacattattccatgtggcctctttaaggtagagattatgtatgtctgtaccccacctgtgtctaccatgcaggaaaaatcatttcccattcttttgtaaatatcatgtttatcagtcttaagatactctattttattgattgagacagggtctcattctttgtcccaggctggagtgctatggcaccatcatggctctctgtagcctcaacctcccaggctcaagcgatcctcccagctcagcctcctgagtagctgggattacaggcacacagcaccacactcggctaattttttgtattttttgtagggatagggtctcgcttcattgccagggctagtcttgaactcctgggctcaagttatcttcctacctcagcctcccaaagttctgggattacagacgtgagccactgcatccaaccacaagataatctgtttttaatggtaaatattttataaagttgttgaaaggaatgagttaagcccaattccttgtcagttatttttcacttaaatacacatatttatcttaatccaaaaacggtttaaggcattttgatcttagagaagggaaggaaaaacaggatagattagtctctttttgagcccaaaagaatctctgtattgttttcagattattaaattttgcatgcatttttctgttttactttaaacggataaatgcaatacccatagctgcttttacatttttatatcacagtttttagaactatgtgaatattagttttttcatatttactttttattcacttgtcaaagcattgctatggagaagacctatactgtttgaaaatgcaggccgggcgcggtggctcatgcctgtaatgccagcactttgggagggcgaggcaggaggatcacgaggtcaggagatcaagaccatcctggctaacatggtgaaaccccgtctctactaaaaatacaaaaaaaacaaaattagccaggcgtggtggtgggcgcctgtagtctcagctactcgggaggttggggcaggagaatggtgtgaacctgggaggtggagcttgcggtgagccaagattgcaccactgcactccagcctgggcaacagagtgggactctgtctaaaaaaaaaaaaaaaaaaaaaaaaaaaaaagagagagagagagaaaatgcactaacattagtcactatgtttttaaggtatgattgacataacacttacctttgctatgtggtcttgaccattcaaatgacactgtctaaaattattcattaaatttgacatgattcttcaagtaacatgtaatttattagagtcttcattagtcatcaattgtatcacattttgtcatactggagaatttttagtttaaaaatttttttgtctgacaagcagcacgtaggacttcataagaaacatttttactagtgtttactttttctctactgttataagtagtcattttaagaattttggttatgggccgggcacagtggctcacgcctgtaatcccaacactttgggaggccgaggtgggcggatcacaaggtcaggagattgagaccatcctggctaacatggtgataccctgcctctactaaaaatacaaaaaattagccgggcgtggtggcgggcgcctgtagtcccagctactcgggaggctgaggcaggagaatggcgtgaacccgggaggcagagctttcagtgagctgaaatcgtgccactgcactccagcctgggtgacagagcaagactccgtctccaaaaaaaaaaaaaaaaaaaagaattttggttatgagagctgtgtttcaaaagataaatattgctgcaaataaatattagctggttaaattttattttttaaaatgtgcttagttcccttccccctcctattactactctctgcttgatttatctaatttctatgtcttatttggtgtaagttagtattttcatcatgagagattcgacttttaagctatgttagtctagctgatagtaaaagcttaaaaactagggtggatgggagatgtcctgaattctcatctcagtaattgccttcaatttactttacagaataattgtaaacatcccagctgatatgatagtttaatcaacataactagtgttctatagttttattaattttactatattaaggaaatataaacttcaatatgaaataacctgtggtgttctataataatttcaccaatatttctttagtaagagtcttacctgtatgaggtacttcctatgcaaaaaaggtcactcgccataatgtattcaacagagcgcaaagatagacattgatgttaattatacctgtgcacaaatcagagccctgccatttactaagattgtcaccgtgacaaataacttaaatctctctgagctttagtttcatcacttataaaaatgataactggaatccttactttgtagggtacctgtgaggattcagtaagattatgtatataaagttcttagcacaaatattatttttccttccttagatggtaggaggacatagaatggaatatgaaattgtctttactctaaaagagtttgcagtctaagtggagagtcttgtgaaccgttgcaaggtagagttaattgctataatagatgtgtaaaaataggtgtgctatatcaactgtacgagttcagataaagaaagtgcaggaacctagataataggtttctcttctaatattaatgaaagcccatgagagagttacataacagtgtttggaaaaatcaaatataatggctgcggaagaggtttcagtcctctattgtctatccagagtgatgagaaaatgtaatttgccataagataaaatgacttttaagtgtggtcattagctaaagttcttctcaatttagtgattctgtaatgtcagccattgcaaatccgtgtctacttgatttattggtttggttttcttttgctttttatttttttatttttcattttttgagacggagtctcaccctgtcaccgaggctgtaatgcagtggtgcaatctcggctcactgtaacctctgccttccaggttcaagcgattctcctgcctcaccctcccaagtagctgggactacaggcatgcaccaccacgcctggctaatttttctatttttagttgagatgggtttcaccatgttgatcaggctagtctcaaactcctgaactaaagtgatccacctacctcggcctccaaaagtactgggattacaggcatgagccaccgtgcctggctatggtttggttttagtatgtctttttttttttttttttgagagagagtcttgctctgtcgcccaggctggagtgcagtggtgccatctcagctcactgcaagctccgtctcccaggttcacgccattctcctgcctcagcctcctaagtagctgggacgacaggtgcccgccaccacgcccagctaactttttgtatttttagtagagacagggtttcactgtgttagccaggatggtgtccatctcttgacctcatgatctgcctgcctcagcctcccaaagtgctgggattacagacctgagccactgcgcccgacctagtatatcttttaaaaagcaacttctcttccccaactgtcactactatagcaattcacagaaatacaggtgattaataatgtaagtgtcagttggaaagcgagaggtactttatctgttgaacttgccaaaattgacccaaatacgacaaatggaacaacctttcatccaaccttattaataagtccacctccaaattgagtcatgccatttagtctatatcagtgattctcaaccctggctgtatatcagaattacctgtcaggctttaaaagaacaacccaaatccactgaatctgtgtattttgaaatggaactttggcatgtgtgcaattttaaaagctccacaggtaattccaatgtggagcaagggttgataatcactttatgtgtaaatctttgaagcagattttgttttaatgtcctgtaatttttttttaataaaatggtaggtttttatcttttttttttttttttttttttttggtttgggggttttcgggggaagagggttgtaggccctgcattaaaaggtctttgtgatataccgtaaagtagaaaatttcctcttaaagactgacaaggtttatcattagagtatacttatcacatgttgttccatctcaacccttcctgaatagattaaaatgggaaactttttatttatttatttatttatttatttatttatttatttatgaatgaatgaatgaatgaatgacagggtcttcctccattgcccaggctggagtgtagaggcatgaacatggcttactgtaatctcaacctcctgggctcaagtgatcctcccaccttagcttcccaagtagctgggaccagaggtgtgtgctgccacacctaattttttaaatttttgttttgtagagacggggtctccccgtgttgctcaggctggtctcaaactcctgggctcaagtgatcctttgaccttggcctcccaaagtgctgggattacaggcatgagccaccagccctggatgagaaactttatttagggaaacatgttttaagtccacataataaattttgcaattaaatgacagctaatatgcttgttgtggaaaattggaaaattcaaagaaaataaagtatctagaactccctacccattatcattatattgctgtatttcctttctttccaggtatttttacatatgctaacatgaacagatacacagacgtatatgtatccaaaaagcatgggccatacacagtatcatcttttttttttttttttggagatggagtcttgctctgtcgcctaggctggagtgcagtgggtgtgatcttggctcactgcaacctccacctcctgagttcaagcaattctcctgcctcagcctcccgagtagctgagattactgatgcacacacaccatacctggctaatttttgtatttttagtagagatggggtttcaccatgttggtcaggctgatctcgaactgctgacctcaggtgatccacccatctcagcctcccaaagtgctgcgattacaggcatgagctactgtgcccggcccagtatcatccattttttgccatgaggatacttccccgccccatccccaccaccaccccgtctgaggcaggaaaacaagcactttttttttctttttcttttctttttttttttttttttgagatagagtctcactttgtcacccaggctggagtgcagtggtgcgatctcgggtcactgcaacctccgccctccgagttcaagcgattctcctgcctcagcctcccggagtagctgggattgcaggcacttgccactgcgtgctgctaattttttgtatttttagtagagatagggtttcaccatcttggccaggctggtcttgaattcctgacctcgtgatccacccgcctcagcctaacaagcccttttttttttttttttttttaagagggtctcactctgtcgttcagactggtgttcattggtatggtcatgggtcactgaagcctcaacctcctcgacttagctcaacctctcgcctcagttccccaagtagttgggactatgggcgtgttccttttaaacattttttgtagagatagggtctcattgtgtttcccaggctggcctagaactcctgacctcaaggaatcctcctacccgtctcccaaagtggtgaaattgcatacacgagtcactgctcctggccaatgagggcaactttttaaaaaataacattcatctgctctcatttttctaataaaacattgccatttattatatggctttattagtgttatctttgttgcaaaagtatatgtaatagtctctaaagatggttaagagtttgtgtcacatcaactgtatcaataacctattttgtattttattttcccaatattttaagatgaaaacttccaaatgtatttaaaaaggggatatgatatgttggaacagctgtatattgtctctctagattcaacaactgttaacattttgccatagttgctttatttttctttttatatctactgttttttttctttctttgactgaaccctttgagagaaaattgcagacatcatattttacctgtaaacatttaagcatgcagctcttaagaatgaagatatttttcagccaggcacggtagctcacacctgtaatcccagcactttgggaggccgatgcaggcagatcacctgaggttgggagttcgagaccagcctgaccaacatggagaaaccctgtctctactaaaaatacaaaattagccgggcatggtgtcacatgcctgtaatcccagctactcgggaggctgaggcaggagaatcgcttaaatcctcgaggtggaggttgtggtgagccgagaacatgccattgccctccagcctgggcaacaagagtgaaactccatcccaaaaaaaaaaaaagaacgaagacatttttctgtataaccataataccattattatacctaagaaaattcatttttttaaatttatttttaatttttgtgggtacactgtaggtgtataaaaaaataaattgtataatattgaatatcaagtttaaatttccctagttgtcactagagtgactattgtaattgttattttgaatcccagtctaatcaagtttatcaatcaagcacattaaacaagtctttaatcagtcaagcccctcacctgtttttttccccttgaaactgactttgaagaatctgagccagttttttacaatacgtcctgcattctgaattcatatgattgttttctcatgtgtgctctaacttgatcctctattcccttttttcctgtaaactgggaattagcattattagattcattctaaacattttttggcacgaatacaggacatgactgtactttataatgcatcatatcaagaggcacatactgtaaagatatctttattttagtctgtcggcttaactgtgatcagcttggatgattagagcttgttctgtacagtattaagtagttactattgtagaaacctgtagattttccaaaattcactaaaatatgaaaggattgagtagtttattattcatactgagaatacttaatttatttttatctagagatgtttttatcaaaataagagcaaaaagtaaatacaatttttatccgtaaaaactctaaaatctttcaaaaatctgtttaaatctatatagttttatgttttgtatttcctacttatttagcagaaatgatgaagaaactgttctgatggcctgcttttctgtccttttcctactgctttaaacattgattttcttttgtactaaatcatatagccaaatattgtttaagtaagtcagttttaggaaatgcttgtgttgctgttgaattataaaagctgagtaaatttcagattaaactttaaatgactgtgaaataagacataaactagttaatggtaatttgcttaaaatgacttgagattattattggaagtttttattaattgatacaggtaagaattgatatttaataaaatgttctcatgcttagactatattacttttcggtagagaaattagtattttgctgtaatgtgttatgaaatacatgtgatatcctagtttgtctactgacactggggtcttgaatcttaaaaaaaggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatctatgcatgttgtacttatttttgaattaattttttaaaaacaaccaagtttggtatattggaagaatacccattagaaattcatttgtatttatataacatttagaacacttttggcttaccttttttcattaacaaaaaggaaaagtttaatattaaaatatatgtgttgcatacttaaatctattctttttcttatccatcttttgtggtacaaaatattaatctttggacattatgggcacacattagacatgtgagaaaattgccacagtgagcattttaaagattgcagaattgtccattttgttacaaatttttgttagttattaagaaattgaacaattatgggctatttttaaaatagtggcagatgagagtttttgtttaaagggatttttaaattatagatttgtcacatagggaaaaatattttttaaaaattattttataactgtagaacattaacttttcgtctttacgtttatatttatatcatgtgtctaaagttgctttaagttaccataaattgaaacttcggaatctttggatgttatagctgatgttttgatgtatttttccaatgccagaatatttttaagtgctttgagaaaggaaggcatttgatggagaggggaggaaaataacccaacccagttatctatccatattagatacacgtgtacacacacaatatgcaatacacaacatctctctgtaaaagtacccttttcagacaaagaaaggaaggtaatttgttcatcaattttgttttcttttgaaattcaatccaatctggaagtggcataggtaaataataatattcttccttttctcttcctgtagggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacaca

SEQ ID NO: 17166 - DNA, 20795 bp, Human
aagcctaggagtctccacaggggaccatataagctggttttggccagtgtgctactacattgtaacaattgaaacctcctgagcatttagggtgcaggagctgaagatgagaaaaagaaagacttctcatagaaaaagaacaaatgtgcgggctattctggtcctttctaagatttttgcttgcggggaagagttggagggctagggagatggatgtggaggaggacagaagagagggtggagggttgtatctgcatttttcagctaaagatgtttgtgccttctgagtccagtctagggtgctttgattccaggaagatggaggctatagataaagaattaatagtatcaaaatctgcccccccaccagtcccctcactgcaaatgtggggaggtgcaactaagctgacaagtgtttgggtccctagcgcagtagggttgagtttccaatggcctttgtcactcagtcatgggcatcttccacttctctttcttctcccctcccacctcctgtacccacccctcgaaacctttctgcctccacttgtacgactgaaactgacaggtttcagaagccagtctactaccgtgacccaggcaagcctgttcttgcatctggaataaagaggctgatctattggtccatggcctatgtacctgatacaaaccattaaaaaaaaaaatagaaccactcaactattctccacccaagatttgcttcctatgttttatcactgtcctttaacttgggtgggaaatgtttttgttttcataaatgctcatgaggcttctacagataagcccctattaaactatatttaaagggattgtagttcaaatcagtatgcacagataccagtttcccaccttgccctgtggacttgtcagcaaagcatctttgggatcttcatgttgtctaagagccttggtctaaaatagatcccgaatgggcaccctagagggcgcactgcttacattttcggcatgcaacgccaacagcgctcgctcccaggctccataaaaggggaggaggcagatcagtttcctcctctcattgagaaagaagaggattggaaggccgggcgtataaagccgcgcagagagcgtgaaacaaagcagtcggctcggaattggacttgggaggcgcggtgaggagtcaggcttaaaacttgttggaggggagtaaccagcctgctcctctcgctctcctcctcgtctgcgccgcgtttcagaggttgcccatcagccttgtgatttatttttatatctgctttttataaagagagaaatatatatatatatatatatttttttttttcttcttaagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgaggtgagtgtggccggccgcggcttccacgagggggtcggccagtgggatcccagtcccgaggtgggcctccccgctttcatccgttttcccttaaaaaaaaaaaaaaagaaaaaaaaaagtctttctcggtccttactactttcccctgattagactgcggggaaagggaaagtgcgctggaagttttagggttgggacgcgcctgcacatgggctggttagctcctgaaacttgttcgttcctgtgtgcataacctggggttgggagattcgggtcagcagatctgtgagagccgggtggggtgagtggggagtaggacaggggtttcggaaagggtccatgtgcttagtgtgtggtctgatgtgtgaaggttttctttcttaactggggagcggggaggggaagggtgttcaatgggtgtcgtgcgtttaaacgtaacctctttgccctctttccttcctcttttgcccattttgtctatccagaattacgttcctacagtgtttgagaattacacggccagttttgaaatcgacacacaaagaatagagttgagcctgtgggacacttcgggtaagagtgggaggaccgcgtggcgcttggggcgggtttccagtcgctgggggatgcgcggcgggtctcgggaaaccgcgcgctacaagccgtctgcgcccctcccaagggattcccacggtccctgttgggcgaaaattgtatcccttctgggtgggggcggcagacgacagcgtggacgaggagatagcagtggggagaggagagcgctgtgtgcccgcagggtgaccccgcggttggagccactagtggccaggcgcagtccgcccgcggagtcgtggtcaagtcgccttgggtcggccgaggtggcccgatactgtggggtgttgcatgggcgctgcgtgcgcctcggcggaaccacccggctcaaggcgggcgcccctcctagatctaacctgctggttggcggggaggcggggagcgccgcgggggtgatgggaggcgggagaaaatcccagaggcgacgcggttacgtgcaattgccgctgttgagggaaagaaactgagcgcaggcagccgcggcgcccgtgacgcctacacccaggaatgcgctggtggcgcaggggccgggcagcagctgaacctcctcttcgcgctgccggccgcccgcggtgcctcggtgcccacctgtaccgagcttttccctttttcccccactccatcccagtgatcacgtccgtttccccttcaccacaccagcccctcctgacctctattgcatcccccactcggcttgcctccaaggccgcgggcaacactattcgcctttgaccttccagtctacttgaattattggcgccgcggtgggttatattcatgggtctgaggttcaaggccgggttattgctttcccatgcgcccacccacctacctggcgcgcggtggtagggagggctaggtaccctcccggtgggaaggcatccggccccccggctgagttaggggtttaggccaggtcaaaggccggggagtggcaggggggcaccatctgaggtcttgggctgggacataggcacccgccgccctaaccagcggtgtctagcgagtttgtttccaagaagggtgtcggctatggaaaagcaggacccactgggaaggctgggtaaaggcccctgcgcttagggctgggaatttagcaaggagctgggttgctggcggaccgagccaaatccgggtgaaactggcgaggaggaacgcgcaagtgccaacaagcaggtttgctgttaggcggggaggccccgaggtggagccgcgcccagcggggagtggcctcgtggaggtgtttctgtgagcttcccacagaaccgctgggcttgaaccgctggagcccccgagggacgcgggggttcagagagcaagaggaaggaaccagactgacagggtcgccagaggcagtcccagcacaaaggcaagcgagaagtctcgcacgagcgagcgcctctcatggtcggtgccagatgctccgactgctgcagtgagaagggctgattttgtttccccctggagtcaggctctttctcagccgttccaagggcagcagaatcaggactttgccgccgtgttttctgttggggatggtacacagactcgaaactctggagaaggtgttggtagacagaattcaagtggttccttatttcagtagttcctatcagaattattttacagcctggtacttaatgggctctgattcccagacatatcatggtatgtatttgttatgcctactggatggcacagctggtgtggtaccgataataagcaccagtactccctgccccaaccggcagccctgtttggacctaatgcacgataaaaattattttggcacggggtggagcagtgtgtctgaaccagtcgttgatacaaagctgtgtttagatcttagctcctggttaccatggatttctgtgtgcaaatcccctatctccctgggtctcattttcatcatctgtaaaaagaggacactgagctagatgatgtgcaggatctctcccagctgtacacttcttggctttattacgctggacaggcaggtctttttgtttcccaggatgttggttggcttcagctcttagtcttaggggatctggcatcccgtgctggggttttcacagcctgcaaagcaagccaggttctgggcagagccaggcttcctggtggatttaggaatgaaacccatctggacagggagggggaatgggtgggcttataggaatgctgggctatacatttcctatctcaagcttcaagagtgacaggaccaccaatggatatttcggaatagatgcctaaagggctaaattgattcttttaggggagaaaaggcacattgtttgataaaggctagaacataaaccaaaatgtgggcagtttgtagttggaggctgtccttcgtatgtgcaggtaaataccacttcaggtatcttcatgcatttaatcaaaactctgcagttcgtagactctgcacacatagcacaatgccttgcatacagcagttatccaataaaatctgatgaatgagtaaatgagtaatgatatgcatagttgccaaggagatgaggttccctgacatttattcacactgaattacctgtgcacaaagaatggcaactttataaacattgcctttcatcgaattaaagataatcatctgaaatgaatttgtagtgaaataatcacttgtctttttatttaatgaaaccaaaacttatgtatgtttaactaaaatataaaggtttgaaaatgtgatgaagaaaattttgtactgcaaaattatccggtaatgaaatcttagttagaatttagatttaaacaaatggaaaaaagaggcataagggaattatttagaattccattatgttgttcatgaggtgaaatgttagttagttaaacacagtcaccaagcactgcttacttaaattctaagaatagcctgtttccatcaaaagtgatttgttgtttatatctagcaggaaccattgaatcagcaactaattatttcaaggatctttaacatttttccatttaattccaagcttttcatggcaaatttctggacaggactattttttggtaaatgtttgacattttctttgcccactaaaacatttatttagttcagattgtaaaaataattgcatatgccttatgcctcttgatacatttattttttccaaaggccatcaatataactctggagaaaagatcccagccaagtctgtaaagttctaaatgtcagataaattgcactttttatttccctcctagaactttgtgaaagagacttatataggaaaaattgggtgtgcctgactgctcttatatagggagagatacgggatgaacattgtcctttgaatgatatttcctgtcctgtttaccctcctagcagaagggcaaccatttagaagacagaaacagttcctctcttatctggcctctttagttggacagcttctcataaggggtctacttttgcccccagcagtcatgatcatgcataggcaaactctgccaatttggatgtgagaaagactaccaagtgaaagtaggatatgtgaagtctctttgcaccaagaaaaaaaaataatttcctgctttttaaggcacagtaacttaatatttccttcctttctccctttctccatccatctcttcctttttttccgcatccactataaacaggccctctgtcaagaccttagagatacagtgttaattaagcatggtcctgctcctaagaagcagacagttcaggtggggtaatggagaaaaagaagctcttctggtttagcgtgtatttcattaacaactcatgatgcacctaattttgtcaggtccttgaaccccagtgcccttttccacttggttgcaatgtttttcctttgtcagacatcctagggcttatagatcctctggatcctcttcagataggaaacagctacccccgcaccgccccccccacccccgcccattgcacacaccagttaaagcaactacaaaaggcattttgccagtcaattcttagggctacagtactccagcccccccaacaaaagtaaacaaaacctttgtaaaaatgctgtaggaatcatctaaaagagggaatttttaaggcccataacttcttcattttcctaaaaaatatttttcattataaaatgaacattcttaatagttgcagaaatgctcccattgattttcaaatttcacccaatgagtttctgccaaacaatgggtaatagtttcaattgtgaagtaataagtaagaccaaagtaattctaatatcttgtgcttcaaaattggccacatttgccaagcatagaagtaatttgtagcatgaagccaaatgcctactaataatagaaatgtagtcatttaaggatcactgtatcttttcctaagagatttgattgcagtgtaatttcagcacatgtgatttagggagtaataatcattcattccagctttttaaccaaggcaagttaatgcacattttatttaaggcttattattacttttaacatattcaattcagctgctaaattccccacaataactatgctattgcctcatgaacactctttcgaatcttgtcatgatccaagtttcttttaagccctgagtgctaaagttagtacttcctattttagtttttagcattactaacacttaaggtggtatcctttatttcttagagaaaaagagaggaaaaatatcttagttacctaatggccttaatatgaggacaaacttctctataaacagaagtctatctaagctgttatatttagattattgtacatcaagtatgaagaatggtcttggtgacaagctctctaatgaaatatttcttaacagggatggaaatggttcagcagtattggagattagtatataattaatccagaaaagcagcttaaaaggggatcactgctctctctctccccctcccctttttttttggtgatttagcatataaatgaacacatctagacaagacataaaaatgattataaaaccagtaaacatggtttagtgctttctgtgtgcatacaatctgctagatgctatgggaggagtacagagctgggtgagagcagcttctgcccttaggtactcacagtttcaccatgtgataagacagacatggtgaaaacatgagtgacaataaaatttaaaatattcaggctttcccaaactaacaaaagaaatcaaatgagaagcccggattaagtgtcaggtgtttaggtgagaggagatgccagtagactgagatttgaacagggtaaagacatccttcttccctgacaaccttctttgaatacccacaggacaaacagaggacatagaaagacttcctcctgtctagtgctgtaatacctgtttataggatggtgagcccggaggttctaaacctggatttttcaaggagcaacaagatccaaagagttcttgaaggccacaagggcagcccaggctccctaactcatgacttaatggtcattgaggcccaccacaattcccttcctttctagaagttgactaagttctaagaagtttttaacgtttcttccacgtggaaactcgcttacatttagtggctctcagataaaacaagattctggaagctgagaattataacttaaattaacgttcttggagaaaggaagaggttaagaatttatgaaggagccagagaagcatggatgcttgggatttgaatatcaactgtgaaattgcaggaaaccaagcatttcatcaggtagtaatgatccattggagcttagggtttcaaaactaggtttaattcttaacgagttttcacactgaaactcttatgtaaaagacctgggttaaggtaaaacagatagtttgtatggtggtttccaataagcagtacataaaactgcatttggagatttgtccaccatgcagtaatttccatttaaaccaaggaacctcctaaaaaggggagggggcagtatgaatgctctttctaagtctacatctgtctgtagattttttttttttagccgcatttagtgctgttttttttccaatctggtttcttgctaagttgcacatttcaatgaagcatccaaattggtcattctgataacacccgaaataaccagatgtttcctcattaatccagttcttttgcatgtaaatatgacaccaagaaccaatactttctccagttagctcatggtgcctggcgggctctgccaaatgaattagtcgtggctcagtcattttctgatgtcctttaaatgacttctcagttgctacatattggtcactttctcagagtctcccttggcaaagcaaacattttattgacacggaatgtagttgacgcagaagtttgaccaggtgttgtgcacattggttttgaaaaatgagcctgatgacatagtttgtggaaagatgaattcactcatgggattctactccaagaaatctgattcttagatatcatatgaaacaaaaacttgaatccattatccctatttacttttaggcatattcatatacatatactcttttccctaaagctcttgacttaaccatggttccactgtcagtaaaatattttgattcttacatatttttaagtacctcaataagattaggagtttaaagctaaactttatttaaaggccaaacatatctacctgtctgactttctaattttgtatctacattgcccccagaaatagaaaatctttattccattttaatagcaacacataaatgcccacaaaattttataagatctgttcatagttcctattacctgaatccatggaagaaacaaacatattcttcctgggagtgtttgttgcatatttgcaggcatggtatttgttgtgcagactacttgaaacaagaactaaacagtcttacactgagtcagatacaaaagttctgcccagacttgattcacattcttgagattgctgctaatttaaaccttttcctctgattagagatggcatgaggaaatgcaatcttgtaataattgggcagatcatgccctctcacatgttagctgctgctgcgttcagatgtgctcatggtggtcactaaatataccaaaagttaatctacttttctctgccaaaaatatgcaatagctttagcttactcttcttggtaaaaatttcttaagggggaaagggaagcttttcagatgaaggttcaagttaaataaattatatttatgaaatattcaacaagaagagttttcagttctccaactcctctaaagcctcacagtgtttaaactggtactttgcaaaaggttccataaagccttccttttgggcatgaatcttcttacatatacatttaattatgtacatatatggtgtgttctatatttgcgaaagggtgacttcagcaggcaggtatgtgtctgaagaattagtttctgggtgaggcacgttgtgactattctttggctggaaattttgctctcacccagaattaatgatcttgaatacaaagatgggtagatctgaaatttcaaaagctctctagaactttgctgatgtttgccaaacttgagcaactcagagaaccccaagtgtacacttgttccaatctacccccagcaaagcctttcaactatattttctgggtgagcggggtacacattttgcatatatagtgtagttgtttctttacaatatagagtttccctaagtttttccttcagaggtgtggcaggttacttaaaaaggaccttggaatagggttgcgagcttaaaagtttcatatagtaccagagaaatgctgcatctgagaatttccatatgcatgaagcctattccacatgctgaaaaagagtttcatttgacaagccaaacgcagtccctaaatgttattggactttagtgcattcttaggtactagagcacatactctgtgtatatcaatacctaccatgtactgcagttaaagttgaatactttcatacttagtaaaaattgttgagccctcctgcttgtgctgtgtttagttctacagttagcaccttgggagtttttcatgtgcatcttttaaaaacacctatagaagttaattttttttttttttttttgccgtttggcttcacagggtgttgtaagacttttctggagggatataggagttaggggcaggtattgttcctgctttacccacttactttcagctccttcctttggtgtcatttctgcccctctttattgcttctcacttcacagagtcatttctggaattcctcttcctttttttttggcatgcgttgtctcacgcatacctgtgattccaccgtgccctctccagctttgcttgccttacttcctttgtgcagtctcttgggctttatggggaagaaaaggaaggattccaagtgcttaaacacagagtaaacactgtaaagttacacaggaggtgtttttgtgtgtgagtgtttttgttttttgttttgctttgtttttttttttatcctgaaagtcctgctgagctgatgacttacatctttcctggtgggacagttcttgataattctatatcaatatttttcactgtgaataaatagagacaatagatatttctatctaagacaagataaacttaacctatcaaaaatatagtgaataaatggtcttgttattttaaataaattactcttgtcattggcagtcaaattatgcttataactaagaaatatgggaatcagttttactagtacctttggacactcgtgttgatctaaaagcagcactgttcattagcaaaagtaatagaatgggatcaaagtgtcatccctaattagatcatgttaaacctcttaaaaattacctgtctacctccacaagcacggtggtttatttctcataaacctttgcactacatatgtattttcacttatactgttaaccggataaaaacaaaagcagatacaaacttccctgaaaatctggtttaactggagaactccgtttcattttaaaatcaggccagagtctaaattttgcagatatttagatatatgcactaagcacagaagccagcccacttgattttagtaggtagcagtctccagcaggtgactcagggctgagcacaaagccagatctcctttgtggccataaaatgggtgggggacgggaaacatagtccacaaaggggggaggggtattcccagcagtcatgtggtggcctgaatgttgaaaccattcctcaggattttcctggcagtctcaattttaattaaactcttttatcctctttgtatttcttcaatcgcttttcctaatttttttatttggaaaagatggtctccattgtcatagagcagtattacatctggaattagcagtgagtactctaacatcatacaaatcgtatcctgaaaggagctggtaggcacctggaacagttctctaaagataccaggtctgcttgtactggaagctctccacagggagagagtggtttttcctaatgtgagtgatttctgggaaaggagatctctgaagcctcgttaggtttctgacaatcctaactgttggcagctttgccttcctgggtctgggatcaggttgtctctcgcggactttgaggagtagaggaaactctcatttatatgtccagtatttggagctccactctatgatctagaattttctgactgcctgtttggaaagagtcattcaaatgtttacagcaggtgccgtgctagagttagactttggacacagaaacaggaaaggttctagttgagaaagtgtgaacttcttagaactaatatggaaatactaatgtagccataaatagtgttcaaccatctcgtttctgatgcctttcgaatgttcaaatgggtgaactatttgtgaattattctcttcacctcagagtactttcagcgactgaaaaggcagccacagcttgtcattttcagagacggcctcattctaatataccttcatacttaaaatgacttgactttttaaactctaaacgctttaagcttctgggaaatatctttcagctgtcagcctctgctctaccagggtcctggttccagatgtgggtaggcagctgctgcagctcatgaacagctctgacttaattctctatttattcacacttttcttcctgattcttgtaacattcttttcttccttgcttagcagacacacgtggcttgaagttgtcactctccatcgtaaaggagctagagaaaaagctgcactgttgcctggggttccatagcagatgccagggacccagagtgtactgtgtgaatagagggcgatgccccctgactatagtgccttttagatcacaagaacagcctccaagcaaatgttgttttgatagaaatataaacagtgacattttttctaaagctgctttttaagtctctcttcctgactttgcctattgaggttttgatttatcaagggacaacatgtcctgtttttctgctcaaaatggaaagtgatgtcaaaatgaaatagacttttaaaaagagtttggtggtttagattttctttttctactctggagtcagatacatacgtgtgtatatatttgcctagtaaaatcattttcatgtgatgcttgtgaaatgtcagcatacggaaaatgatttcttaaacaagcggcatttggcaggctgtatttagttttctagtcaatcatttcataactataggcctcatgtaattgcccatcctttggaattcttaaagaaatagaagaaacttccttgattgactagagagttctgtggttaaattaattggctggtgccttgaacctttagggtaccctggacttaattcaggttaagatccttagatcatgcctcagtgtcactctcagagatgggactctgtaaaaaagcgacatgatcctatacgacatttattacattcttgattgtaacaggaagaaaatctatatagggtttggcgataagttaaaataagcaagctcaaaggtcaatggcctatgtaaacttacatcttggagatgggtaacactgatgtggtttctctttgcatagttgaacccttcctcttcctctctccctcattcacccctatcctgctgtcagaattgatcttgagttttggtctctttcccaagaagtagttcagtttatggttcttgctaccactcagcttttaacagcagtaatacaaccataatgcccatagttaatacgtattgatcccttactaaaagccaggccctgcctgggtttacttaatctcaggtatgtatgttgtcagcatcttcattttatgagtgaagaatcagaggcacagggtcctaaagctaccttgccccctccctttttagtggtggaggcaggtttacacacaagaccacctggccccaggtgcttccctacttcacccaggtaacttcaggccctagtctttgaaccatacagatttcacttaagatcctggccctcttcttgaatttatgtcagacacatgtgaggcttcattcatcatatatttctaagcaggcttttgtgtgtctgtttgaattcttttccaagaattaggggaagtgggagttgggtcgtgatgtgacagtcaaaggacttagccggaaagggtagagttaatgcatgacagacaaggggactctcatctgaaaatttgtgtgtctttgtttcttctcaggttctccttactatgacaatgtccgccccctctcttaccctgattcggatgctgtgctgatttgctttgacatcagtagaccagagaccctggacagtgtcctcaaaaaggcaagtgctgggaaatgatgacacacttcagtactgggtgatgtataaatagaaacgtggggtttgttgggaagctcaaagactctaatcaattccctgccttacaatttgtaattaaacactagaaagaaccctttcacaccaaaatggggtttccactttttgatgatgaacttgcttgaaattttatttcatgaagctctgaaacaaaataccttttaagggccttcatgtttgtcctttgggagaaaaatggtacagctaacaacagttatatttgattactatcatattcatgtgttccttccttctttcagtgactcaacagattgcatcttagtttacagatttacatttgacctcaagtcagatagtgaaaggaatgcaataatggctattttaacaaagaagctgtgttttagttatggtgttattagaaacagaaatggaactagtgtaggaggaatagggatgtgtccaatgtgaattgtctgatgatcaggtatctgtctagtaattatgaccaggtatctttctagtaatatggaagcagtgcttgtaaacatgttatatattataatgtacacatagtttatggaggcaaaggtaagtcaggttccgtaggaacctaactaaggaagctatggttggaaggaaccagggggagatcaagaggaagaggacctattacaggatgggtcacaggaactagggaggccagtgggaggaaggggcgtttcttgaccttcagcagttgagactcagcctccaggtagttgtagaaggcacatgccgtgttagtccatggatcagcatttattagccactagctattttctcagccctggcctgtgtgctgtggggtttcagaatcagatccttgttggagcactccctctcctccacacactggcttcaacaccggatgtggctgagagcaaggcagtgtcaactgaggggtgacccatgcagcccagtctgagtatggtatggattgagaaagacaaacatgcaggtgtggctaggttggttttgtttttttcattttaatttttagtggaatttatttgtattttgtgtgtttttattagtttacattcccctattatatttgattgcttggcttgtgtgtcattgtgaaatcaggatttgaagtataataatccttctgtctctactaaatattacaaacagagttcaataaaactcttagtagatctctttcttaatagatcaaagactcttttttcctttttagctcctttcaattttgagtaatacatatctaacacaaataatgctaatgcttgtcaaatccaggcaggaatacacctttcctgtctttaatgcttgtaaacaattgctagacatgcagagggaggccaaagtcattacacagctgaagagcaacataacaacatgtctagttctgtctggagataaaaggggttgcttatttactagagattttacttgatgtagtatcaggctatgcataatttatgatgaaaagcctttctcctgttttattttgcttttgtcttctaagaccaaatgaatagtgactttgggcttatagatattaatgagtatgttttacattcctgtgaggtttaaggctcatgataacccctgcggtttgtcttgattaatggaaccctttaagtccttcactatcaaagaggaggttagaatgacttgaagtagggaggatttcttttttttttttttccagttcaccttccacttctaatgccagtgccacctagcatgtggtaggtgttcctacataattctgaaaggagtgagggagagagggagagaggaagggagggaggaaagaaggaaagaaggaaggaaggaagggagggagggagggaggaagggaggaataagtggacaaaatgggctcttatggaaagtatattactcctttgaatcctctggtgtagtttgcactagagttcgttacccaaagtacacccctagatttggagatgtctcctctagtgatcttttaagttattcttgcaggatgtccctcttatctagtgttatacttaatacatgacttcatcacccccagtattctgtgaatttccttccagaagacacagctatgtcttagtcatcattgtcactgccacagtacttagtagaacacttacatatttgtgaatgtgggtgggaagagtcaggcgccacttccccatctcagcctctctaggccctgccctcaaaggccaaagatctcctgtgaccgccctgaactcttgactcccatgctgttgcagagctcaagcttgaggaaatgaagccacaaaaagctgcttgcttgttcttaaagaggacagttggaattccaagccaggcattgctgaaggttctaataattattgttagatcatgaaacaactagacaaattggaatagattgaaatagttttaaactaacttgaaggcatatgagctacaggaccagctgccttcccgatgacccaagagatgttcctttgcaaatgtcatggtctgtgttgatgcaaccatgtgaacagaaactccttcaaggcaggatgttctgttttattaactatctcaggtacttaaaatagagcctcagctcgtggtggcatgcttcagtgtttcatgatgggatcagggaatgcatacttgtgctagtgttgcctctgccttatccccagccttctagtgaaggaggatcagatccacacatcgaaggatgtggtcacttgttaggatatataattattcttaagacacatttatctttaagagacacaccaataattaagacattattgaagctacctttggacaacatctaccaagtctctttcagtagcaacagatgagtcacagagagggagaatcaatcataatatacataattattctctaatgcttaaaaagtagtaaaacttcacatctgttcaggagataaatgcaaagtttgcttcttcatctcaagggacactccatttttaacatcttttctgagtttcattctaatgtcagccagtggagaaatggttttcatgatatggataccgttactttgttcatttttaatctttttttttttctttcatagtggaaaggtgaaatccaggaattttgtccaaataccaaaatgctcttggtcggctgcaagtctgatctgcggacagatgttagtacattagtagagctctccaatcacaggcagacgccagtgtcctatgaccaggtatgtatgttgcccatgtgcaaaactggattttagaaagagtgaaagaaatggactatcactcataataaataaaataaaaagtagctgcttttctaaaggctcacccagtggtcagttgtgaaatttaaaatgctgtcatttattagtgtaattacatgatattcgggtacataaacagttgatatgctaaccttgtatatttctgcacctcccagtaggtttaaagttaaataggtttaagagagaatgtggtcaaaatcagtaatactctttaagaggggtaatctgattttacagtcggcagtacaataataaggctgttgccagtaaagtggaacactccataacaccatctttcagagagtcttcatttctgtaagcatttcccccaagtatttagaaatgagaatcagtttcaaaagctcattctcataaaacctacaaccagattctaaagagagttcatgttgaaataccaaaattttattaagaatcatcattttaaataccgcagtcttcttagtcttccatttctcattagcaaaaaatttggtattttaaataagtagttttggttaatgtgcacatgcttattgttgtgtacgttggtggtatggttcacacttagaaattacatatgttgtgtttcataaagtaacagatgttacaatagtattattcctttcctcaacgcatttcggccctaagtaagacacaatcacatacatttcaaaatcgattttaaatttcattcattgcccctgtttttggtacaacctagtcactagtcttgaatgccatttaccctcaagaaaagagaaatgaagtgcaccatgaggcgctggaacaggttctcaaggccacatcgccacggccagagctgtgtggaaaatgcagagtttatgttcatgaccttcagctaacttacttcactagtaagcttctctgcgccattccatgcttgctgtgaccctggaaaacctgaataaccagttaactcttgcttgcagttgatagtgaagatgaatcacttcgttagctccactctacacttctttgaatcacctcatgttaagtgtttgataaccagggtcttcctttgttaagatcagcctttagcatttattcagagctctaacacctctaatgagccatgagagttgggcatcttagggatgggctcttgactgcaaatagttatgaagtaataaataaggcagtttacattttaacaactttttttttttgcaatgacacttggaaaattcagttaacgtatcagcaaacgttttgcaatgtgttattattttgtggtattagaagatgctagctaactttcccccaaagtcttattgctggttaaaatcccttcttttgcttctcagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggtttttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagacgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatacttttttttttcttcaaataaaaaagtaaccatgtctttgtctaaatgtgatctgtcttttattatctacttcctgatttagctgtttagctttgttctttaacataggtgattacagaatctggcctaacgttttctgaactagaaggctttggaattttttgattcttcatagtagtaacagataaacctgcatatataaaagttttcatgatgctttcaaatcacaagaaaaaaatggggcataatta

SEQ ID NO: 17167 - DNA, 48536 bp, Human; identical to SEQ ID NO: 11867

SEQ ID NO: 17168 - DNA, 28129 bp, Human
ctcctctcacccgacagcctgcctatttccaaaggaaaaaaaaaaagcgtgttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgcccgccctagtccctgctctccacgggtgcgctgcgcagggacccccccccccccgcctccctcgtcactcttcttatccctgccctccggattcacgccccggggaagcacggaggctgaggctctagttgaagtggggcaagagcgattttcccttgagcttccatgctgcgagcgcctgtccctccaaagggcgcctgggcagcagcagccgaaggcgctactaggaacggtaacctgttacttttccaggggccgtagtcgacccgctgcccgagttgctgtgcgactgcgcgcgcggggctaggagtgaggtcggagggagggtgtggaggcgatggccggtgggcccttctctgtggggtcctcgatctacccagattagcccgcaatctctctgtcccggggccttcgggcgccatcgcgccagcgccgagagtcgagcaggggcgccgcgcaagatctttgtccgccgcctcctgcgcgctgcgcgcaagttcgtttccccggtgacgttccccatgcttacttaccccaccctctctggatctgtaccgcgagaaatctggggtcctcagggggctaggtagaggagaaacgctgaaaccggaccgaaacctcgccctaggcttagcgatggctaaaaaccggctgggataagagggaggcaagcaacattccgactcgctgctttctggctgtctggagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccccgctggcccacacgccggctgctgagtgcccaatggggcttgtagcggctcggctggaaaatcgctcactgagcgctcccctgtgctcctagcctagtcccccacacccttgcgtcttgtactggccttggacccccaccccgaccccgaccccgcctcgtctcggcgcttcactccaggtcgcgccgatgcaccgccagactcgagagcggcccagggctacgctccctgcgccccagtaccggagctagcgcgcacgtctcctccgctgcccccacccctgcgcacccctaccaggcaggctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaagtaggtcccgccccaattttctatcaaatgaactgcagggaagatgggggcgctgggacgtcgggaggctgagctggcggaaagggaagggggagcgcggagataatggaggctgggaaataaatggggctctgaccccgtccctgccagaggtcattcggctgtcagggacgctaggtgactcccagggcaccggagagcgaggaccacgcaaggtccgagcagcggcgatcgttgagggcttcgcggaggaggaggggcgcgcagccagggtgttgtttttattctgttgtgtgtggtttctttgctccgtgggacgacaggggtcagcgcagggggcggaatgaagagctaggagccccagcaggaataagagttttcagtccccggctttcgttgagccaagatctgacctcctcctttccccctgggctgtgttcaaagtctataatcagcggaaatttcgacgttaattgcagcttttagaaaactcaaggtccctaattgctccaaatttgcatcaagctattgacgagttagggagaagtcaggggcgggaaaggtgcataaaactgagactgagccttgacatttcatacaattaattacatctcagagaaataaataaataaataaataaataaataggggagcgggcggcatcctgagtggcaagagatggggaactgggagggggcaagaagctttatcatagagaggagagagcacctctctccttatcccaggcaagagatctgtcaggaggtgacatgtcccgaaaagagagaaagaaaagagacaccagataaaagaggggggaggatttatgcttccctgtcttaagtgcgacaggctcctcaacccatttccagaatctatctttaattttatttcctacctctgtaaaggcttgagatgagaaaattgtttttctttttccttgttggagtgaagaagtgtctcctgaccccacccccctaaaaaaacttatcagcttcagactgtaagtgttcccactcccccatttatttatttctgagatgtaattaattgtatgaatttccagaatttgtatacagaaagggcttaagaaggatagtgtggttacagggagtgcttattgatgcgcttttatggcactttatatttgagaaaataagtatcctcatcaatgaagtggggattattaccggaaagcccctttagacgctggcattggctcccgggcaggaggtctcgtgttaagtcctcaggtctcattccaatttcctttgcagctccctcttcccgccacccaggagggatacaattacccacacaacaaagagggcctcgggagagtcgccagccctggtagcatatgaaccaggcaccggcgttggagctggccagggcagggcgggaggaacgcgaggcctgcgcgcctttgtgtggtgctttcgccttgatggatttcttttctgacgctttccacatttcccgctcccttttgccgcctgggggtgggggtggggggttagcgggcagttgtgttaatttgccctccactcccggcgcccttacggaattcccggtggccgccagtcgccggcgcaaatgccaagtcaccggtaggagacacaacagaggcgatgacctgaatccgcacgtggcctggttcgcctggaagctgccaaagcgaaggcaagagagcccgggaccctgctgtaaaacagcaagcagcacgtgtcccaggcacactgttgcgggcccttagcctagctacgcatccgcaccccaggcttcaaaggcgcgctgggcgctctatccactctcaccctcccttgcagacaatacctttgcccgcccagctggctccacttctttgcccctttagagtctcctgggaggtggcgttagtgcaggcaacctaaggcactctcttgttccagaaacccttgggtggggcttggagccctccttgtccccaaccactaggtcttcccgacccttgctacatcaaaggggctctctcgcttgctctccccgtctccctttccctttctttcattgcaacccccaattttgaaaggcagtgcaatgtgtctgaactccaacttccctgttgattgaccttggaaaactcatgtaacctctctgagcctcgatgttttttctttgtcaaatgactcttagatcaacactcctgccagtttcataggactgttacgagaattagatgagatgatgttgaaagtgaaagcactttatcaggtccaaatagctctttatccgccaggtattattagggtttcgcttttgcactgatttcctgtctgtcactggaactccatctgtgacatgtcttaccgacgtcaggctgtttcttctccccgctggggctctgttgtgcctcaggtttaatggatgtcactctccttatcgcctccaacacctgtgcgaagctggaggcaccagtcagggtagggtaagcgagtgcttggagaggtttgctttgagagattggaaggggatttcgtgctgggctcaccacaccactccgcttgggggcttagtggggatggggctgcttcccacgcttcttgctggaagttgaaccccgaaggcagcaggtagaccttgaggggtttgagaacagcctggaaaagaaggaaaatccagcagcacctccaccctcagttgtgactcagaggaaaggtgcttgattccatttacctttgcctgctccagacccaagatgtcagagggaagggttaatgaggggcaggttgggaagaggggccagggatgaggacctgaggcgcactattgtcttccccactccccggtctgactgaagagcagccatgcgagcccgatcatctagtcaaatactatttttcacccaattaattcttgaactcttccacgaccccatttcatgccagtttattttaagctgccactaggctggagacccgccaagaaattatgagacgtttcggtcccagatgcctgtgttccctttctgggctgctgtggtcgccctttgagtctgcggggcccggccagtgggtgttgggcagctcgatcggagcctggccctttgcgtgtgggtcagccttcacccaactccgaccccacctccggagctgccgggcgggggtcgcttacgggcccggaggggcgccgggtgccccgcctctcagagacaccgttccatatttgaagccaggagcaggaagggagtatgatgggggcttagagtatatgcctgtcggctcacagatttggctcctagctcctttcaggaagtagcttttaatgaagagctctggcaaagtcctcatcctcccccaagaaaaccattgtcctccacccatttccccgcggtcggaacctccctaaccgaacctctctccctctctctcgtcctagcgtacgatacctggtgcggcgtggcccatggatgcaccagaaaactggggctcaagatctgcggtaagtgacaggacccactggggcccggctgggtggcgcggcgggcggacctttggggcttgggagactgggacgcaagcggagggggatccgggctcatgggtctgattttctaatgtaattacagccaggacagccagcgaccacgctcccctacaggccctgaccctcctctgcccgccccagacctggtccccaggggtcttttcctctggagtccccaatccccaacacccagtggagcgaacgccgggtgccctgcctgggcgcagaagcgggaggaaagcgcccccgcgcggcaaccccgccttcctagccctgcgcgcaagcagctcccacccggtgccgtgcactctgcctgcgcgtcccaaaggtcgcgtagaaaaggtgaactgatctggcttgctggagagcagaccaaaggcggtgtatctgcctaaagctgtagctgacacgtctcccccatcccctacatcatcgcctacccctcactcgcacctccacccgcgcagtcgggtcgcattgaaagtggtctctccaccttgaggggttttgccctgagatgtcataacggattcaagtttctttctttggggcttcggaggctaaagaaaaggattgcctggagccctccatggcctgcctgagggaggcacgagggtttgcctggcgcatccttgaaggcgaggagggaagggaaaggggacgagcagggacgaggagccgcaggcggcgaaagaaccgggaaggaagaaaatagatcagggagctggagaggagaaagaactgctctctggagacaggagggtctgaaatgaaaacgcccaaaggatgtaatttttttaaaggaaaaagggagatttgttcgaagggacacagctgagtgattctggctgaacaatgaggcctcactttcctggctacatttcaccgactaaaattctctagccttatcgggccagaaaatacggatgtccccgggcagaggttggagaggcgggggaagattaacgggcggcttattaaagagccatccgtcagctcctgcgcgcgggagatagcggcagagcaggcacgggacacgcccgcccgccctagccccggagcgccgagagccgcccgccgcctgggtgctctctgcacctgatcttcccagcctccctgggtcccggggcgagggcggtggcagtttgcagtcagagcagagtggccgctttggggaactactcccttccctgcttggccgcgccgcgccctccctgcatttctggggctctgtcctctagaccctgggactcggcgtttagggaggaacaggcgctccattcctagacccagccattttccaccgaaagcccagccctgccgccgggcggcctgggagtttggccttctccccagcgcaggacgcccgtggggcaaggccagggctgcatccctgtgctggggcagccggcggccgcggatctttgttctataaatagccccgtcccactcccacccccacctccacccccaccctgccgccattctgggcttaatggcccgtttcgcgccaggtcccttcggcggccgcagcgctcggcttctgcagccgtcattgtcatgcagccagccgggcaggcagaactgagcgagccctgggcagccgaggacagggtaggggcaggctctgggcgacggctccttaccagcggcgcctggcctgctgagggtggggggcagccctcattcacccccatcctgccccctgctgtcccctgctcctctggctgcaggcgctccacttccgcgggaataaaaggtctaagtgcttcttatggggacatacccgacgagttcagaaaggctaaagaggcgggaaagagtggggcttcgctgggtccggaaatagggaagccggagttggcctccactccccctcccccactgtcagccgaagctaggagggagagctcctgggggctacagtcctcagagagtttcctccctgtgtctgctccccacaacccatggtagtctgttgaggagaaattgccttgggctaaaatgccccgcttttggggccacaggttaggaggcttcccattaggtttgattgtgaaagaaaacaaaacaccaagatttattttccacaccttgagacaactttggctttccattttaatctagtggaggcagagtgcagtcttttgtgttggccctgggtccacagctccctgcctgcctacacacacacacacacacacacacacacacacacacacccctcccttcatccctggagggatggacctggagggtcccttcttgacttgacaccatccaggttggtttaccctttcacattaagagagcagaggaactcatggtcctcttcccacttccaaacccactgccctggatgactctcagaagcaccctcagtgccttgccaaaattcaacccccacccactctccccctgcccttccccaaaatccacagaatgaagctgcaaggaaggccctgggccccactagtggtagccctgaaggcagaattagctctggaggcagaatcccccagggagagtaatcagctagaagaaacccatggtcttgccaagagctggagagtgctgcaggcatggtggcatgacctaaatacgatgagttgcagggatccctaagttctggctccaggctctgctaacttcccagggtgtccttgggcttccatcacttatctcttgctgccaactacagcccctgagctgttttatttagcctacactcgtgtgtgtgtgtgtgtgtgtgttatgtatgtgtgtgtaattttgtatcaagtgccaaaccttaaaaatagagagatttcaagtgctctctttttctggtttctcttgaaaaaacttgggggtgggcaatggggagggaaacatggcaggtgctgttagcccaagaaaatcagaaaaagaagtcatggtggctcacatctgtaatcccaacactttgggaggccaaggtggtaggatcatttgaggccaggagtttgagactagcctgagcagcatagggagaccccatctctacaaaaactttcaaaaaattagccaggtgtggtggccacatagctgcagtcctagctactcaggaggatgaggcaggaggatcgcttgagcccaggagtttgaaattacaatgagctatgatggcgccactacactccagtctggacaacagcaatacagtatgaccctgtctcaaaaacaaacaaacaaatgaaaaagagcccctccgtctatgcatatgcaattccatgccatagcttggtgaacagagagtgtgctgggcttcagctcccacgtgccctgttggccataggtgtttatgccatacacagctcaaagccccacttggcaacaactggctggagccaggtgctttctagctacacatacctgtgcgcacatgcacgcacacatacacatacacactctctcactgggccccataagcctttgagtttggcagcaggggtgaggaacctgcagcaggagctcccctcagctcagaggtggagtcatgatttttctccccttgcggctggccagtgtgctagcacccaaccaaacacaactgcagctttgcctctcctctgctttcctctttgcctctaagaatgtagagctctgtgaccagttacccacaggcttaaactaggtcctcgaagctggggtgtagagcaagagggagtacactcggcttcattctctgggaccccttcttacaggaccccttgctagccagggaaattgtcaaggcactgacctccatgtcatccaccacctcttcatccttggagaagcagttccttccagggcctctcagagccaagggaggcctggttcacctacctttctgaggatcccagtattttagagaacaaacaccttcctaaacaaagtgaaagacatgtgacaatatatattatatgtttatattagcaaattaattgttttaacataaattataatgcagtgtaagtgtgctattcataaaataattacaggatttagagaggattctgattcctagtacattactggaagtgcagcccaaggaatgggatgcaggtttaaagccgtgtcgtagggccgggcgcagtggctcgcacctgtaatcccagcactttgggaggccgagacaggtggatcacctgaggtcaggagtttgagaccagcctgaccaacatggcgaaacccccatctctactaaaaatacaaaaattagccagacgtggtggtaggcacctgtaatcccaactacttgggaggctgaggcaagagaatcacttgaacttgggagctggaggttgtggtgagccgagatcatgccactgcactccagcctgggtgacagagcaagactccgtctcaaaaaaaaaaaaaaaaaagctgtggcataatgatcgtttctcagcctcatgagcgcatctctgggagagcctgtgtcaaaacctcaagccgagtttctgcttcctgcagctgcccagagggaaggggcttcaaggtggggagactcagggagtgagtcagaagcctaagcaggcgtcggggacaacagagtggaggttcagctgggcaggacctcactacatgaggccacatgggtttggtctttcaagtctggcaaattccacagctcaatgttctgggatgagaggagcagtctcagagttcaggtgccatctgatcctgcatccctctggcaaatgagtgctggctcctggctctggactttgaggatttggaggaggaattcaggaagtaggcaaagagatatggaaaaggatacaatcccatctttatacccaagtgtggagctctattatagtgtatttccccccttctcatgtcctttgggctttagtgataaatgtaaaaggtgctgggagcaacaaaaagcttggtggctctgctttccccttcttccctccagaaatagcccctggctcccttgtgtgggaggattctaatcaccgcagccctcccatgcatccccccttctcccacccatcacagttgaattgtagtcctgggaagcaaagctgaattctccagattaacttgcctttttgcacctcttgggactttcttccaagtctgccttgtgacacgtgtgactccgcaagtttcttggtatttacagaaacagctttggggtcaccaagaagcttagaacctttttcctcttttcagtgtgctgcattttgggctaagactgaggctgaattgaaggaggagaagccaaaggaaagagcagacgtgcgggccaggagccccacaggggatggtggagatgtggagggagtgtgctccacgctggcaggttctcctgcccttttggcttaaccctctttccccgtttgctgccggagtttgtcctgctcaccttgggcaggagaactttccactcactccgaggggcagaggtgaggcactgagaatcccgccctgggctcagatccctcctgtcatctctgtggagttcttggatgactagttttattccagcatttgtcaccatctgccaggcttgtaggctcctggagggcaggggatctgtcccactagctttatcagtccccaatcctagatgcttagcaaagtgtttttgtacaacaggtgctcaataagtacttatagaattaaatggcaacacagaagattgaagctttttttggtctcacagtaccttcattcaaggagagggggtggtgcaagaaaagctgcattcaggtttgcattcagaaaaataccacttacgttcaaccctgtgagcattacctggtgctggaggaaagtgtctgcccgaatcctctgtgttggacctcactccttctccttctgccatcctcacccctcctccttctgctgtcctccctctgctgtcctcaccctcctccctctgctgtcctcaccctcctccctctgctgtcctcgccctcctctctctgctgtcctcacctctcctctctctgctatcctcacccctcctctttctgctgtcctcacccctcctctctctgctgtcctcacccctccccttccctctgctgtcctcaccctcctccctatgctgtcctcaccctcttccctctgctgtcatcttcctccctctgctgtcctcatccccttccctctgctgtcctcaccctcctccctctgctgtccccaccctcctccctctgctgtcctcacccctcctcttccctccgcggtcctcgctgtcctccctctgctgtccttgatctcctccctctgctgtccttgatctcctccctctgctgtccttgctctcctccctctgctgtcctcaccctcctacctctgctgtcctcaccgtcctcctctgctgtcctcacccctcctcttccctctgttgtccttgccctcctccctctgctgtcctcaccctcctccctctgctgtcctcaccctcctcccctgttgtcctcaccctcctcctctgttgtccacacccttctccctctgctgtcctcaccctcctccctctgctgtcctcgccctcctacctctgctgtcctcaccctcctccctctgctgtcctcacccctcctcttccctctgccgtcctcacctctcctccctctgctgtcctcgccttcctccctctgcggtccttgctctcctccctctgtggtcctcactctccttcctctgctgtcctcacccctcctcatctctctgctgtcctcacctctcctccctctgctatcctcatcttcctccctcagctgtcctcacctctcctcctccctctgctgtcctcaccctcctccctcagctgtcctcacctctcctcctacctctgctgttctctcccctcctccttctgcttatacagcccataaacagtgctggcagcatcttctctgattgtgtctcctcctttaaagccctatcctggggctggtcactggagtggaagctgtccaacttacttaattgtgagttcactgtcacattcagagaggagaacgggcttcacttactgtttttctctcttgcatgactgggcctctgccactgatgacatttggcactgcccccctccctgcctgaaggcgagcagtgccagagccactgtatttaaaacacagacactcacttcttttctcaggagaaacaagagccctgcttggagagttgattcactctgcagctgaccctcaggggctgggcagtttgcagcactctctctgaccagcttcttgtgccataggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagaggtagcccctgccccactcccgccccatgctagccagtagatttcttatttgagtttcttgactttttcctgcaattttacttcttttatcaagaaatgtcattattctctctgaacccacatgaaactgcttttgtgactttgggggaatataattgactccctccctccctgctggccaggtctccatcattttggaaactggatgaaggcagtcaataaaagtcaactctaaagacactcgagggaacaaatatggattcatagactctcagagtcaaaggaaccttgcatataagaaaatctaatgatttccttaataacgtttatcctggaagattggccacacacatacacacaaaatcacactatgggaagttgcatgctgagcctcataaccaacgagtgtcctggaacttgttttcctttcagagatgttttactaacccctgctgccccacaacactcatctcaggaggtgctttaccagtctctcccaaacagctcataggtagatccgcttccatccccttctgtgaacttcccacagggccacagaaggcagaccagagtattaaacaatatgtcactaaaaccctggagctaacccaggaagtcacagagagtatcgtgcacaactgcacagcctgcctgtgagctacagaattgggcccctacagcttttttccctgcctaacctctagcctgactactgcagagcctgtcacccaaagtcacctctggatatctcaaagtccaggcccaaaagggtggggtcaagaaagaggcaggggttccctgtcccaccttcttgagccccatcttccagctccagtttcctgtcgaaggacaccgccaaggaccaccctcctcagggggaaccccagcctctacccacagaggccttaccctctgatgccaacagaccaagcacatcacaacaccaaaccagatagacagggacacacctggtcccaggggagcacgacagatgccccctccatcacactcctcacaggtgcccattcaacctgcagatgacaaccgcagtcgcaggttgttcacggcgtctcagagcacttcattccatgtctgagcagcctgtcagaaaggctgtgaacccccaggaagcatgtgcaaaacttctgtgtatgtgcatttttctggagatgtggtatatccgattctcagtgcacatacatatcccagaatgaaatcaggcctatacagatagcatggttaatattaggggtctctgggctgaagaaatctagatatgagtcaggtgaaaaccattcattgctctccccaattcagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtaaggaggagagttgggtagacaggtagtggcaactttgccctccatctcacccttgccagttgtgaggatatcaaacttgtgttggaagaaaaacacagccctggtgagataaggcggcaaagtacccagtgaccacaagaacaagcttgggcagtaacagttggtggagggacccgacccaggcaaaagttcatcagcatatatcatggtaaaagtagataaaaaagatataaatgcttggtgctaggtcaagttctgtataaagagttttcattctggccaagcacaatggctcatgcctataattccagcattttgggaggccaaggtgggcagaacacttgagctcaggagttcgagaccagcctgggcaacatggcgaaaccttgtctctacatatgtgtgtgtgtgtgtgtgtgtgtgtgtgtgtgtgtgtgtgtatatacctatttttatatataaatatttatatataaatatttaatataataaataaataataattataaataataaaatttaaaaataataaattataaataataaatataaaaataatatataaatatttatatataatatttatattatatattatatataaatataaattatataatatttatatatatatgaaaatgagctgggcatggtggcgtgcacctgtagtcccagctactcaggaggctgaggccaagaggcagaggctgcagtgagccaagatcgtgccactgcactccagcctgggcaatagattgggaccctatctcaaaaaaaagaattttcattcttggatttaggctattcacaacctaaagagagcagaatgacccatcctctgcttcttttcttgcctccattttcaggtctatttcattctgataaatcctgcccttgcctgtccctgacactggggagaattgggctatttcctctccctttctgtattagtttcctaggaatgccattataaatgaccacaaattggatggctcaaaacaatagaaatttgttctctcacaattctggaggctaggagtttaaaatcaaggtgctggctatgctctctctgatggctcttggagaggatccacccttgtctttaccagcttccaggtgttgtggatattccttggcatttgttggcttgtagatgcatcgctccaacctctgccttcacttcacatggccttcatcctgtgtgtgtgtccaaatttctctctccttataagaatgccagtcgttggattaaggcccaccccaatccagcatgacctcatcttaacatgattacatccgcaaagacccgatttccaaataaggtcacattcacaggaaccagggattaggacttgaacatatctttttgaggaacacaattcaacccatgacaccttttaccagctaggccaaaaagacacatgcacacacaggccaaaaagacacaggcacacatgcgcgcgcgcgcgcacacacacacacacacacacacacacacacatacacacatgccttctcattctactgcaacttctggaacttaggacactctgagtcaccaaattctatttccagtgggagtccttgaggatgtcctcttgcctccttttcttgttccaggagctctctctaatcagcaatcctcatcaaagcagttgctttccaattgcctccagttcaaggactttggggcctctgtctgagatgcttagaaacagctcagactgtggactaagcccaggagtgacacagtggtttcttctccctataactctctccacactacagtctggctttcctgagctctcaggcagacagatctagaataattgacagtccctagcttagttgccaccacaggggaagccccaaggccacaactggcaatcctgtgttctttcttcttctttgtctctccttctttattttccctctcattcttcctcgtcatttgaagatagatttaagactgagactaggaggctggtggtgatagagctgagtaagactattggatgtcaaaaacaaagtgttataatgaaataatgatgctggccaaagatgctttttaaaatgaggaatcccagagagctgctgaggtctgccaacaccactggaataagtgcagcttcattaaatgactgatggatacacaagactcagttatatgtacaaaatttatgttgtttgatttttaaagaaaagcactctatcaatttacatttagttacttctcatcttggtcagatggctaatatattcctaatggaaaacaaatagtgttattcggctgcattttaaaaagagtcagaattccccatgtatgtttagcttgacttgctttggtgtgatattttgaactttgccagtttgctctacatgcgctttctcagagagatgagaactacatcattttattatgaaagcccagaatggcgttgtccctcaaataaaaatacatgattttgtcataatatcaactaatattatctacaaaaccaaagcatcttgtggtcagagaaagcactgacgggcctggcctggtggctcacactcgtgatcccatcacgttggcaggctggcaggtggatcacgcgagctcaggagttcaagactaacctggcaaaaccccatctctaccaaaaatacaaaaattagctgagcgtggtagtgtgcacctgtgatcccagctactctggaggctgcagtgggaggatcacttgagcccgggaggcggaggttgcagtgagctgagattgtgccactgcaccactccagcctgggtgacagcaggaccctgtttcaaaaaaaaaaaaagagagagagagagagaaagcattgactttcattagtccagtgtatgaacccacttaggtacttagcctgcaaacattcatttttgttcctcagagttgcttcttggggcagatatttgtctttacagagttcacagtcttccaagcaatatgaaacctcctgctatatctcaggattttggccctgataaaagcatgctgttgctgccgtgtcaaaacagctcctggttgctgatgtggaatttaagcatagataaggagcaatagggtaaaccccacaggtagctacacacagtagaaagtattttttcaaggatattaatgcattaataggctcagccaaaataatgaattgggttttaatagtgaaaacatactgatccgggtatagtctgtgaagagatgatgatggcatttagaaatttctctataaattaataaaagacttcttttaaaaaatgaaccagcctatagagatttcccatgaactaacaggcaccagtcagccttcagccacagcagctacttaagtgatttgtagatatgctggactcccttcgttgttctttttaaaactttttcttatggaaaattttaaacttatacaaaagtagaatcctataatgaaccctataaacctaatgccctgctttattatcagcttttacctgtaccgccatccattccccatcacctacattacatgaaagcaaatccccaacataatattattgtatccataaatattcattctttttttttttttttttgagatggagtttcaatcttgttgcccaagctggagtggagtgcagtggcgtgatctcggctcactgcaacctcccctcttgggttcaagcgattcccctgcctcagcctcctgagaagctgggattataggtgcacgccaccatgcctggctaatttttgtatttttttagtagagatggggtttcaccatgttggccaggctggtctcgaactcctgacttcagatgacccacccaccttggcctcccaaagtgctgggattgcaggcatgagccaccgtgcctggcccaatattcattcttaagaactttttttaaaaaagtccacaatgtcattgtcatacctgaaaagaaaaatttatagctccttaatgaaatatttagtcagttttcaaatttccaattgtatcatgaacgtcataaatgcttttagttaattaaactcatttgaatcaggatccaaataagtttcttacatgcagttgtttgccttgtctcctaatcaagagatctccccctccaactcttcttttttttcttgtagtttatttgtaggaaaactttgctttaaaaaataattctttccttctccccctacctgaatttaggccatgagcggcccagcaccatatctatcatctgctactttcatccaatatagagaattgaaattcaaattgaaactattttgttacttaatagaaattctgatagatataagatttgggggcacaaggttgtaaccataagctaaaaataagattttgaaggactttgtgtcctttatattttaatggacaaagagatactatttcactttgtgttaatctctctgtctttgtccatcttttgtttctgccaagctgtatggttttgatacattatcaaatagtgtgattgcatttatttaccattcagtcttgtcttaaaatgaagtgttattgttaaaagtttttaaatggatattgcatatatattttaatggctttcaatacaatgtgttgtttcaaaagacctcagattctgttggcaatgagcaaagtagagtaacatggaatcatttaactatctaggatagtccacatgaatatctagaatatggccccatacttaaactaagtttactagttatgcttcttttagttttttctaaaaaacagtattattttgtgagggctcttaagatgcagagactggtatcttctgatatgagaagtcatagtccagatgttctgaatcacatctagggaagaatagagattctcagagaggagagttagaccaggaacattctaacactagctctctgaccgtttttggttgtttttctttttttttttttcagaagcaaaggcaatttccactggaaacacagcagtcagcatatctttctaacaccagttcccagccacacgtccctagataatctattgcgttgactccttcctgacagctgagccaagcctgctgatgtggagttgagttttccgttgaatgctaagttggcaaaaacttggcaacaatcctgaatttgctgagagcaaagcctgttaaagcatactgtgggttgcacagggatttagagttacgtagcaaaagcaattatttcaccaacaactgaatgagtgaaataggctgcccatttcacagaggagagctaagttatctcagccataaatttaatttgaaggtcattttactatatatatattggcaaaacacatcaaaacacaaaacactggaaagcatgatttgtttcatgatactggatattattctttaaaagcacgatgctttagaaacatagaagtttgagggacattatgaatgttaatgttggtatagggtgggtcaacctgcccttcctttttcaatatccttgagcagccttattcgacatatcactgggatggaagccccatcagtgtgacccagtggggcaggccgtttgccttcaagataggttgagaaatctgcatttgccttgatgcttttctgtttcctatctaggtcatcctcgatttttcaaccagctctccactggattggatattattggcctagctggagaatggctgacatcaacggccaataccaacatgtaagtctcatatgttttcatataagcaaccctgatgtatgactatggcttgttgctttaaaagttcagtcccagtggttctattttattaaagtttccctggtcattttttctcttaaaatctttaggtttatcacagttctgatttaatggtaaatacttgataaactattgttgaatttaataatggaatttaaggaaagcatggtcatgagaaataataactctaacttccaaaatgtagtcttgaaatttcatgttaaaagacccatttctgttaatggtgtatctaaagaggttatgttttgaggtatgatcttggttttacctttttccacccaagcacattggtccttatcatttaggtcatgtttcttccataattaaagcagccataaacccacaaaccaatttgatcaacctattgcttaactaaaaattctaaaacaaaattcagccgatactgatacagtatatattcttttcaaaataagtgattgtttttctaaatgtgacattttttcatacttgtttgtgtaggcaaagccttcctttgtttctaagttcttgaaaatttacacaaaactgactctgaggtcctgtagggtatggggtagaagtactacctgggtagtcttatagcaatcatcccagattttcctctacatgcatgtgccctcttttaagaaaatgtcagattactaatcgatggaggggccatcagagtactgcctttgctctcaacactaatgacaatgttttaccagtatctatacatccagacaatggcactacatcctattaaagtatccaaaggaaaataacaaaacaaatatcttataataatttaaaaacaactatataagaattacatgggtgtccatcactgtggaaatattcagaaaatagccactcactttttaagttcatagaaaagtagattccaaaaaatgaatttaggtaaaagggtagtattgcttaaaatgagaaaatccatttgatatcaagatagaacgtaaattactgaagtttaaggtagtctgtttttcttaaactgctctcagccagaaaacctgaagggcatttaaaattatatagtgacccatatgtattctaaagctgtttaatgctgtgactcagaatacttaactatattcagaaaagtttctattaattaaggattcctgttttcttggctaatttaaaacaacagtgacaaattttaaagagcaaatgtgacaagtgaagcctctggtggtaaaaaagcataaaagattaaactgattgaaaaactaaaacgatgttcatgctccctgcttgcaggtcatggttagcttcacagactgtccatgttgggtcactgagatttggaagagccaagaggaatacaggtcaaagatacagttgcttggaatttgaacaaaaagctccatttagcaatctttactgtactgtgatttttgagataaaaatataccagccagcacagacatcatagtagagttaattataacttgagaaaagacactaatgtttaattgtagtatctagcactaaggaacaatttaaattaggaaatatagttgttgtttttaactcaaccatttggaaaataagtgaggaaaacagagtaaaagatacatatctattaaagtccaagtacccatattaatacaagcactgaatttactcagcacctttaagtgtgtgttctgcagggcactcagctgctttttccatgtatatatatgtctccaatctcaaggtaaataacggacctcccccctttcaaccacttatgaccagatattcctaaaccagaaaaatcccacaaattctccttttttggcatgtgttcataaaaccaaagtcccttactcttctcttagctcagctgcaaaacactaaaatgtgtcccagccatctgaggtcaaggccaatccaactaaatgacatgtagtaattgcagctgtacttgaatgggagatatttataaaatatgaccgattccaacagatcgatagagaaggttatttaaaatagcaaaatagtttctgtcagttctggagacaaggcattgtctgaagaagcaataactattatctagaaattgttctaagccagttgccctggaagatcatgaaatgtggcagcactgtcaggagctgaggcaaaatttgctcccttgtgacaattccttctccagtcgggaacagtgttcaaaataagtctgggaaagaatggcaaaaggatctttctatggcagtgcaggatttatttagtgataatgcctggtttttggtcctgtactctcattgaatttaggtggcacctgacatagaaaataagaactatattcctcagtcatagcctcttaaaaagaacgatccaataacctgacacaggtgcaaagtgcaaggtgtctgactattagaatagaaagatggtaggttgggtgtggtggctcacgcctgtaatcccagcactttgggaggccaaggtggatgggtcacctaaaatgggagttcgaggccagcctggccaacatggtgaaactccatgtctactaaaaacacaaaaatgagccgggtgtggtggcgggtgcctgtaatcccagctactcaggaggctgaggcaggagaatcacttgagcctgggaggtagaggttgcagtgagctgagactatgccaccgcactccagcccgggcgacagaacgagactccatctcaaaaaaaaaaaaaaaaatctatgtccatgcctttacacctgtttctgcacatagctgtgcagtatattcttcttctaagcaacgacccagtgaagatccaaacaaaagttcacaaatatgtagttatccaaggcacatacagctcttttcttccagaacagggccaccaagcacaattgcgcaggtagggcccgagtgtaaacaacagcctgccctcaaacatctaatggcaatacataatcttaatggcaagatctatcataaccctttgctatgaggttatgatttcaagtatctagcactttattttcatagaaaatatccaggagaaattctctatgggagttattcatcattttacaccaccgggcaggtcattagataggagcctgcagtaagcagttctcgtttgtcatggaaaagcagctgtgacatagacttggaattctgcttaaacacactaactcggagatcttaaaacaaaccactgaatttctctgaacctcagttttctcatcaggaaaatggaggataatagtatccatcctacagagtggttctgaagactaaaaatggctccagtcctaagtgcctagcgtatacaaggtacagtgtttgcacctaggaaaggcaaccaccgcacagtcactgttgctatttgagactttcctgactcttttatttctgtctctcatcatctggacagtagagtgtttccctaagctcccctcagctatgttaccttttaaggtgaagatgtactacctgccacatctgtaaggagaagtcaagaggagtatcaggatagagtcagcatggaagattatttctctcattaaagaagttcccagtttgacagtcaccagggatccagattttgtgtgcctttctaatccctattgtagcacatggctcccatcctcaaagttgcattatggtgcagcctggctgctggagctccagccatcactccggtgttccagaactcagaaaggaagggagggagggaggaagggaggaagggaggaaaggagggaggtagggaagggagggagggagggagggagggaagggcaaaagagacatactcctctttgattaaaaaaaaattaaaaaaaaaaccttctcagaggtctcacacatttccataaagcctctttagccagaacttagtccaagaccacaccaaaaaagggtagaaaatatagtcttcgatcagagtgaacagcaaccctaaataaaatttaacaaagcaagggaaaattgatatgggtagcaacaagcagactctgccacacaagaactacagcttgttgacagtcaatttgccttcgctctgagtgaactcctccgggaaggtgagttgaaccactgcaaaagggctgactcacttccctactcggaatatagacatgctcagaatgctcctctagtgtcactccatgaatgccaccatcctactgttttaaatctttacttccaatcccatgttcttatgcttcaacccagagcttctggcaggtttagtttctggttctgactctgaaatgtaatcttgtactttgactttagcatctaacctgcttcttctgaattcatatttgacctttgatctcttgacttcatttgctttcctcagtcatttaggaaaacagtacccaacctggaatctaggttgcaagagaagaatctcctatagttctatacaaaatgatgtgcctatcttcattttttacttggagagaaggactacagatttcctaggattcccaaagggatctgtaatcccaattaggtgaagaaccactgggcatggtggctcacaactgtaatctcagaactttgggaggcaaaggcgggaggatcgcttgaggccaagaattgaagaccatcctgggcaatatagtgagacctccatctctacacaaaataaaataaagttaaaaataagaaatttttaaaaactgctttggtgaactacaaggccttctttaagagtgcagctgcacagattgtaaacatggcccaggatggggcagcagggtcagaagaagtgtcaggaatgaagaacaccatgtcagcccatttgtcaggcctggctgtggatcagcagccatggactgatatactagctttcaggagagagtgtcaggcctaagctaataagtcaggaaaagagtggaaaattggtcctttagactcaggcagggactatcaaacaggatacagctaaggccaagaaccagatgctagaatcatcctagtaggtttcctcctcaaggttgagaatggtgtcttctaatatcttagtttccttagtacataggatgtcacctggcagagaatagccactcagtaagtatttgttgaatagaactgaaagaaagtttaggaatcaggtacctggcatagataaggaacctgaaatagattagatcagttaagctcatgataaactctctagactcttcctcctaatcctgagagtaatggccatgttcctggtccttggggaggctaattcatgcaaaccttgggcctaattggttttaaatctgaagcatggagtgggacctatgcctgatattcagtcccattccctctcccttgtccatgtggttcctgcctggccaacactgacttgatcctaagccaactttcatccagtctttgatatggttctgatattacggtatgtgatttcatttgttccttgccttaccccagagagctttcttatatagtactgggagattctagcacagacactgccaccagtatctcctcgccatgcaaacatttttgtcatgtcaacatttccaaaaaccagtggaaccattaataacacatttgttcaagaatggttaaaagcccatcatgagtttgcctcttggtacacttggcagcacaggctaaaccaggaatccttctcttcttcttcctttatcaggccatcagacatgagggagtgttggttgctacggtgatggggctcagagcagaaccaaagcatgattgtgacctccagaggtgatggtaactgcacacatggtttccaagggtcttcctcctaaatttccaggggcctcccaaggaaaatggacatattctttttggaaataaaatacttctaccaacatatctgaggatccttcaggatctttttgtcttcttttacctccatgtgattaatttgactgcttttttcatccacaattaaaacttagtagcttcacctgtgtcttatgtaaaacaatagttatctcatccttacaaatagctttgccttacattaagcaagcaagaattcccattagtcttcaacattagcacttggctcaaacaccctaaccagtgataaagcttccccatgtcacttagctgagtcagtctaggcatctcttttcggtgaggatgatctgagcccagcctacagactctaatgctaaagaatgccaagcaaaaacaagaaagacaaaaagcctcagagcttagtaaatatctttttgttttctggcttaattttctgtggacagaccttccttgatttttcttaggccccacgtttggtctcacgatcttgtttcaatgactagtctaccagactatgcctctgtgttgaattgctttgaaaagagcatggcttgctacttttaaatcagtttcttagaagacaaatgtaaccttccaagatatctgatgcccacagctagttgtttatgccagttgaccgtcttcttgttatttataatttgtaattagaaaatcatcacttagaattattcttgacagatattgacttcagagaattatagaaacatagctgtccttgaggattattacagaaaaaccatgtagataattatattgagatctttaaaacctgggtcaatatttccaattatcttcacagttagccttcagatgtttacattatttttaaaagatagactttggctctggcttttatatattctacaagtgtgaaactggcagtcagcttttttttttttttttttaaacaaattgtaaaccaattttacatagaacttggaatgcttttttcaattaacatttgcattgtcctataatcttagaggtaaaagggactcagaaaagtcattttctttccttctattcctctgggtggaccatgcctaagacattccattcagataagaatctattttgttggtgaagtatcacagggctggcacttccaccacctctctcagtaacccaggctggtttctgacattttatgatcggcgacttaatgcatttccaggaaatgaatcatgttagtggtttggaacagcttttttttagaacccaactacaaatactaaaccaatcctctgtgttcctaaaataagtggtttgacttctttattttctttcatccttcttcttaccacctttccaggtttacatatgaaattgcaccagtgtttgtcctcatggaacaaataacacttaagaagatgagagagatagttggatggtcaagtaaagatggtgatgggatattttctcctggtaggtttctcttctcttcctcttctcaaggtttgggattcttaagaatacaaaatatgaagtaggtttatggaagaataatgccttaacattttttttggataccctgacttcctattttttcaagatgaaggctaacaaaaatgctacattctatatgaattaactaacaaaggctatgcttaaatctgtaaaaactgacaaaggctgtgtctagataatgctaaataaccccattttttcttttttctttttttttttttttttttgagacagggtctcactctgtcatccaggctagagtgcagtggtgtgatcctagctcactgcagcctcgaactcctgggctcaagcaatcctcctgcttcagcttctcaagtagctgggactataggcatgtgccaccatgcccagccgttttaaaatttcttttgtagaaacaaggtctcactattaaacaactccattctgtcaacagcagtttgattatgctggggatcagtgaatcaagattattaattaattgattgatttcagccaaaatagtatatctactttgaatctctagtttgaagtagataaaataagaatttttaaaacaa

SEQ ID NO: 17169 - DNA, 28129 bp, Human; identical to SEQ ID NO: 17168

SEQ ID NO: 17170 - DNA, 197132 bp, Human
  misc_feature (1)...(197132): n = A,T,C or G
ctcaaaaaaaaaaaaaaaaaaaaaaagagggagagagagagagaaattgagattcattcaaggaaataccatgggtagatccttaatatccaataagaaaaatgatttggagaacattaaagtttacatacattaaaaaaacccaaatgacactaaatgcatgtgtctataaacatgtttaagcaccgtaaaactaaaaataaaagtggactagaattacacttttatttttataaaataaaattttatacccataaaattcatggtagaagtggcctacgccaagggaggaaaatgaagcagggaggaaagaggaattcaattctgtagtatttaatttcttatgaaaaatctgggacaaaaatgaaaaatgttaaatttttaaattcttggtgataggtcacaaatgtttgtttcataattacttgcactttttgaataaaaataaaatcttttggaaattaaaaaaattggcgatttgtcatggtgattttcttaaaagactaaggtgtctagtgggatacagaagactcgatgattttattttattttaggttttttttttttttttttttttgagacgcagtctcgcaatgtcgaccaggctggtgtgcagtggtgcgatctccgctcgctgcaacctctgcctcccgcgttcatgcgattctcctgcctcagcctcccgagtagctgggattacagctacttgcccgccaccacgcctggctaactttttgtatttttagtggagacagggtttcactatgttggccaggctggtctcgaactcctgacctcgtgatccgcccgcctcggcctcccaaagtgctgggattacaggcgtgagccaccgcgcccggccttattttagttttttatgtcaatttttgaatttgtaattgggtgagaattaaagtgttataaatttcaccttaagtgaaaatttattagttttctaatgacaaaagtagttacatctgacgtaaggggatttaattatctttttctgggcttgcgtcccggaacgctgctgcattatgtaatctgtagtaatatacccacgagcagtttggagggttctgggaagcacatttgttttgcttacctaccatgggaaagattccacgtggtcctagaagcatacgtattcgtcggttacagtattttaaatattcactggccgctgaaatttaaaatggatgaaaaagaaattctcttaagtagcgttcttgaaactgctttatcaaactcagttcatattttcagttggagttcgtgatgtatgtgaatttcctttaaataaaacccgaatctttagtaatacaaatattgggaacttcgattactgtaggtcttagggtagactcgcttggactttgactaaatactatgctttagaaatttatctttaggagataaatttggggggtttatctttttatatttgctttgtttcaatttatttaaataaaagtagtctttctagaagtatgttttatagtaccacttacctcggttactgtcccagttaagcagttttcacgaatgtggaaaaatagtagtgtttttctttcatacacgcgtatatgaaaaatttttacattgatagagaattattcgtaaaaattaaagtaaatttactgttagtctctaattttgttctgagatagccacgctgtggcattaagaaggataatcaaggaataagccataatgttcagaaaggggctttactttttatttttaatattattgataaactttgtttagtcgaattgatgtctgcgtgtcttcccccgccttccccataaaacagcgggacagaaagtcctgaaaactccaaaagggaaatatttactcagaggtctattcaaatttgcttagtctctgacgttttcctgtgtcgtacaaatccctcgtgcggcaaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattggggtgagtgggatctgagaatgtaccagggtggctcgggttcgcgtctaaaggtttcttcctccctacttccgcccactcgtggtgacaggtgtggaccaaccctgcctggggagtgaggcccctcgtcactcctgttcgtgcccctggaagagtctgggagtatcgttcggcttctgtcctggccacagggagagtagaatattgtctaactggagttaactgtcgtttttcactattcccactggggaagtaccgggtgatctttttgtgtggctaacactggacgtctttaggaggtttagagcaaaatggctgggaccgccaaaaaggctacaagctatttcctgagtgtgaaatgtgggcggtgagcacaatggagtgggtttttgtgtgtttggtgtatatgagagaatgtggttatatacaagaaattctaatcttacagcttttactattggtttaagcctgatgtccgtcttggcagaaaagcaaaacacccaagcacctgacctcgggtccctgcttagctacacctaatacttatggtgtaatcctgactgctctccagatacagctcttaattttcttgttaatggatattttgtttggttttggtggtcaggaagggtggaatgggatgaagtggaaatgagaatgaagaaactttgttatctaagtatttagaggagacttttattctcctcttgattgcaagatataatagtaatattgttcttaggttccaatatgaatttgggattgtgtaggttcccaaatgggcccgctagtgagcctacaccactcatcagccttggaactggggggaacccagtttatctttctcccttggatcagcattctcaatagcaggagtggaaggaatctcaactttttattgaacaaagtcatttaattgtttcaaggacagatgttctctaaaactatattctattggagatttattttaatccttgggtagattttttaagagttgctggaaaacttaagattttttattcccattttcccaagccaaatgcattagtgacagtaaccatttatttagctctttgtgtcagggaccctgttaaactcttgacatgaagtattttgtttaatcctaccaacagtccaatgaggtactgtttattttagagatgaggaaactgaggctaacagaatttgtgctcagattcttagagctagttagtggcagaagaaggatcagaccaggtttttctacctccaaagtctgtacccctagcatctattctataatgctttcctaactcatgtctacagattttattcttcctaagatccctggttattaataagactacttgaatatattgggtagttatgatttattttgtcagctagtcagctattatattttcatgacatttcttttctttacctctttttttgagatggagtttcgcttttgttgcccaggctagagtgtaatggcgcaatcttggctcaccgcaacctccgccactcgggtttgagcgattctcctgcctcagcctcccgagtagctgggattacaggcatgcaccaccacgcccggctaattttgtatttttagtagagacgaggtttctccatgttggttaggctggtctggagctctggacctcaggtgatccgcccacctcggcctcccaaagtgctgggattacgggtgtgagccactgtgcccggccagtgacatttcttaaagtataactgtgggacacttcctggtagcataattttatgtcgtcttctgatacccaggctgcattttccagacttatctgatcacttgacttaatgttctctaacagagcattcagttctttgtagtcagttcaccgactcacttctatcgggtatcctgccctgtccctccctgaatgtgcccatttccattgttttccaggtttcccttttcaaactgttaacagtcttctcttctttgaagactttaatttaattccttaggtgttcagtaagtaggatagattttgttggcaatagagtgaaacactactgtctgatagtgtttcgttctgtgacagttgctgttttggatgttcaagtacttcactgatttacttgattttgttgttgttgttgttgtttcttttagagacagggtcttgctctgtcgcccaggctggagtgcggtgatgcaatcatagttcactgtgacctggaactcctgggctcaagtgatccttccatctgagcctcctgagtcgctaggactacaggtgcacaccgctaccatgcctggttaatttttaatttttgaattttttgtagagacaggggtcttgctgtgttgcccagactggtctccaactggcctcagtcatcctgcctcaacctcccaggtgatgggattacaggctcaagccactgtgtctagccttgatttttttttaatattagacactatctagttaaaatttaaaaatcagattatgtaattagtatgtcctgtgattttaacaactctaaataatttaaataaagtgattaactcagaacagcctgtgagggatgtgctttcctttttctttttaacttaggtaatgaaatttagagcaagagtcttcaaacattttctgtaaaggttcagatagtaaatattttaggctttgtgattacatggtcactgttgcaactactcaagtctgctgtgatagtgcaggagcagccagagacagcataaacaagtgagcatggctgtgtttctataaagctttatagacactgaaatttgaatttcacataattattttaaataataagcctacttttttagtataattatagatttacacaataattgagcagatagtacaaagagtccacatacttccccttcatccccagcttctcctattggtaacatcttgcattagtgtggtacattggttacaattgatgagccagtattgatacattattattaactaagcccatcatttaaagttcactctgttgtacattctatggcagggatccccagccttttggcaccagggactggtttcatgaaagacaatttttccacaggaggtggggacagggaggcacaggaaatgttttcaggatgattcaagtgcattacatttattgtgcactttatttgtattgttattacactgtaatatataatgaaataattatataactcaacataatacagaattagtgggagccctgagcttgttttcctgcaactagatggtctcatctgggggtgatgggagacagtgattagatcatcaggcgttagattctcataaggagcgtgcactctagatccctcacatgtgcagttcacagtagggttcacactcctatgagaatctaatgctgctgctgatctgacaggtcgtggagctcaggcggtaatgcaagtgatggggagtggctgtaaatacagatgaagcttcgctcactcacccacctgctgctcacctcctgctgtgtggcctggttcccaacagggttgggaaccactgttctatgggttttgacaaaggtataatgacatgtatccataattacagtattatatagaatagtttcactgccctaaaaaagccctatgctctacctattttttcctccttcctcttccctacctctggtcaggtaaccactgatcttttcactgtctccatggttttgccttttgcagaatgtcatatagttggaatcatacagtatgtagcatttttgaattggcttctttcacttagcaatatgcacttaaggtccctccatgtcttttcatggcttgatagctcatttcttcttagcactaaatagtattacaaaaatactatttacagtgttacaaaaaatagtatgtatgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacatggcactgagagagagaatcttcttcttcttataaggccacagtcctatcagattagtgccccactttaatgacctcatttaactttaattacctcctaaagactgtatctctcgatatagtaatatttggggttagggcttcaacatacgaattttggaggacacagtttaggccataaattcacagtttgcttatccacttacctattgaagcacatcttggttgcttccaacttttggcaattatatataaaactgctgaaaacatttgtgtgcaggtttttgtgtggacatgcattttccaattgtttgggtaaatatcaaggagcacaattgctggattgtgtggtaagaacatgttttttgtttgttttgtaagaaattgccaaactgtcttccaaagtggctataccattttgcattcccgctagcaatgaatgagcatttttgatgctccacatccttgctaacatttggtgttgccagtactttggattttagtcattctaataggtgtgtagtggtatgttttaatttgcagtttcctgatgacatatgatgttgagcatcttttcatatgcttatttgccgtctgtatgttttaccctcctctctccttctctcttctcttttactcttgcttgaatttgtgcaaaagctgctttattctgctttcttctttcttccctcctcctcctcctttctcctttctcctttttccttctctttattcttctgtcagctgtacttaagatatgtgtatcaagatcagaagctttcgtctgccactgtggtttcgtttatgtcttcagtctcttctgtgaaggttctcttggctttctagcactaaatcaaaatctggtgctcctggatgacacaacttcccgtaatgccccggtgaacggttgctaattttattctcaaaaccttttcaccatagggcctctgttggtgggataggtgtctccattgtccttcactgctattctcctttcctcctccctaaaaatatctaagttgaaatctcattttgtcacaatatcccatcctctacctctcctgattcctggatcactctctttcacttttctttttttcttttagagatggggtcttgttctcttgcccaggttggagctggagtatgcggtggagcaatcacagctcactgcatcttcagacccctggggtcaaaggatcctcctgcctcagcctcccgagtagctgggactacagacacatgccaccatgcctggcttctttttggctttttgaaaacattttgccactagcttactgttactttcttcaccattacttccatcatgattcttggatgatttcagtatccttagagaagatccttcagatacactgacctgtcattttctggacctcctctttatcactgatcttaccttttacccagtctcagccatttgctttcctgatcataagcctaagtcttgtcactaccaataacatctcactttcaaacatcctgctctgactgccttcgcctgttttaccagcttacttcctttagtattccagtttcaatagttgttcagtccttctgagattttgccatgtttccagtgtctctcattctcttcagttcatcacgtccctcttacccagtttaaataccatggacagtcattgtcactatttccttcctttcacctttcatattcatgtctgtctcttttctggtaggtttctcttggataaacctattagttaaattcagttttgcccacttcatgcctgtcctagtatagctgaatcagctgaagaaaacacttcaactgtcctgactggtctcaatttaagtgttgccagaccaatcatatttccctggtcctctcactgtcccattctgatgattgctttataaagtttcttctatcttcaaacctccaacatctctcccatcctttgaatcagaagagaacttctacagtctcccactacctcatttacccacctatcaacatgtttgctttctcttttgttggtgagaatgagtggcttcttgctcctagctagagccagtccttccatatgtgctttagattcttcctgttttgttcaagaatattgctcaagctattcttcctcctgtttcctgcatcagcatttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaattccttttaaaaaatgtccacgttcactgactctagttttttatttctccttgtctcttgaacccagtccagtcaggtgccaccactccactgaaactcctgtttttttttttttttttttttgagacagagtcttgctctgttgcccaggctagagtgcaatggcacgatcttggctcactgtaacctccacctcctggattcaagcgattcccgcctcagcttcctgagtagctgagattacaggcgcctgccaccatgcccggctactttttgtatttttttttttttgagacggagtctctctctgttacccaggctggagtgcagtggctcactcggctcactgcaagctccacctcccaggttcacgccattcttctgcctcagccttccgagtagctgggactacaggcacctgctaccacacctggctaaatttttttttgtatttttagtagagacggggtttcaccgtgttagccgggatggtcttgatctcctgacctcatgatccgcctgcccaccttggcctcccaaagtgctgagattacaggcgtcagccactaatttttgtatttttagtagagatggggtttcaccatgctggccaggctggtctcaaactcccgacctcatgtgatccacccgcctcggccttccaaagtgctgggattacaggcgtgagccatcatgcctggcctgaaactgctgtttttaagggcactactgatttccacattgctaaacccagtgactgtgtctgatcttattaaacttataaggagtaaatgaataaataaatgggcaaggtggaggtgaggtgggaaagtttgttgagtacactaaaaatagtaactaccattatttactactgttgagggaaatctaatagtgtgggactggtgcaaaggatatagaaataggcaataggttttaggatactttggggtaactgatgctaacagtttcttatggattcttttggaatgttctataaatatacgagtatatttatcaacccaccttcagttatttttttaaccacagaaaagtcaaaagatcagtacactgataaacgtgcgttttccttatctagatttaccaactgttaacatcgtgccacattcactttatatcttaatattacccacactttcctcctttttcacatctgaaagtgggctgcagataatatgaaactcctaaacacttcaccatgtatttcctaagaatgaggaaatgtttatttttaaaaagcatcaattcattttaatatgctttatacttcaaagctaacatcacagggttctttttcaccttcttgcaccatatgcttgtatttctcttctgccgctatgagaatcctgattcccaataacatcctttgtttttataggctcacttcagcagctctgttggaaataaactgaaagaggggcaagggcagaagcagggagacgttttggaggctgttatagcaatccccatgagttacaatagtagcagtggagtaatgagaagtagttggattatggatatgtacacacacacacacacacacacacacacacatacacacatatatatacatacattttaaaattttgaaatagtttgaaatctatagaaaagttttaagaacagtgcaaagaactcttgcatgccttttacacagactcctcagttgttaaattttactgcatttactcaatttctctctttctccctttcaagagagagagatgtgttgacccatcacctttaaatactgtagtgtatactctctatcctcctgcctcccaaaagaaggccactttcctctattactaccctatatttcttccagtcaggagataaacattgatacaacagtgtcatccaattcaaagacaccattcaaagtttgccatctgtttcaataatgatttgcttttctagtctaggattttacttgcaaacactcattgcttttacttatcatgtctcatcagtgtcctttaatctggaacagttctttagtcttttcctgtctctaatgtccttgacagtcttaaagagtagaagtcttttattcgacaagatgatcctaaaccactaaggggttccttggaaaaatgaccaattccagggctgggaaagtgcagggaaagtgcaaaataagcctggaaaatcttgggccagaaattctcagcaaatgaacatgttaaaaagaacaaaggccccaatatgaatgaactccccgtggtcaaatctgggaaaatttggcatcagaataaaatgagggtatacattatagtgtaaatactatgcgatgttcctatgccatcatatcatcctgtgatatagtcacatgatcacttggtcaagttggtatcttctaggtttcaccactgtaaagccactgcttcccattttgtattttattgctattttgggggagataatctgacataacaccaatatccttttcttattaaacctctaaccacgagccctagcctcattaataaccccaatctatatcagttaccactctaatggttgccaaatggtaactatctaactctatcattctgtctatcattctatcattgttgattgacattgcactataagaaccaacctacctacctaccttccttccttcctttgttccgtgatgaactcattgattccttttttatttggtggttggtaaaccgctactctcattttattctgatgctcagattttcccagatttgaccactgagaattcattcatattggggcctttgttctttttgacatattcctgtcatttgctgagaatttctggcacagcaagatttccaggcttattttgcactttccctgctgcaagccctggaattggttatttctccaaggaaccccttagtggacttctgtttggtggaagatggtatttagtatccaagatctggtcacccagtattttcattgctactgggatgtcattgcttctaggacctcttagcagacagaactaggaaatatatatacatgtgtgtatatatatatatatgtgcatgtgtatatatgtatatatgcataatacaaacatctgcatatgtgtgtacatatatatatacttccacagctatctgtatgtgttatattttaaatgagtttatttactaatacttctagttctaatccaacatcttaggattcttttagtctcccgactctttccatgctcttaaatcctttctcagactgtgagaaatctgactccaattattttagtaaaaggcaaaagattcattcgttctgaagagaaaccagagcattctaattattttagatatattcaaccatttgctcagtcacctaacatatttgttcagtatgaccactctcctaaccactcagcctgcgttttccatctgctactccattccccctcccactgggctggggcatgctggcatctttgctgggcaatagtctctcccacaccatcctatttccttggatatgaggcatattgctggagatgactgtgcacaaaaccccatcacctttgttgccctgcttctttggaagctgacatctctgtgttgggaggggtagggaagaaaaggaaggttgggaagggaaggaagaatgggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggggttgatgaggagctcattttggatatgttaggtttgacatgccttttaaacatctaagaggagatgtcatactcactgcacatgcatcttgaagtgtgggttggagatgtatatttggaaatccttggtatatagattttatttaaagccgtgagctcagctgagattaccaaggaagtaagatagatagaaacgtttatgctgagcccagggacaaatttgtgttagggagatgaggaagaaccagcaaggtaggtcaaccactgaggtgggaggaaaactgggtaagtgtgatattctggaagtcaagtgaagaaaatgcttcagttaaaatgaaaggatcaactatgttaatgctgttgataggtcaagtaagatgaggactatgagtttaccattgaatttagcaatatggaagtcactggggacattaataattatgtgtatgtggagcggggagcttgattggagcaggtttagaacgaatgggaggaaagaaatgagagagccagatagagaactctttaaaggagtttcagcctatatataagccgcagtcctctgcttatatgtttcttggctctgcacctgagtagtcttttctgagagtcatgtgagtaaccttttgttattactacgtatacatttttttgctaaatactattttgtcttaggcggtgaaatgttactgtaattggtcaggttaataacagactgacagtgcagttcctacacttgtgcactgaggaaatcatcagagcagtttcagcagcataaaataggtagagagtacaaaggaagacctagttttgaaaaactcttcaaagtgcttaaagttttgaaagtgtcagaggaaataggaacttcatagattctatggtgaggagccttcttgggccttggtcaacaccttaacctttctttacaaaaagttttcagtatagtgtattgaagaatgttttctgtatccacatatttcttgatttgtaatgaaacctcattaggaaattggaatatagttagatttgctgaaatgaatttgatggtttagatgaatgaatcctttattgtctagatagaaaattggttgcacccttaacttaaggcatggataacaaatacgcagtgtgtatatactttccacagccctctcctattgcttatgaaccatgtctactttccacagttgtctcctattacttatgaaccacattaactcttcatgctgaacccagatgtagcatcagaattcttgttagtaatgttccataaagccactaccaattagtcttacatgacatatgacataaaaccttttttgatccctggtgtaagaattcagttcacaagataaaaattatgcagaaaacaacacataaattggaaatgagcattgaattgcttattcacattactggagtttatcaataatagtaatggctaatgagaaaccttaatagaggtgacatagggacacagtgcttgtttctttgtcaaataattgaattgacagttcatttctattcttttcctttgtccaaagattctgctctctttgctgaactcggttatttcacagacactgatgagctgcaattggaagcagcaaatgagacgtatgtaagtatttactaaggttgaataatgtgatatttagtctttaaccctaattattgcaagaaagtttcaggacaacaggttcaggctagtaatttaagttacatacttaatggtaaatagcttctaccattaagtatgaaagttagtagccattttgtaatcagtaaatgtaggacagtagaaattgcattgtattgcaattctaggcccacctttggccctagggatgggtgactttggaaaagtcactaatctgcctacctggtttttacagatactttgctacataagggaattggcaggtgactttggaaaagtcactaacctgcctacttcttggtttttacagattctttgcttttaaaaaggaagttggtaagttctgcttgactaagttagtcctttttaaaagttgtgtattcatgtagaaagctctgaaaagtaggtgtatccttacctttgattggttagaggtctgtgtgaaaactattataacactgagtccccgagaatatcttagattttcttttcttgattagtacatataaaactctttgccctatagaactttgattttgtcttattctttaatggatgaggtgctgtttcacttaagaagtaattcaagtgagcagagtaatttgtcaatcaggttgaatatcacatcattttaggctcttattaacttgagtacaaaatatgtaaagattgcttagtgagtttcagacatttcttaaacaatgatttagcagttgtttttaccattaatcgacagaagagaatgaaggacatgatatattttaaaaaatcagtactagggattttaatggtttcatttactccatgagatactttagaatgtggcccattgattaaactgccttttaatattggctatttgaataagcaactgatactcatatttcataacatctagaatcctaaaagaaaatgtttcttttaaactatgtcaagaaactgtgtgctcaattggaaagattaagggaaatatattcctgattttacaactaacattctattattttatgcaaatcactcaatctttcagttccttagtttttctagtatgacatgaagggattgaatctctgagacccctcatgtcattcttcttccaaacggcaatagaatttcccatgctaaatcactgaagagttagagtatataagtgccagtatgtttcattttgcatgaactgggcctgttaaatttctgatgtgataaaatctttatgctgtagaaggtatttgacttatttggctgaagattgagtcagaagtttcctcaagtagatcatgcccttatttaaaagtgttgctggcactcaggcaagcaacattggtaactttacttagattaagaaagtttaaggattttttggttgctaaaacaaggctgcttaatttttttttttaagacagagtcgcactctgttgcccaggctggagtgcagtggtttgatctcggctcactgcaacctctgcctcccaggttcaagcgattctcatgtctcagcctcctgaatagctgggactacaggtgcatgctatcacgcctggctaatttttgtatttttagtagagacggggtttcactacattggccaggctagtctcaaactcctgagctcaagtggtccacccacctcggcctcccaaagtgctgggattacaggcatgagccaccacacctggctaaggctgcttaattttttgatgtgaagatccaaataagagaaaaaagtgaaggagattgattttttaaaaaatggtttttttatgatttaaatacttttttttcatgtgcactttcacatgttctctttatgtaccttgtactaatatttactcagttatgggcatcataagaaaatagtttcccttctgtgtttctgttacattctcaataaaaatgaaccatatagtagtcattttgaaatgataatattcttctagaaattgttaacaaatggtcgttaccaattactagatacatttttactttttttgcctgaggtgtatttttttatttttatttttattttttttttgagacggagtcttgctctgtcgcccaggctggagtgcagtggcgcaatctcggctcactgtaagctccacctcccgggttcacaccattctcctgcctcagcctcctgagtagctgggactccaggcacccgccaccacgcccggctaattttttgtatttttagtagagatggggtttcaccatgttagccaggatggtctcgatctcctgacctcgtgatccacctgcctcggcttcccaaagtgctgggattacaggcgtgagccactgcacccggccgaggtgtattttattgttgctgtttttgttgttgttgttgttttgttttgtttctttgacagggtctggctctgtctcccaggatggagtgcagtggcatgatcttggctcattgcagcctccatcttttggactcaagcgatcttcccaccccagcctccagaatagctgggaccgtaggtgcacgccactatgcccagctagtgtttgtattttttttcttaggtagagatgggttttgccatgttgcccaggctggtcttgaacccctgggctcaagcaatcctattgttgctgttttatcatttgtgacattaagttaatatttactgccttttgactttattgcattatttatgtattaagtttacttttctttttgtctctgtgactccagacacttaatttaaaatagtactgtttggtactaacttgatctcagacttacatgaggactctgaaattatgtgacacttctttattcatgtatatagtataaggtggttatctggatgacccagaatatgcttatattttggttagaaaaaccacctaaatgaaaagaacttaatgcaggctttaagaagtttgctggaccctgttttagaaaattagttttattttataggattaaaaagtggtgttttttttgattcataaaagttttagaaatttaagaagtatagaactgtagaaaaaaggaaaattactcagtgattcataaaagttttagaaatttaggaagtatagaacagtagaaaaaaaagaaaattactcagtggtaactatcctctttatgattcttgcctgtcttttggatatatctatattctttctattgtatatagagattatattatgaatagcatttactttgtcttgtttttcttaatggcaatgggaaaatgtattttgctggatttcccttaagataaaagacacatttttgactcctgtaatggtcattctcatagaaaataatgaagccaactaaatgttttaaatactgaatcccttacctctttcctagttgttgctgctgtgcttcaagtaactgaattgattttatctctaggctatccaagatgtattctcatacaagactgacttagagtattctttttactaggttggctaatagcagttaaattatttgtgccaaattgtgtctcacagtttgattttaagatgtgtatgttttattcttttaatattcttttgctgatttgaaacctacaggaaaacaattttgataatcttgattttgatttggatttgatgccttgggagtcagacatttgggacatcaacaaccaaatctgtacaggtaattatgtgtttcactggtaaaagttttaaaaagatcaattttattttgtagtttggtcatactcaaaattaggtggggttattgggctattctggtaggttaaaagattcctggtgttatgcattctacttctggtatggcaattatgtaaacaaatttcttgccaaaaatggatatgaggagtttcatagttatgtttcagtagtgtaatgaatgaacagttcatatcagaaatagaaatagtgattttgaattatgaataatgtctctgtataagattaacctgagaaccagacagggcttagggaatcaaagggaagagcctgggttaccagaacctaggaacttggtggaggagtcccatgcatttaatacatgtacttctaagaaggggcagcacctggctgatactaatatctttaagggggcctgatgaggtcggggttgagtatactgaaagaagccagaacctggagcaaattgccagtgctgggatacagctgatggtagaatgaagaaaaatcccttctcctcccttctagctttttctagtatcccctattgacaggacctaaaaggatgccagctgggaataatttatatcaccgattatagaaagtggacttagtgctgagagacagtgaataaataaccagcacattctcctatctaaattcctctctacctctgcactacctattcctcttcattttatgtatttacttatactgtttcatgcctgtttgccttcatagaatgtgggatacacaaagtcagtgttctggttttatcgtttgacaaactaaatcttagttgcttaaagcaacaaccattttattagattgctagaatctatgggtcacgaattttgactgggtgcttacgaattttgaccgggtgctccaaggatggcttgtctctgctccatgatgtccagaccacaactggggagatttgaagattgtagtagcttgacatttgggggctagaatcatcttgaggtttcttcactcatatgtgtggcacctggggtggaatgacttgaagactaggactactaaatggagtgcctgcatagggcctctttgtgtggcgtggtgttctcagtcatggtggtctcagggtagtcagacttcaaaggctccaagtatgagtgttccagcacacaaagcagaggctgcatttccagcttcagaattcacatagcattacttctatcttctcttgattgaaggagtcaagcccacctaaattcttggggaggggaaatcgactctacttcttggtgggaaagtggcaagatcacattgtagaagatcatgagggaagatcatgaaggatggtagatatcgtatggctaattttggaaaacacagtctgccatccccaccctattctatctttgacaccaagggatactgcctgggccatagttgctcagtacatttttataggataaattaatagtttaaaagatatgaacattttttatgagtttgaattgtattgtcaaaaatgctttccaaaatatttcctgtttcttatttttttaaattttttgggaagctataatattttgcatatggtaaaatattcaaaaggtacaaaaatctgtatagtagaaaaatgtctcctgcttttattcctcagccaacaagttctattttccagagacaaccactgttaccagtttcttctgtttacccttccagagaattagtgcagatgcaagtgtacacatatatatacacacacacacagacatacatatataccccctccccacatatatatataatttgtaacacaagtggaaacatactagatatattgttttctgcatctttcattttcactcgttatattttggtgaccttagcttccatatctgattgaattttaaaagtagattttaccttctttcttgttcattttattataagtttttattgtccagtgggtaaaacctttcctccatgttttccagttaaagatattaaggcagaacctcagccactttctccagcctcctcaagttattcagtctcgtctcctcggtcagtggactcttattcttcaactcagcatgttcctgtgagtagccagtcttttacaatgattttggttataatatgctatctggaaaatatgtatatggaggaggcagttaacatttattgaatactactatgagttatattgtctcatttattgagggaactgagactcaagaaagagccttgtgggagctagaaagttgttagtgcctttggttttgctctcttttcccctctgttcatgcctccataatttcattgtttcatttgtttcattgcattttaacagtatccagtatttgtttattggcttactgtcctttctcccaccctttctttctcctccctattaggatatacattctttatatatggacatagaagaatgtaagatggtcagtttttatatctctttagtcacagcatctagaatgattgccttagtttgggaatgcctagtgctaccttttgaaggggctcacgtttttatagaagtctggtagctcttttaagaacacttctgctctgtgtccagacaaaagccctgaggccaggaaaaggaagtacctgatttaggtactttttagaatggggaaagggaaagtataagaataaaaaaatcaaataatattttagtatattatatgtgctataaattgtggtatctttgttcctgcaggctctacatttagttactaaatcctggtggttatatgcacatattaattcaaggatttatcttttctgcccctgccaggccatcactatctcacctggattaagtcaataggattttaactggtcagccttacaactcctcaaacctttcttagcagtggaatcttcaaagagaaatctttcagtgtcacaagctttactgtatcagtcatttgcttaaaactttttagtaacttcccagtccttacaaggatgaaatttaaattcccagagtactaggctttccatgatctggcccccatttacttttccagtctcttttcttgctatcccctcctacttccacattccccttaatttgagccctgtgagagttcctctctgagagctcctatgcactctactcattcaaccgctgtgccaggcactgttccagatgctggcagtgaacaacagcagtgagattgctgctgttacagttctaggtttttgcacatcctctttcttctgcctagaatagccccatttttttcttgtcttggaaaactcatccttcaagtcccagttcaaaaactacttcctttatgaagcttttctctgattgctgctattggtagctctctgaggtcccacaatttctccaaatgatttaattttttaaaaaattaataattacaaaaggtagcatactgtataccctgtcctgtaccttgtttttttagcttagcaggataactcttaatttcagagtatataattttcccattatgctacataatgtttcattgcatggccttatcatgcttaatttagtgatttccttattgatgagtatttgtgttgtttttagtcttttccagacccaattaacctgtacataagtcttttccagactcaaataacctatagtaaataacctggtacataagtcactttatatttttaccaggatatttttgggatatatttcaagaggtgggattgttgacaccaaggtaaatacacttgaattttgctagatactgccaaatttctctctataggggttgtaaaattttacatcctcatcagcagtatgtaagagggcctgttttcccatcatcactccacaataggttttgttttatatctcttttattataagtatggttaaataatatctattcatatgttttatatgtttaaggcctatttgcatttctttttaaaaaatgaactgtcatttcaaatttttgttctttttttttttttggagatgaactctctctcttgtctaccaggctggggtgcaatggcatgatctcggctcactgcaacctccgcctcctggcttcaagcaattctcctgcctcctcagcctcccgagtacctgggattacaggcacctgccaccacacccggctaatttttgtatttttagtagagacagggtttcaccatgttggccaggctggtctcgaacttctgacctcaggttatccacctgcctcggccccccaaagtgcttgggattacaggtgtgagacactgcgcccggccgttcattttttaattgaattgtattggtctttttctctttaatattttaggtgctttattatatattaggattattagtccttagtttgtgaaataagctgcaaatattttttccccaatttttcttttgtctctttgctttatttctggtgtttatttttccccaggtgtactgttttctatagccaaattattgatcttttctttaattgcttttttgttcactcaaaggaaggttttcaccactgagaggttataaaataattcactcatatttttactctttttttttgcttatgttaattttttgtttggaacaatctcaaattcacagaagtgttgtgagtaccttgcaaataacttgttttttccttatgcatttcagagtaagttaccagtccgatgcccctatcactccaatactttagtgtctacttcctacaagcacagatatttcttagccataatacaagcacaaaatcgggaaataaacattaatatgttactataatctaaccttcagctctcgtttaaattgtgccagacatcccagaggtgtcctttagactatcaaaaggacccagttcagaatcaagcattgcatgtggttatcttgtctttttaatcttgttcagtatgaaacagttcttcattaatccttgactttcttcaccttgtcacttttggggattaggagttagttattttgaagagcatttcttagtcgggtttgtctgatgtttctttaggatcatattcaggttttatatctgtggcaggaatgtcacagaagtgctgtctgtgtccaacttttgatgacccaattttgattttttctaatactgattattttcactttgatcccttcatagatgttatctgccaacctattccattgtgaagttgctttttctctctatgccatacatattttgtgagaaagatactttaagactatgtaaaaatatcctgttcatcatcacactttatatttgttcacttatttgttaatatctgtatggattcatcgtttcttattttattcaacagattataatccgttactataattatttattctgattcttacattgttctggatttggccagtgggggtcccttcacaccagctcttatgttcttttaacatgtctcctttgggctctgatgtccttacactaggctgtcttcccatgcggatgccctcctcactctgctgtgactcctcatgccaggccgcctgccatatcagtgccctctctacccttcttggaccctgacattccaccaggctacttctctgcgtggatggtggtcttgctttaccccatctagtggcttaggataaaattattcaggaaggaatattttctaagtgactatgaataagtatttatcatgagatattatttttagtgtttagatctcggatccatttgaaattacccttgtgtattatatgagatacaaatccaattttatgtttttccaaatgactatcaaaatgattattctagtaccatttatcaaaaagttcatctgatttcaattatatgcatgtattttaaatttatgtaaatggcattatagtagatatctttatattatttacttttaaaaatcagcacagtgtttttaagataaattcctattgctctgtgtacatcaaatctgttgcatctaactctgtacaacattcaagtatgcattcactacatttttacctacaccataatgaatattttaaaaaatgttcccttgcggacccatgtgagaaatcctttagaatatatgcctagaattgctgggtagtagaatgtgcaggtatttaatttgacaagtgcttccatatttctctccaggatcatcatagtactctgtgggctggcagcagtgcctgaggatccctgtgacttctctcctgatacttggcattgtctgcctttttaatttttactccatggcacaatgtgtttttttgttgtttgcttttattttgttttactttgtatttctttggttattgttttcaacatttatttacattcttatgagctttttggactttttttcttttatacattgtttattcctgtcctttgccagtttttctactcagttgttgtcttcttgtttatcagcaggaattcctcatatacttgaaatagtaaaactcttgttggatttagacattcaaattgcctatatcttttccctttctattatctattaactttgtagtctttattaagtataaatagttaattttcaattactcaggcttatctttttttttcttttcctttatggcttatttaagaagtccttctatgcttttagagcacagaggtattctgcattttcttttattaaccatatggtttacctttcacatttaggtttcttaatactcttagacaccactttaatatgtggtattatgtagggatctagcactaggtagggatctaattttaattttctctataaaatgaatcagttttcctaactgtattgtctttataatcacttgtaatcactcttttcaacaatattgtatatctctctgtttactgaaatcttttatgccttagttcagttgtgtagttttcttcatatgggtcctgcacattccttagaaaatttctaggtattttgtaattgttattgctattgtgagtgaaatatttatttatttgttttatttaaatcttttttatttttaactttttttgggtacatggtaggcatatatatttgtggggtacatgagatgttttgacacaggcatgcaatgtaaaataattagatcatggaaaatggggtatccatcccctcaagcatttatcctttgtgttataaacaatccagttacatactttttgttattttaaaatgtacaactaagctcttattgagtatagtcaccctgctgtgctattaaataatatgtcttattccttctccttttttttttttttttttttttttttacccattaacaatccccatctcactaccagcttctcagtaccctccccagcctctggtaaccatccttctaccctatgttcatgatttcaattgttttggttttttgatcccacaaataagtgagaacatgtgatgtttgtctttctgtgcctggcttgaaatatttattttttattatgttttctaagtgtatattaatacaatattttcaagtcaaatttttttttcagtggattgttacatgtgcttcaagtatatagcatattaccttgctaaaaggcacgctgtctcttttgttttaatgttttttaaatttcttcttttagtgtaattatactagaattacagaaaaagcaggtatctattttttatcctgactttaattgtaatgcattcagcattggacttggctgtataattactgatagctttttaatgttaagaaagtattcctcggatccttgttttctaggattttattgaggaatacttgtcgaatattatcaaataccttttaagcatcaaaggccgtgaagataatagtctcctcccgtgttaccttgtactctttggtttcttggaaatgtattttaatacactctacatattgctcagcttacatgctgagtaggtgttaaggatgaaggaagatgcaattgtcacttgtcactctcaccagtgagactgagagcatttctttctcccatatcctctcaaggtcatttaaatttttttttatgataaaaaaagtttaaatttgcctttgactaccatttgcgtttccttttcagtgaaatggctgttcctgccttttgtctatttttcgcaaatattttctaccaatatatatcttttaactttgtttatggtctagtttttattgttaaatagtttacttattatttgttcaaatctatttcttcttcctttgtggcttctgtgtgttctgacttaagagggtctgcaacaccctgagagtaaacaagtattctcttaaattttatttttatattataatcttatagattattttgaagatgttatgaagtagagattatgtctattgcgtgatcatgcatgccatcttttctgtctgaattgaattgctacttctatgttgtttctttattctaacaaaatgagatagattcactgaatattaaaagactttgggaaaatgcgaatgttatctttatgtatctcaatcattatgaattcacctactaaattaaagaaaatagcactgttggctgggtggggtggttcacgcctgtaatcccagcacgttgggaggctgaggtgggtggaccatatgaggtcaggagttttagagcagcccagccaacatggtgaaaccccctctctaccagaaatacaaaaacttagcaaggcgtggtggcacacatctgtggttgtagctactcgggaggctaaggcaggagaattgcttgaactggggaggcagaggttgcagtgagctgagattgcgtcactgcactccagcttgggcaacagagtgagactctgtctcaacaacaacaacaacaacaacaacaacaacaacaacaaagcactgctccattcatgcatctttcttttacaacatttggaacaaaggcagtattacaaaatagaaaacagaaaagaatacaaataaaattattttgcttttgatattcttttaagaccaaataagagagattatggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacaggatggcatagacttactctgcattttgagttatttttcctttggtatagatggatcatgctgatagtcacttattacttaatatatatatacagtttctaatatacctttcctttgaagttaccctgaagtgtttttctgtttatatgtgggtctcctccttttctatgcaatttgctgcttaaggattatactcattaatttttgtttttattatgctacaggaggagttggatttgtcttctagttctcagatgtctcccctttccttatatggtgaaaactctaatagtctctcttcagcggagccactgaaggaagataagcctgtcactggtcctaggaacaagactggtattactctatctcctaacttctgttatttctatttcagattgagcttaggttccatttcttaaaagaaaatgctggattaaatttatgtttattaggctggcttgctgttttttaattggtggacctatattgtttgttgtgagtgattaccgtggagaggaaaggggagaaataatctttggttgtctctgtctttacaggtgaaagatactttaaaatagactcagaccccaccatcttcaggagagatttcaaagtttcagttaaagataactgaatggagctatgacatttgttacctcattaatctctgggtgttatcccgtgattttagcaattctcctttaccagttagtgtgtcccattcccaaaactgcagcttggttagaaaaggaggtaacagtttaagtacttttcttcagttcattcaggtatatgtactgtagctatgcttaaactccagttaaagattgttaatcgaagttaagataatgtgtagagaaaggtgtgtgatagaatctgttttttagggcttgcgtaattgctttcacattgacttgtggtttgtctggtttttctccagaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggtacctgagcagaatttaaggctgtgtaaatttatttggagggcagtaagggttgtgtcatatgatttgttttaattcaggttataatttctgagcacgtgctgtttgtcaggaatgtctttggttatgaggacgttgcagagatgactaatgtgtggttcctgtcataacaagggatatagctctccagaccagttacatctgatggttattttgaaaatctgggacactttcttggtgccattttattctggtggataaaatacaggaacacaaattttaagctagttgaaggcagagttcaggtcagccagatttttgtggctgtgaactttttttgttttgaaggaatatttaaaataatagggtccatttcaggtgtgttatagcaatagaatcacacccttaatctctgaggaggctgcatggtttagtaaacagtatattgacctggtcatgaggagacctgaactctgctttcaactagctaagaatttgtgtgtttcgtattttatccaccagatggcctcatacacttgtgattctatgagaggtttatgtcattattgaaagaagttcaagtctgaggatttggtactattcagatatgggagtcatttccgtatggagatctcttaggtagattagtcatcattgtactcatactgatatctgtatacactgggtacaagaaaacttttgcagcattcttatctctggatttagtttgttggcaccagatatgactaggcgataatggggtatgggttgtaaataaacaccaatgttacatttgtactgtatctccaattgtgaataggtagctcgttttttggagcatagttttaatgagggtaaatttgataaatttaatttccagatactcttttagctttgttctattacatggtcatagacaatatgacattgataaaaagaagacctagatgagagaatggatgaatcagtgaaaattcatccatcagtcccaccaaaaataaacagacaaacaaacaaacaaaaaccagtttgaaatgcctgctctctcagtacaaagtcagaactgctgccttttccatctgaaaagtagcattcctatagaataggtattcttgtgatttataaatgtgtattaagggttcatgaactccttgaaacaaaatgcaggatttaatgtatgttcatatgtggattattctagggatagtctccaaaactttcattaggatctcataaggatctgtgccttcccaaaggctaagaatttaaactaatgaagaacctcattgtagttcccataagctattaaaatacgtctatacaaaaagtctgacattaatatgactagcgtataaagcaggggtattcctaagaatttgcccttagcagatcattgactatgtttgagtgatggaagatcttacctataataagaagacaaactgttcttttctgagcagtttatcagttccagaaacctgaattacacattatttgaaacttcaatactttcctgtcatctgaagactatagttatttttttgtgagcatgtgctaatatgaggaactgcaccttgcctgttttttttcttttatttgagacagagtctcgctgtgttgccaggctggagtgcagtggtgtgatcttggctcactgcaacttccacctcctgggttcaagtgattctcctgcttcagcctccagagtagctgggactacaggcacgtgccaccatgcccagctaatttttatatttttagtagagacagggtttcaccatgtcggccaggatggtcttgatctcttgacctcgtgatcgcctgcctcggcctcccaaagtgctgggattacaggtgtgagccaccgcgcctggtgccttgtctgtttttatagtacaatctaaataggtggtattattataataacatacagatttaaagtatgtttttcatttatttgagaatggggaggaagaagggaagtatgggcaagacattatacagttaatcatgttaatactagtagtaaatatgttaccattgaaaaagaagaggtaatttccacaggtttaagactgagattctctagcttggaatgtaaaactcttcacaatttggctctagtttagttttttgtttttttgttattgttgtttgtttgtttttaatagagacaggatctcactatattgctcagtctggtctcgaattcttgggctcaagggatctacccaccttgatctcccaaagctctgggattaaggcgtgagccaccatgcctggcctcctagtttagttttcgaactttataatattactcttttctataaatcccttcttctagctcaactaatctgtcattgtcctttgaattctcttgtttttcctagttttttggctcaccattttctaccaaccagcaacaacttatgcctacttctacttctcagtcctccatgtcctttaagactgttttgagtagtgtagatgagagataatgaaagcctggaatatcaatgaaagtggagaaccaggatgaagagtagagatgttaaaagtgtagaatcttagagattggtaattggattgtgtagaaggaggctgaacgatagagaggaaggtgtctaggatgacttccgtttttctatcttggggctttttgggtagatgatggcgaaaattattgaaatgggagacagaggtaaaatatgttgcccagatcactctgctaataagaagtggagccagaacttgagcccaggtggtctggctcggagtctatgtgaataatcactatactgtatcgccttaaaaaaaaaatgacagatgtattccttgctctcaagaattctacactttaattgggggattaaattcacataaacagttaaataacagtcactgtgataactaataaattaataactcatgcagtgcccttatggaagctattattatatagaaaaggagattaataataataataattgcatttaagttcttactatgtgccagacactcttctaagtgcttaagtgcattatcttatttcaaataatatttacacattatttgaaacttcagtatgtttctatgatttatggtgatgggttgtgatatctccattttttagatgagaacgctaagtacagattatttgccctaagtcacacaccgatgctgtttcagacaaagtaggcattcaataaatgtttgatacatagtttaaaatctttgaagaaagtttaaaagaaagaactatcaaaatcagtgagttacacatagtcaaaaaaatatatggcattgaatccagccatgttccgttaagggggatttgcatgtaatgccagagaggattttgagcatgctaaaatggataaacagcctttggaatgtcctttttaactgtttccacactaggaacagtagtaactatgttcagctgctatttaaggccccaaacaattctttgcattgtagtttgtggcctggtcagcatttaccaagtcaccatgagagttttttgttctttcacttgaacatattgtcatagaaatttagttgtttcccctcattctgtgttgaacccaaacatgcctagaatatttagagtatccctgatttagctgctgggtaatttgaggatagttgggtactctgggatgaaaaggcttgatacaatatgggaaaaaaaggaagcagcagtggcttggtaggactcaagccacatttggccttgccttggtattcttccatctcctttgtgtgatgcggtcgtctcagcaaggagacagtggtaattacacaattggtagtacagatttggattatttttcttaattagtttaagaaatattacaaagccctctgtacatgttatctgctagggctttaaatctgtaactgtagctagaaataggattctttcttataagttgcctaattcattatatttacacctcttctgttctttaaaatagtcccaaagttccctgaacagtgtttaattttggggagggatcttttaatcataattttaaactcagaggatgtagaacatggcttcctataatactcttctcaaagtattggtttaagtcagtggttctcagtctgtatattgtggaccctgggatgtgggtgatgggggtagtagctttatggcattttgcaaagcatctgcaaatccatacttgaagcaagcattttctgtagaccaaataatttatttcatatatctttgtacagctcttcaaatttttatagctatacttctgactaataaactccaagttcattttaaatcttcactaaattcttagcagcctttttccatcatgtattttctcagtacacagaagctgaaaggacaaccttgatggttttgggtgaccaggatattattttatattaaaagagagcccttatattcaggagcctttggggagagactatgggttttctaggtgtagaattatatcatctgtgtgagagatggtttgacttcctctcttcatatttggatgccttttatttctttcttttgcctgattgctctggctatgacttgagcacttgggaattcttgttttttggttttttttttcacattatgataaatatatattttcatagtgccagatttactgtaatttcttattgttattaaaacctaacacttggtcatatgctatttactttatgtgtttctaatttttatttgcgtatttggcctaagcatgtttatatctgcttctgagtaatttctgcattttatatgtttttacttcataaaagatggaggccacctcaaaacaaattaggcatcaaaggaacatacctcaaaataataagaaccatctatagcaagtccacagccaacattgtaatgagtgggcaagagctggaagtacattccctttgagaaccagaacaagacaaggatgtccctctcaccactcatattcaacatagtgctggaagttgtagccatagcagtcaggcaagagaaagaaataaaaggcatccaaataggaagagaggaagtcaaactacctctcttcacagacgatatgattctatacctggaaaacccatagtctcagcccaagactcctagatctgataaacaacttcagcaaagttttaggatacaaaatcaatgtacaaaagtcagcagcatttctataccccagtaatgtccaagctgagagccaaatcaagaatgcagtctcattcacgatagccaaaaaaagaatataaagtacctgggaatacagcaagctggggaggtgaaagatctctacaatgagttacaaaacactgctgaaagaaatcagagatcacacaaacaaatggaaaaacattccatgctcatggataggaagaatcgatagtgttaaaatggccatactgctcaaagcaatttacagatttaatgctattcctatcaaactatcaatgacatttttcacacaattaggaaaaactattctaaagttcacatggaactgaaaaagagcctaaatagccaaagcagccctaagcaaaaagaacaaagccagaggcatcaagctacctgatttcaaactgtactacaagactacagtaaccaaaacagcatgatactggtataaaaacaggcacatagaccgatggattagattagagaacccagaaataaagctgcacccctgcaaccatctggtctttaacaaaaacaaacagtggggaaaggactgcctattcaataaatggtggtaagataactggctagccatatgcagaagattgaaactggatcctttcctttcagtgtatacaaaacccaactcaagatggatgaaagacttaaatgtacaggctcaaattataaaaaccctagaagaaaacctaggaaatatggttctggacataggccttgtcaaagatttcatgatgaagactccaaaagcaatcgcaacaaaaacaaaaattgacaaatgggatctaattaaactaaagaggctgggcgtggtggttcacacctgtaatcccagcactttgggaggctgaggggtgcatcacttgagatcaggaattcaagaccaacctggccaatatggtgaaaccccatctctactaaaaatacataaattagccaggcatggtggtacatgcttgtaatcccagttacttgggaggctgaggcaggagaattgcttgaacccaggaggcggcaggtgcagtgagctgagattgtgccactgcactccagcctgggtgacagagctcaaaaatcaataaataaaaatcaactaaagagcttctgcacagcaaaagaaactatcaacagaggaataggacagcctacagaatgggagagaatatttgcaaacagtgtatccaacaaaggtctaatctccagaatctacaagaaacttaacaagcaaaaaacaaccccattaagaagtgggcaaaggatatgaacagacactttcaaaagaagacatagacatggccaataagcatatgaaaaaatgctcaacatcactaatcattagagaaatgtaaatcaaaacaacagtgagataccatctcacatcagtcagaatggctactatcaaaaagttgaaaaatatccgatgctggcaagattgcagagaaaagtgaatgcatatacattgctggtgggaatgtaaattggttcagccactgaacgtagtttgtagatttctcaaataacttaaagtagaactaccatttgacccagcagtcccattactgggtatatacccaagggaatataaagacacacgcacacatatgttcatcacagaactattcacaatagcaaagacatggaatcaacctagatgcccatcagtggtgaactggataaagaaaatgtggtacatatacaccattcaatactacacagccataaaaaagaatgaaatcatgttctttgcagcaacatggatggagctgaaggccattatcctaagataattaatgcaggaacagaaaaccaaatacttcatgttctgtcttataagtgggagttatacattgagtacacatagacataaaaaggggacaatagacaacaggggctacttttgagggtggaggatgcaaggagggtgagaatctaaaaattacctgttgggtactgtgctcattacctgagtgatgaaataatctgtatgccaaacacctgtgacatgcaatttatccatgtaacaaacctgcctgtctaccccctgaacctaaaataaaagttgggggaaagaaaaactgaatccaagggaaaacgagaaggtaaaaatgtttaatgatcatttatgccgaagtattaatacattgtatctactccaaatccatgaaattatttttagatcttcttatctgggataaaatgctgtttattgaaattctgctactttcagtgtgttttttgaggccatctgaaacaagggctttgcttttataagttatcttttttagccaagacagatgttcttgacaaacaggtgttctgaagctttattttgatttttagttttccccgatcctttgaaatattgagctgagttttacatgggtcaacctgtctgaaagcataatgctttttttttcttaaacaaattataaatttacatgatattttagttgccagttattttagtaccttcattttgttagataggctcaagcagctgtggatgttaggcaaggctttcagcaccttataaaaatctgccagatctgaaaggaaacacttagcaggcaagtaaaatttttaatagattagtgttatgagttgtataagtctttaggttaatggtacaggtttagtaccccttaaatgaaatgcttggaaccagaagtgtttcagattttgggtacttttggattttagaatatttgcatatacataatgagatatcttggggacagaacccaagtctaacatgaaattcatttatgtttcatgtatatctcatacacatagcctgaaggtaattttatataatattttaaataattctctgcatgaaaccaagtttgcatacagtgaaccatcagaaagcacagttgtcactatctcctgtggacaatctgtagttgtttggcaccaccatcattcctggctctgaattcatatgctactgacaagcaatcattttcttacacttattcacaaattcacacctaagaacttaacaaaaattatgacataccattaatacagtgaaaaaataatgtgtgcagagtaacaaggcaggacagtagaatcaccagaataccagtgtcagctactacacaacagcaacaacaaaaaatggcagctttcagtctctgcctttgatgctgttttcattaaaagcctactgtaccctctattttatgtcttcaggtgagaagaaacatcagaagcagttgagagactggaagtgggtcctctagggatgaggaggcattctgctggatgacttctaaaaatgttttctatggagtcatctgcctcattaacaagtttttgttttagaagtctctttttgattttgtaaactgacatgatttctttttctgttatgactgtatgctgctttagtccttcactaggcccatcacacatttttaccatgtcatctataggcactttttctgcagcgttaacagcatcatcttcattgtcattattatagattgagtatcccttatccaaaatacttaggaccagaagtgtggagttttccacttgtgaagttgtgtcagcactcaaaaagttttggattttggagcattttggattttgggtttttggattaaggatgttcaacctctaataattctcgtcagattagcataaatttaaaataatgatacctctgaatactcagaaaagaattgaaggccatttttgggggaagagggaaagggctggtatcatctacagactattttgaatcacagatttatgtttaccgtgattgttagctaagatttaatctcaaatggttttaagttttttggtatttgtagtctttttttttttttttttttttttgtcctttttagggatctgcctgcctcagcctcctgagtagctaagactcgaggcacataccaccatacctggctaatttttaaatttttttttgtagagacaggctatcactatgttgccttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattcagtgtaaaagatttgttatttataataagacaaatccttttagcactaataaatttcagaggttaattcttagaaatctagggattacagcaaatttgatagctgtttagttgagaaagataaataagaaagtatattaaagtatattgttaatgataactcaaagagatgaatttagttggtcacattaaaaacataacaaagtcaccataagcgtgtgctgctattgatccaatgttttaattgatggtgtccaatcccttggtgttgatcttacccattacgtctgcagaaaagacctaattataagctgcttcccctgccacagtagttgtgtaccctttgattccttttcttttttctaacgcaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatgtaagttttgaaacttagtgcttctcttaatgcctgatttaaaaaccaacaaaaaaacaccttttgcttttgttgccttgtttttgttttttttagagtttcttatattgcatcaaataaaagagtgtgctgaattgcacatctagtctttggaggaaaattagggtaaggcttactacgttagaatctaagtgaaaaggtttttgaaagtgaagtggtttgatgaaaagcaaagtatgcatacctccctcttctttactccttctttagaaccaaccctcttattattctcttcaagcccttacaccctcaacccagtcatccactaatattttacagattcaacgtttcctgattgaaatgttttagcgatcttcagataagagtctatagattactttttaggtaggttttatatttagctttcttccttgccgttttgaagtattttcaccacttcataatgatgactagctactcttaggaattctgtctcttagtgattatttggtactttcccatttttgcaaacctttaaattttctagcatgttgtagggatttcttataatttataaatcacatagtttcctaagacctgtcactctctaaagccagttactgcacttgccaactaactcttgctttctttcaaaatgattggaaataacttatgtattaaattgaacatcttggtcctaaaatttaatgaatgttaaagctatatagtcaaacagtggattctctaaagttacgattgggaaagcaaagtgtgtatgttttctttaaaataaaaatggatactactagttgttaatattactacttcatcctttctttaggtagaatgcatttgaaaagtaattttaaaatcctgtgggttatgcaaggttgtttatcagactactgtctgatctgtctgccagaatttattaaccagcatgtcagtgacccatttaattataaaattgctccacagttgcataaacagtaatctcagccagcaatattgtaaaaattcataacaaaggaatattgtctggtgaaagtagaacatccagtttctagaataagagtcccatcgtttgtataggtattgaaaacaatgcatgtcaagacatggaataggaaaattagtgttgctatgagactagagaccatggacagtacaggattaggcttgactgttatgttggtttgttttgaggactagaagaggtaagcacaatgcttatggcataataggctctaatacatagcgtgtgtttcagttgaagatgaaacaatgttgctgggatgggaaggtggtgagcacaggatagaggcaactggattggcaaaatgttgataatgatggaagctgggtgtttatttttctatccttttggtgcatggaaaaatttctacaatatgttaaaaaaatgacaataacaaaaatccaaaagctttctgtgatattttcaattaaaaagttgtgtgaccaataagaaaagagtatgattttcatgggagaccaaccaggttaagaatgatgaaaaaggatttttaaaaataatgctttgaaatttctttttttttgttttattatactttaagttttaggatacatgtgcacaatgtgcaggttagttacatatgtatacatgtgacatgctggtgcgctgcacccactaactcgtcatctagcattaggtatgtctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccttttaatactcttttaaattatgaacttgaatgtttcttatataatacccccaaatgaaacttataatagaaaatatccaaagttgcctttatgtaatatgttaggacatttaaaatatttttatgaaatattttagacatgaaaaaaagataaagactaattagaactttaaaaatacataggtcaacagtatatcactgttgttaaaaaatattaacaatattaatctaagtcatcccaaacatggaaaagtccagaaaagcatagctaggatggggagagtatctagaaaccatggggtagaggagtgggttaaaggttggaatgattcagtaaactgaagaagagaggatggaaagtagacctgggagccatcttccaggaaaggaaggttgttatgtggaaaatagaattgttctgcttgttccagaagagttatctggaacaggtgcaggaaaaatatagaaaggtttcttctaaacataaggttttttgatacaatcattgtatttaaaaaccagaagagcaacccccctgcctttttttttttctacttttaggcttactatctgaataatgagcatcttaatgttgacaatcatcactgtatgccattgacccattttataatctctaaacatattccaattaattatatgttggtctattagtcagacatcctttattagttctctggtgtgaaagactgtgtctgttcagcttttgtactcttaagggggatctgtaaatttaaagtatttttaatgaaatattttagacatgaaaaaagataaagactaattagaagttaaaaaatatataggtcaagagtatgtcactgctaaaaatatgagaaaatgtagaaccaataaatactgctagaaacaaaagctaatacttattggttactatgttttctcatctcacacatcccccagttcttcaacgttaattgagactttgtcagcaaagtctcaatgtatgaatgtctacatttattgtatgaatgtatattcagatgaggttaatttttttaacaatgatataccgttgacctacaatttttannnnnnnnnnnnnnnnnnnntttaggatacatgtgcacaatgtgcaggttagttacatatgtatacatgtgacatgctggtgcgctgcacccactaactcgtcatctagcattaggtatgtctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccttttaatactcttttaaattatgaacttgaatgtttcttatataatacccccaaatgaaacttataatagaaaatatccaaagttgcctttatgtaatatgttaggacatttaaaatatttcattaaaaatactttaaatttacagagcccccttaagagtacaaaagccaaacagacacagtctttttgaagtttagaattgacaggattataaagaaagattcaaacactttatgtttaatgcaaagagacctaaggacaattagaataattttctagtcaacctgcattgaggtttttgtgcttatttttacttggccagcacatcgagacgtgagccaagcctttcaatatgagtttttttggtagaaattttgactgaatgtttatttcaagtaaagaagcattagtctgtcctagcagcaggccaacccactcaggaacccaaagtaaatctgttccagaaggagttgcagagaagaactttgatcagcttgtatagccttctgtgttagtaacttggttgacctcagtattacatgtgtctgttaaaacacaagtcctattaaattaggataaattaatataaattcctaatttaaaatgatcaaaaaaatattttttatcatataccttttgtgcctttaaaccaaaagtatggtgaaagaattgtaatccaccaaaaaaaaaaaaatcatatcagtttttttgtggctttgtaatgctgacatggcttctttttctaccttttttagttcttttgtttggctggtttcactctccagaggcctgctacagccataagtagcgtttttagcataccatattctgcaaactgcattaaatgccacattttctgttatgaaacagtttgcctggttcaaattatatcttactcttcctgtcttttgctggtaaatctgttttgtttaactcttggagacctcacctaagttttcaagaaatatggtttgtttttggctgtgatcctgatggaaaaaatgaacatgatctctcatttcagtgtagaagttctctgtgcagtttcttagtaaatggcaatcttggaactacaaagttgactttataggacagcatgcttatctttctttaaagggctatttagtgttgccacacatcaaaccaagggcttaaaaacaagcagtctgtttaaatctgcattacactcactacttccacctacccatcataatcgcataaactttatgaaacattactgcccttgttttaaggttataggaattacattgttttagttattggaacaaaagaccagaaaaacaagtggtaaaattctacatcttccacagtgggccacattggagcaaatactcttagtggaaatcagtaggtgggaataatggaaagaaaagtatccagaactgatatagaactataaataacctcagatgtgaggttgatgaagggatacaaactactgttaggagtctccttccttccggctcagtcaccccactgaatatcttccaaactctgtatcaccttttaccctgtttctaaatcctatagttaggaaacttgatcccttccatcccaaaatgacttccctttgggagtccctgtcttgggttcctagagtcatcatgagaaggtaggtgctggggggaatcctttgctactggtttgcaggtattagaaatggtgcgaaggggattctcctgtcataccaaattagaactttgtatttcctttctctagaattggtgtacagttaatttagggatttcaggtatttttagtattgttctatgggagtgatgtgacatgggcctagatggatgccctgcacacagtgttcctctcttgcagtggaggaacatgagcttggagaatctaccatgtgtatagcaagcagaaagcaagcctcctcattgtctagagggagattttatctcatccttcaaggttgcttgttggaaactgaaccttgagaatggcctgggaaaagagtggtccggaccttgcattctttgcatacccaataagacgtgtaggagcaaaactcataagagactccctggaggtgtgtttctcaagaaaaatatgtctataataatctatttgcaatgcatagcaactcagaaaaacagagactgcctatgttctatttcagaaaaaaagcaaaacttcaatagacgttgaagttgcttatctgtaacatccaagaataggacgctggttaggtcaaaatgtgagctgaatctccttaaattatgtggctagcttagatctcagaagataaataatgaataggcacttcttaataacttctaacaacaaacaagttgagatcatgatatttctttaggctgcaaagtagaggaatctatcagaacaaatccaataggaaggatttggagagctggagttatccagggtttagtaaaaaaattacttctgtgctgactgcattgtggctttgctgctaccagggactctgcaaataaaagaaaatatgctttgtttaaatatttgcagtatctctttaaatgtaggtttggagcttctaaaaatttatcttgaatagcagttcagtttcattcgaggttacagtagctttggaaggggaagtgaacagcttttttttgttgttgtttatttttccttcctgatgcattgcattaggataaatttatgttgtggcaacctcagcattctttattctgtactttttgtactttttagtttgtcatcctttttttttttttttttttttttttttttttgagacaaagtcttgctctgttgcccaggctggagtacaatggcacgctcttggctcactgcaacctccaccttccaggttcaagcgattctcctgcctcagcctcctgagtagctgggactacagctatgtgccaccacacccagctaatttttgtatttttagtagagatggggtttcaccagtttggccaggctgttctcaaactcctggcctcaagtgatccacctgcctcggcctcccaaagtgctgggattataggcatgagccactgcgcccagcagtttggcatctttataagaataataaataattatttttaaggattctgatttttatcttaataaacaatgaaatacttctctctcctttctctaatttcccttctcaaaaccttgtggggactcattctagggagacagtccttttataccccagagactttcttgcaaatcagtttccttgtctggtagtcattcttactagttttgtgtgcattcttctggagacagttctttaatatgtaagtacttatagttttatttattgacctatttcatagaaaaggtagcatactgtacatgtcatcctgcaacttgcttttctcacttataccttagagatctgttcagatcagtactaaaaacttttctcattccttttttaaatttttatttatttatttatttttttaaagacagtctgttgctctgttgcctaggctggtgtgcagtggcatgatcatagctcactattgccttaaatatctgggcttaagcaatcctcctgcctcaggctcctgagtagctagatgtgtgccacctggctaaattttgatttttttttttgtttttgtagagatgggggtcttgttgtattgcacagggtggtcttgagctcctggcctcaaatgatcctcctgcagtggcctcccaaagtgctgagattacaggcataagccaccatgcctggtctttttcttattcttttaatagctgcattttaatggctacatagtaacctacttcataggggtgccataattattgtaaaattttgcagtccttttcattataaacatttcttcattgaataacttggtacttatttcattttgttcatatacaaatatatctatgggagaaattttattttatttttattatactttaagttctagggtacatgtgcacaacgtgcaggtttgttacatatgtatatatgtgccatgttggtgtgttgcacccattaactcgtgatttacattaggtatatctcctaatgctatccctcccacctcccccaaccccacgacaggccctggtgtgtgatgttccccttcctgtgtccaagtgttctcattgttcaattcccacctatgagtgagaacatgtgtgttcggttttttgtccttgtggtagtttgctgagaatgatggtttccagcttcatccatgtccctacaaaggacatgaacttatccttttttatggctgcatagtattccatggtgtatatgtgccacatttttttaatccagtctgtcattcatggacatttgggttggttccaagtctttgctattgtgaatagtgctgcaataaacataagtgtgcatgtgtctttatagcagcatgatttataatcctttgggtatatacccagtaatgggatggttgggtcaaatggtatttctagttctagatccttgaggaattgccacactgtcttccacaatggttgaactagtttacagtcctactaacagtgtaaaagtgttcctgtttcactactttgtaatgattgcctgtttcctgactttgtaatgattgccattctaactggtgtgagatggtatctcattgtggttttgatttgcatttctctgatggccagtgatgatgagcattttttcatgtgtctgttggctgcataaatgtcttcttttgagaagtgtctgttcatatctttcgcccactttttgatggggttgtttttttcttgtaaatttgagttctttgtagattctggatattagccctttgtcagatgagtagattgcaaaaattttgtgggagaaatttttagaattggatttgctgggccagaaggtatgtacttgttcagttttgataggttttaccaaatggtcctccattgaggtagttctaattgagaagtcagtcacagggcttaatggagtccttgggtgggtttcagtgtttccataatcagcatcctatattagtcagttctcacacttctataaagaaatacctgaaactgagtgatttataaagaaaagaggtttaattgtctcatggttctgcaggctgtacaggaaacatggctggggaagcctcaggaaacttacaatcatgactgtgggtgagggggaagctggcacatcttacatggctagagcaggagaaagagagaaaagagggaagtgctacacacttttaaacaaccagatcttatgagaacttactatcatgagaacagcaaggtggaaatctgcctccatgatcgaatcacctttcaccaggctcctcccccaacattggggattacaattcgacatgagatttgggtagagacacaaatctagatcatatcacacccctttaccccacctcacctcatccctcatatagttgttagcaatgtgcaagtgcatttgtctggggagtccataagctcttttgttgtctttttttttttaacagcttcattgagataaaatgcacattacataaggatcacccttttgaactgtacaatttagtggtaccatcactgctgtctaattccagaatatttttgtcaccctaaaaagaaaaccccatagtcattagccatagtctttcctcatttctcactccctgcagcccctggtagccatttaatctgttttctgtgtggagttgtcccagacatttcatatgagtggaatcatacactatgtgcccttttgtgtatggcgtctttcacttaccatatttttttcaagcttcagccatgttgaagcatgtgtcagtgtttattcttttttatgactgaataatattctattatatggatataccacatttttgataatccattcatcagttggtagacatttggcttgtctccactttttgtctgttatgagtaatgccactttgaacactcatgtacattttcacagtcttttaagaacgatttttaatatatagagtataaatcagtgagaaaaatgcaaattaattcaaccatcaatggacaatatatacgaatagataattcacgaagaagagtggtaaattttaaaaatgaaagtatcaatggctgtgtattcctgaagggatattccctctgaaagattactattttataactatgtgaaagaatattaattgttagcaggagagatcttgtggctggttacaggtagttcgagaatgatattcaagaatttaaagtgttatggttagacttttctgtggctcttacctcccttgagtatgagatctaaaggaaaatgtcttatggcttcttataacttcccagtgtgtatacactgcggttgtgtgtgtgtgctgacacatgttaaactttggttattgtatgggtacacatgttaaactttatatttagttataattttaaatttcaaaaagtacaaaaacaaaaaatagtacagagaacacccaggtattcttcagccagattcacctgttgttaacattttacccaatttgcttgcttattctttatctacctacctacccatccatccatccatccactatccatccatccatccatccatccactatccatccatccatccacccacccatccacccaccatccaaccatccatccatccatccatccatccatccatatacacacacaatttttttcctgaactattttagggtaagttacatacctcacagtattttacccctaattttttcagtgtgcattttctaagactaggtacattcttttattaacttcaataatttacattaataaaatagttcaatcacctgtcaatattacaattctgtcagtcgaccaaatatttactggattttcacaaagtctttgtgaaggggacattatttattcccattttactactgaaggaatcaactagctaagtgattcaacaaatgtcatattgctaagatggctaatattaataaagtactatgtgccaggcacttttctaagtgcataacttgtaaatactctctttaaatcttataacagctctttgaaatgaatcagggccctgaggaatacagagtaaggaacagacagagtgctcagaggaatgttaagttttaggctctttttctgcttctttagtgattaaataacatttcatgctttgtgtgtgtgtgtgtgtgtgtgttttaattttaaaacttaaaatctgaaaatgggagctggaatgggagcaggtattttccttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttgtatttttagtagagacggggtttcaccgtttttagccgggatggtctcgatctcctgacctcgtgatccacccgcctcggcctcccaaagtgctgggatcacaggcgtgagccaccgcgcccggccaggagcaggtattttcaatattgctttagttgcatggtatatcagagcagctgtgaggtacattgttgatggaagtaataattttgcctcctctgtgtgtgtgtgtgtgtgtgtgtgtgtgtgtgtcacataattttcctgaaagccatatttgtatggtacattatagcttacagagaaccttcatgtctgttacacagttgattctcaccccaatcatttgaccacttataattgagttaggattcaagcctagctcaattataactggtcttctcctaatccagtggtgtcatcattactctgtgctccattaatagagcctttactttcaaggtagtcctgatgcagctcagactttaaattacccacgtcctttgcttacaactttatgggaaaagaaaaaagaaaaaaaaagaacaaattacccaagtctcgaaacttgctgataccttttttctccctttacaaatgttttttcttaatttataaaaattaagatagttttaagatttaatttttaaaaattaaggtagcagatagttttaagtcatgagggacaaaggtttagaaagattgaccttatttgaataatttggtggtatcaaatgaaacctgtagcaaaaataatcagatccatatttcattatatagtagtcattattgtgctatgtcgttgtgccaattaaattaagtgtatctatttagcatcagccccagaattattttgtttttggattggatgagacctttagaggactaatgaagtggctttaaacttttttgtacacagtccacagtaagaaatgtatttaacctctctttctctcttatactcaatctcatgaaacaactcttactaaatataatgcaccctttttcttttattctgtcctgtgcttttctgtcaaattgtttttgaaggctgtggtgatttactaaattgataaacctgatattgggttataataatgtcataagcactattctggtctaactctctctttttactaatatgtaaatacaccctacaaggtgacgtgatttatttttatttttatttttagattttccaattaattcattgcaatgctgggccaagaattaaggactcctaacttccaattttgtattttcatttaatgacttaaattactattacttttatttagttgcatcaagtatttcttttctttctttttttttttttgagatggagtttcacttttgttgcccaggctggagtgcaatggtgtgatctcggctcaccacaacctctgcctcccaggttcaagcaattctcctgcctcagcctcccgagtagctgggattacaggcatgcaccaccactcccagctaatttttttgtatttttagtagagatgggttttttccatgttgaggctggtctcgaactcctgacctcaggtgatccgcccgccttggcctcccaaagtgctgggattacaggcgtgagccaccgcgcccggcctccatcaagtatttctgaagacacgtgaagcagtggagtcattaactgaaataacaggaaaccattttgaggctcctttgaagatccctgtgttcaggacttgggtccctctattcttcaagaggctgtgcccatggtgtggctttgctgagagcatctggtgcatacttctgcttttacctctcttttggttgttctttatcttcattcagaagatgagattggtagggtttccccatcctataacctagcagggactttgtctattatctgttctcattctggaaactatactacatatcagaaggcattcttcattttaaaaaatagaaggaaatagtttgcaggatgaagattatttccttgataatctgccaaataaatggttcaggttgccagtatgaagcttctttaatttttggcaaatgggagctggttatatgcatacatacacacaaaacttaatagaaagagtaaaataaaattttgactgtcatgagattgagaagagtagagatagtgaaagtctaaattttctctttttttctgctttaaacaatttaatgagaaaaataagtgtacgtaagattcttaacaaaaatcaaattaagttttttaatgtatttgaatatttaaagtaggattgccacaaattaaatttgccaatgattttaactatgtgtgttttttaagaatgtatctataaatatgtttactgcaatacatatgcaataatgtatgttatgtaatttttatttaattgaaagattgtatttttatttttggtcagttacagtgaagaggttaatcagtaatggcttccactttatctatcagtttagagggcaagattcagccaaatgagaataagaactgttagaaagatgtgcagcaagtcaatgattaccatgtgattcatccataggttatcaatacttgatctgacttgagtttacatgagatattcgaatgtatttcttagcataaaaatcccattttaatttttttttttttttttttttttttgagataggctcttactctgtcacccaggctggagaacagtgatgcgatcatggctcactgcagcctcaacctcctgagctcaagtgatcctcctgcctcagcctctagggtagctaggactacaattgtgcaccacgatgcccagctaattttttaattttagcagagacgaggtcttcctatgtttcccaggctgttctcaaactcctggcctcaagcgttcctcctgcctcgacctaccaaagtgttgggattacaggtgtgagccaccactactggctcctatctagtattatatctaatttaatttatggtcattgagctcatttcttagcaacatcacagaaacaaggctttagtcaattttattaataaaaagagactataataacttacagtgtttatcaatcaataaggtttttagttttaaaaaccttattgattgataattaaattgataattaaattaaaacaagctgggccagcactttgagaggctgaagcaggaggattgtttgagcccaggagttcaagaccagcctgggcaacatagagagatcctatctctacaaaaaaataaactagccaggcacggtagcatgcacctgtagtcccagctactggggagcctgaggctggaggatctgttgaacctgtgaggttgaggctgcagtaagctgcaattgtgccactgcactccagcctgggtgacagagtgagattctttctcaaaaaattaaattaaattaaactaaaaacaaaatgtggacgtacttgaaactttgactcttacattgattcaaccttcaaaggaacttgtccatttgtgaaagttttccttttatataagtctttcttacagtcaaataagtgtttactaagtgaaatactacattttatagtgcagtggcactcaaaggaaactattttgcagctgtagagttttttcttttgtcctttttactttttccaaggcaagatgcctggtgggagagttgtctggaggcaggatgatcagaagcaggacctggccagctgttcgcttatttcagtctgtatgaaatcatctgatatgcccataagagagatgtgtcaattggctaatgggtcagagtattgattttatgttttcagattgctgacagagagattaggcttccagatacaagcagttccacaagtctctgttttcagacaggcacataattaaagtaaccacacagttctctgaggttagagttccatgctgtgatgcaagcctctctatttggtatttaaaagcagtttgaagctgttgtgtaagtatcactggacttggagtcaactgacctaagttctagccttggcccttctactgtcttaacagtggattaaatgatgaggcttattttaaagaatcttgaaaactatagtaatttcaacaagaggagattaattgaatatattatgaaacatcaagataattgaaaatctgtgctgccattattgcatgtcaaaggtcattttgatacactgtatgtgcaaaagcagtttaccaaacagaattacatacagtgtaatcctttttttcttatataggaaaatacccacttccccccacttaaaaaaataccaaacaccacaatgtgtgtatgtttagcctacaaatcatattttttttgcctaggaagtattgaataatttaaatattttatattcagatagctaaagatggcttgctgagataaaacattggagccctgtgtttggtgatagccgtgggtttcatttatttttactgtctttatcctctgtatttattgatagtattgaatatttattttcagaactattatagtgtatctgtttctatgggaagaaatgaatatttgaccacagatggttttcatttttttagtatggggcacgtggattgacagcctttgaaacttgaatgctgtgtaatattcaggtgcttttattgtttatagaaatgcctaatccttgtttgaaatttattaaatggtatgccatctgtaagcccctctaaattccacagattaattagcctttaaagtaaggttgccttttgtctaacttttagtataaactcttccatctgggaactttcacttttatgtccctgttcagtgttctgtgtacttcagcactctagtattaattatggacactggcattctaagtaacatgaagaacactaaaaataaaagtagactgaacaaagtggcaatgtccggagaatagtttgcatttggtgaataatcaatccatcatggctttgccattgctctttgtatgtgcgtgcgtgtgtgtgtgtgtgagtgtgtgtgcatgtgcgtgtttagcattacttaagagtgagatagttattcttcagggaaatttttacagatgatggtttcacaaaaatcagcctttttgtagtttaaataaaaaaacaccctttttgacatttcatgtaacatttccttgtgggttctgatttaaaggttgttgaaaatatttggtgttggcagatcacttggttggctttggcatacttctctttctaggaaatgtagtatcagggtgggaattgtgttgttgttttaaaagaaatagattacaggctggcacggtggctcacacttgtaatcccagcactttgggaggccgaggcgggcggatcaggaggtcaggagattgagaccatcctggctaacacggtgaaaccctgtctctaccaaaaatacacaaacaaaattagccaggcgtggtggtgggcacctgtagtcccagctactcgggaggctgaggagggagaatggtgtgaacctgggaggcggagcttgcagcgggccgagatctccccaccgtactccagcctgggcaacagagcaagactccatctcaaaaaaaaaaaaaaaaaggaaatagattacattctttaactttatttactggtctcagtaagagttattgaacactctagagtgtttactttttaaagtccattgcaaaatatatagaaattagtaattcaaccatctgtgtactcatactaatcaatgtaatataggttggcgctttttatgcacttaattttgccacctctctcacttccccaaagaaattagactaatgtataacaataggcttcataacttaatttagaaaacataacaaaaataatttcgctcagtaagtttctgttgtagtagatattgttggtattaaacaaaaaagtaggatcagatgtggtttggctttcaaggtataaaatctaggtggggaaagagagagagagttaacattcttgaaacaattgagagcattagagtgttccagtatatcctccaaattctaagggtataagatgttcagagaaaataaaaaatcagggtgggttagaataattgagttcaaatggaccttggaattaggttagtggaggagatagcattccaaatggaaataaacaatgcgaataaggaaacatgttagacatgtatggagattatgaagtagccttaaatgataagattggaggagtgtggcttgaatagctgtagatttagggcagaaggtctggttaggccgtgggaggtcacaatatggaagaccttaaaagaaaagatgggtagcagggatacatgactagcttgtttttgcaattgagtagtaagataaaaatattttcttaggagaagttatcttagaaatggtggacaggatgagatggaacacaattgaaataggagtctgttgcagtagtatagggatgagttaatgagtgcctgtattaggagagtggaagagggaatagagagaaagtaattactgagacacattttcactggaataaatttggtcattagtatatacttttaacatattcaatgagtgaatgagggattgagaaggactgaatatagtgaataaagtaaaataatagttactattgatagaaaatggatagatttttaaacaatctagttagagggagatagttcagtttgcacataatgaatttgaagtggtaataactgtaagaagtggccttataattaattgaatatatggttctggggcatagccatttaagggccagagatacagatttaagatgtatgtatatatgcatatatatttaaagatactttctgagggagtttctaaggggaaaattggaagattaataaacgagccttagaaaacataagaagaaattatttaacatttgggttttagaaggccttatttaatcatttgattttaacttatttagtttgagcagtgtgttttcaaacctcttttgaaacaactagtaacctatgctttgaaaaaattgttggttaaaataattgtaaaaatgagtatattctgatctattttgatctgattttaaaaccagggtattctgattcattataactttttctagattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagaggtaagtgttagtaatacggctgagtcgagatgggctaaagtatcctctggattaataaatagagaaacttttacattttaaattaaattatgtaaaataatagtgctaggaaaaggagggtataataagtcctaaaacatttgcagtaaggataaagcatttgaaggggaccctttgaattgtactccccaatctacatagaaaagttgtctccttttcctaggtttctcctcattcattgccttagcaccctcttttctggctaagtgaatcacactgaggcttctaaagtgccctgccatattttcccttttaaaaaagaaaacaatataaaagtgtttttattttttctcagtccacctaacaactaatgtgatttttgcattctgttactatgctgactccaagaggttttaatctcctcagttctattcgggaaatttgctgttttcagaatttctcactgcagtgctgaaccatatagatgcctactgaatggggcttcttacactctttttctcttggccctgagtacatgggaatactcctatattttactgaaaacaatgatttaaaaggttagggaggcaaactatagaagtgactcaaaattctttggggatccgtaaaaatataaaaaatgttgaattctggtcgggcgtggtggctcacgcctgtaattccagcactttgggacgctgaggcaggcggatcacaaggtcaggagatcaagaccatcctggccaacatagtgaaaccccatctctactaaaaatacaaaagttagctgggtgtagtgcacacctgtaatcccagctactcgggaggctgaggcagcagaatcgcttgaacctgggaggcggagattgcggtgatccgagatgatgccactgcactccagcttggcgacaaagtgacactccgtctcaaaaaaatatatatacatatatatattgaattctttcctcttgggtgaagaggcaactgcaatggagtggctgctgtgtttttttctcttctgcttctctccttttctctccctgctggaaaagggaacctggaagtctctgctctagtcttgaaaagtgttatttcctcacctttgattttttttttttttttaaataagacaaggtatttgtaagacaagagatttacgtaaccggtaaagaggaaaattctaatcttaagcgttgctttttctgaaatcgatgttagtttaattgtatttaatgtggtcatttcctttagaaccagaggcttaaagtccctagtccaaagcgaagagttgtctgtgtgatgatagtattggcatttataatactgaactatggacctatgaggtaagtgaatagatatttattttggacactaatgctaaaaacttaaattctcattattctttagcttttgtcataaactagagaaaaaatgatttgtttttcaagatgtgtaaagagtaatgagacaggagccatgccttcaaagatctcatgatccagctgggaggagagacaagtagaaggatgactatggtataatgtgatgaacataataataacagtgtgaatgagtcctaacataatatagagtacgagttccttgaggtgaaggttcttgtcgtattgatgggtactcgatacattttttgttgagtgactgagttataagggagatacctacgaaggaagctgaacattgaactgtaatatcagtttgccatgtgcaaagtatgagaaaggcatgccaggcaaagggaacagcatgtttaaaggcacagttatgaaatggcatgacatgttcataaaaaagtgaaaagttcagtgtatcttgtatatgtggggagtgtgcctgaggctagatatatggttagaagtataggtgctgctgtgtacaatgaggcatccctagcttttaggtggagggtaacataatcagctttgcatattaggaagaggactttgtgtgttgtattgagtatagactgcagtgaggagaaactattggcagagaaagcattagaagactattgaggtgtttcaggtaataaatgagagtctgaacttacactatggttataaaaaggatgagcaatcttagggtacctctctgatgtagcttttgtgggatttgttaactggtataatgtgggacatgaggaagaaaagagggaagttaaggataattcaaaaatttctaccttgagggaccgaatggtggtgctgtcatcggaggaagcaaacatagacagatggatagttttatgaagaaagacaatagtttttattttaagtataggaagtttgtggcactgactagatattgagaattaacattatagataggtaggtagactgacagacagataatgttagtggtgtagatgagattatccaaggagaacaagtagaggaaggaaagtaacaagaatctgggggacaccagtatgaatagtagatagccttgggaaaagaaactcacagcatattaggggcagaactgaaagaaagtagctttttgaagccaaagtaaaaagagcttcaagcaggtcttgggcagtggtatcacatgctgctgagagcttgggagatgtagaaagctgaatttggcaattatcaggtcagttgtaatcttggaaagcagatttagtaggggtaggcatgaagtctgtattaaaattggttgagaaattgaaaggagttaaaattgaatgatctcttttttaaaaaaaaacattttttatgaagattttcaaacatataggaaatttgagaaaataatatgatcaaccccttgctctcatgaaatttataatctaatataggtgacatatactaatcaaaatgatcacacaaataaatgcaaaattgtaacaatgttaggtgccatgaaggaaaggtacatgatatcatgaggccacataatagggtcacttgacctagttagggaagtaaggcaaggtttctctgagaaagaggtgattgtgttaacatctaaaagaagattaggaattatttaggtaagatacaggaagaacatttcatatagaatatataaacatctattcccacatttgtgttgtgtctttgtgtttatatgtatttagtttaaaaattttggttttacatgaaacaattatatacaaattgtgctttctttaaaatatgtgaatacattattctcttttaatactacatagttttttgtagtgtaaatgtgccataatttagcaattctctttaggtcttgggaacccctttgtacccttaaaagttaccaaggatcccaaataatttttgattttgtggtttatatatactgatatttattatatgagaaattaaaactttaaaaataaaaaatttttaattcatttaaaaataataaaccgtaaaccattactttacatgttaacataaataacatgttaatgaagaataattatatctcccaaacctccaaaaatttagtgagatacagaagagtggtactactttatagttttgtaaaaatattttttttggggggaagctcaaatacatcagttttagtttttctctatatacacatttatttgctactaaaaattgaaatagcatattgaaatttccttttgttgcaatccaaaattttgaaaaccagaaaaccaaattaattattattatgctgtggccagactactcagtattttctttacattctttcctccaagttactttccttcaaattcttaatgttgggttttatctcactgacttcaggcttctaaaacacatggggatacttgagacctattgttgcttctttaggtcaaatcaatagtttcataaaaatctttgatgtccgacttaacaggatctggcaggattatctgttttttcatgtaatctgttatgatatattgtttgggttgaaataaatgaagaaaatttagactcacatcggtatgcagttggaaaagggagaactttgcagactttgaaagacttttaggatccccagagttccttggactgcttaaaaccccagtgcacacttgcccaactgctgccgtaatttatttaaccatcttttgataggcagctagggtatttccagttacttgttgatatgtgtacataaaatgtatttccatatatttatgtgtctgtatgtgtatgatagaatctagactagagctagaggttacgattatctgaaattgtgatagagtttgccaaattgccttccaaaaagactgtatccgtttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttatttattttctttctctccctggaggtatttttatctcttttgttttccagtgcttagaacagtggctggcacatagtagttactcaataaatacttgtagtatgaatgaatgtctccctcacccaattagtaggaattatatatgttcataaactatttctcaaaaaactgtgtgttcttttagttcctcatttcttatctggtatacgtggtacttatttatttagtcagacatacagcaaatatttatagagcacttaatgtttgccaggtactgagcaaggaatcaaggatgcaaatatgaataaaagtacagtctagtaagagaatcagatatgtaaacaactgttgtatgagaaagaattatatggatgtcatataaacatataggcattaaaaaaatgaaaaactttttgtttacacacttctgacaccagatatgtggattttctacactgagcaattctccaattctctggacaccaactggatgtcctacaatttgactcaattcttttttaaattttaattgtaaaatattttttattgagacagggtcttgctctgttgcccaggctggagtgcagtggtgtgatcgtagctcactgcagcctccatcttccaggcttaagcaatcccccgatcctcagtctcctaagtagctgggactacaggtgcacctcaccacacctggcaaagttgctcaggctggtcttgaactcctaagttcaaatgattctccttccttggccttccgaagtgctgggattacaggtgtgagccattatatctggccaatttaagtcatttctgacactacctggagctagcacaggctcccacaggttaagggctgagtatccaaagactgcccctgacttcagtcaccagttgcaagtcccaggttgtgacctgtaacttctgactaagtggctataagttgagggttcccacaattccctcttgaggtttgataattttctagaatggctcacagaactcaggaaaacactctatttactattactggttttattataaaggatatgtggggcaagctaaatgggagagacgcatagggtaaggtataggggaagagtgcagagctttcatgccctctccaggtgcaccaccctcctagtacctccttgtgtttgctaacctggaagctctccaaattccattgttaggggtttttatggagcttcattaggtaggtgtgattgattaaaccattggccattggtgattgcacttaaactccagccccctctcccctacttggaggttgagggatgggactgaaaatcccaacccactaattatgtggttggtttctctggcaatcagcctccatcatccaagagtcacctcattagcataaactcaggtccagctggaaggggcttattacggataacaaaagatgctcttcttaccccctatcactcaggaaattccaagggttttaggagctctgtgacaggaaccagaataaaaaccaaatatattatttcttattatatcgcaaattcacaggcatattcttgagggaacatagaagtaaccagtaacgctgctagtggcaatcatgggaggctttatgcagtagtactcgatgaaggaataaagaggattagattatgctacaggaagtgacagtggggttaggggggacatctcattgtggaagccctcatgaatcaatagaattttaggaaagaaaagactggaacaaaaaaaattttttgagtgcccccacccaccagacaaaaaatttttaaaaatgaattaatgatcttcacagctgctgaagtaaaggtggggatggatctcatttccatggtagattgattgattatgaaaggaagagatgatggtccctattttatcaagaagtggtttgtgttcaaaaaggagttagtagaaagaggggattaaaaatcggagaaagcttaaatatttgaaaatcttgaggatcaatcagttaagatctgtatctttctctgtgtgatgctttaggaacagccagcgaagaagtagtgggaatattaggaactattcaagttaaaaaaacatgttaaaaggcttaacttgaagaaaagcatcaaggagaaaagctggaaggaatgaggaagtgtaggaaagtatcttaacaagtcagaatatctttgacaccaacaaggaaatatggaggaaactggctgtgaaatttataaaaaccaagaactatttcttgtagacaaaatttggcatgaacagtgaaatattaaagcccagagaacaacagtgatttgaaagactgaaatttgtccctgaatcaaatgttgggaattgagatgtttcatcatttgtgttattcaaaagaattttttgattggccccattttttttttttttttttgagatggagtctcagtctgttccccaggctggagtgcagtggtgcgatcttggctcactgcaacctctgcctcccaggttcaagcgattctcctgcctcagcctcccgagtagctgggattacaggcacctgccactatgcccagctaattttttgtatttttagtagagacagggtttcaccatgttggtcaggctggtctcgaactcctgaccttgtgatctgcccacctcagcctcccaaaatgctgggattacaggtgtgagccactgcgcctggcctgttttcagtctttttactgcaaggctatgatcttctctggtccgggagtctgccagaggagcaggaacttcccagttgaaccttattagtaaccacctggaagatatttattgaacaagtgtcacatctgtagtcttgtgtatctagaaaccttaagcatgcattattatgttttaattggaaaatgcataggctttaaaaaaaaagattgtgagctctatctgaacttttgttaagtaccacaaaattaagtttgtcagacaaatagacatttgaatcagagatttccaaagtattttaaatttaggaacctaaactcttttagaacagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataaagtaagagagttttgtcaaaggtaatatgcagcaaagctgactagtttgaagaggtttgggttactgaatagacgtcacacaggaaaaaaaaataaactaaatggacttataagggttaatttttctgaccttatcgatattttgtggatagtaaagaagtcatctagctatttttggcataggattcaaggagctggcccactctgggtggtctataaatagtaactctaggtagcagggactggctaaacaggacaaatgtgaattggttaaaaagaaaatcctcttcttattactcattggggttaattctatgattattagtcatattttattgttgagaacctgaaatttaacccaggttttttttcttttttttaaattatcactacagactctgccttttctactatgctgtaaagtgttactttattttattttttctaccttaaggttaaggaaccttaaccttttgtttttggcaatatggtaggctaaaggtacaggaaactcattgcagtttagcacactaaaaaatgatggattgaaaaaataaatcaaaactcttatttcctggctccactggagacaaagtaagggcttctcagaggccagaaataataaaagataagatgagtctataatgataagctagcattggaagtggtgcttgttctggatatagttcctgatccttgcggcgtagtgtctggggatgggaaagaaagctgtggacccaagtgaggtgggaagtcacaactgaggcctcccttttcctctacccaaataaagccagaacttccaaagaatgacactcttggttgccaaaagaggggaacaaaagttgccctaccactcagggagactgttattaagtacctatcttggttttggctttagttagagtggaaacaaatgaaaagtctttcctgataattctttactcaaagcccctacctaatcaggttagagcctaaatttatactactagtgtgatccccccaaaatcaagacaaaaatgcagtttaggtgggcttatgttggtggtgcctgtaggcacctgagggaattgaatgcaaattcttctcagaagagacactttataaaagaaagtgtccatcctagaaaaactggagacccatctcatatgcagagacacacacaggctcaaaataaagggatggaggaagatctaccaagcaaatggaaaacaaaaggcaggggttgcaatcctagtctctgataaaacagactttaaaccagcagagatcaaaagagacaaagaaggccattacataatggtaaggggatcaattcaacaagaagagctaactatcgtaaatatatatgcatccaatgcgggagcacccagattcataaagcaagtccttagagacctacaaagagacttagactcccacacaatcataatgggagacttttttttttttttttttttttttttggtgagacggagtctagctttgttgcccaggctggagtgcagtggcgcgatctcagctcactgcaagctccgcctcccgggttcatgcataatgggagactttaacaccccactgtcaacattagacagatcaacgagacagaaagttaacagggatatccaggaattgaactcagctctgcaccaagcagacctaatatacatctacagaactctccaccccaaatcaacagaatatacattcttctcagcaccacatcgcacttattccaaaattgaccacatagttggaagtaaagtagaccaatatccctgatgaacatcgatgaaaaaatcctcaataaaatactggcaaactgaatctagcaacatatcaaaaagcttatccaccatgatcaagtgggcttcatccctgggatgcaaggctggttcaacatacacaaatcaataaatgtaatccagcatataaacagaaccaaagacaaaaaccacataattatctcaatagatgcagaaaaggcctttgacaaaattcaacagcccttcatgctaaaaactctcaataaactaggtattgatggaacatatctcaaaataaaagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtttgcagatgacatgattgtatatttagaaaaccccattatcttagcccaaaatctccttaagctgataagcaacttcagcaaagtctcaggatacaaaatcaatgtgcaaaaatcacaagcattcttatacaccaatagcagacaaacagagagccaaatcatgagtgaactcccattcacaattgcttcaaagagaataaaatacttaggaatccaacttaaagggatgtgaaggacctcttcaaggacaactacaaaccactgctcaatgaaataaaagaggacacaaacaaatggaagaacattccatgctcatggataggaagaatcaatatcgtggaaatggccatactgcccaaggtaatttatagattcaatgccatctccatcaagctaccaatgactttcttcacagaattggaaaaaactactttgaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataataccacacgtctacaaccatctgatctttgacaaacctgacaaaaccaagcaatggggaaaggattccctaagtaataaatggtgctgggaaaactggctagccatatgtagaaagctgaaactggatccgttccttacaccttatacaaaaattaattcaagatggatcaaagacttaaatgttagacctaaaaccataaaaaccctacaagaaaacctaggcaataccattcaggacataggcaagggcaacgacttcatgtctaaaacaccaaaagcaatggcaacaaaagccaaaattgacaaatgggatctaattaaactaaagagcttctgcacagcaaaagaaactaccgtcagagtgaacaggcaacctacagaatgggagaaaatttttgcaatctactcgtctgacaaagggctgatatccagaatctacaaagaactcaaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttaaaatggcagtcattacaaagtcaggaagcaacaggtgctgtagaggatgtggagaaataggaacacttttacactgttggtgggactgtaaattagttcaaacattgtggaagacagtgtggcaattcctcaaggatctagaactagaaatgccatttgacccagccatcccattactgggtatatacccaaaggattataaatcatgctgctataaagacacatgcacacatatgtttattgtggcactattcacaatagcaaagacttggaaccaacccaaatgtccaacaatgatagactggattaagaaaatgtgtcacatatacaccatggaatactatgcagccataaaaaatgatgagttcatgtcctttgtagggacatggatgaatctggaaaccatcattctcagcaaactatcacaaggacaaaaaaccaaacaccacatgttctcactcataggtgggaactgaacagtgagagcagttggatacaggagggggaacatcacacactggggcctgtggtggggtcgggggaggggggagggatagcattcagagatacacctaatgtaaatggcgagttaatgggtgcagcacaccaatgtggcacatatgtatatatgtaacaaacctgcacgttgtgcacatgtaccctagaacttaaagtataataaaaaaaaaaaaagaaagaaaaatttccagagatacagagccagttgaacatgagcacatgtctgcttctttccctcaaaagtcattaaacacaccaggaaaccataccaccatgaataagagttagaaaaaataaactacagaatcacactctgaaagactatagatatttgaattatcagatagagaatataaaatatattaaaagacagaattaaagtctggtaaaggaacaaaagactaccagaattggccagaacattttgaaaaaaaatctggaaataaaaatttaagttaaaattataaaaacaatgaccaggttaagacagcaaaataggtatacttggaataggaacagctccagtctacagctcccagcgtgagcaatgcagaagatgggtgatttctgcatttccaactgaggtacagggttcatctcactggggagtgccagacagtgggtgcaggacagtgggtgcagcgcaccgtgcatgagctgaagcagggtgaggcattgcctcacccaggaagtgcaaggggtcaggtagttccctttcctagtcaaagaaaggggtgacagacggcacctggaaaatcgggtcactaccaccctaatactgtgctcttccaacgggcttaacaaacagcacacgaggagattatatccagcacctgacttggagggtcctacacccacagagcctcgctcattgctagcacagcagtctgagatcaaactgcaaggcggcagcgaggctgggggaggggcacctgccattgcccaggcttgagcaggtaaacaaagcagctgggaagcttgaactgggtggagcccaccacagctcaaggaggccttcctgcctctgtaggctccacctctaggggcagggcacagacaaacaaaagacagcaataacctctgcagacttaaatgtccctgtctgacagctttgaagagagtagtggttctcccagcatgcagcttgagatctgagaacgggcaggctgcctcctcaagtgggtccctaacccccgagcagcctaactgggaggcaccccccagtaggggcggactgacacctcacacagctgggtactcctctgagacaaaacttccagaggaacgatcaggcagcagcatttgcagttcaccaatatccgctgttctgcagccaccgctgctgatacccaggcaaacagggtctggagtggacctccagtaaactccaacagacctgaagctgagggtcctgactgttagaaggaaaactaacaaacagaaaggacatccacaccaaaaacccatctgtacgtcaccatcatcaaagaccaaagatagataaaaccacaaagatggggaaaaaacagagcagaaaaaccagaaactctaaaaatcagagcgcctctcctcctccaaaggaacgcagctcctcacccgcaacagaacaaagctggacggagaatgactttgacgagttgagagaagaaggcttcagaagatcaaactactccgagctaaaggaggaagttcgaaccaatggcaaaaaagttaaaaactttgaaaaaaaaattagatgaatggataactagaataaccaatgcagagaagtccttaaaggacctgatgtagctgaaaaccatggcacgagaactatgtgacgaatgcacaagcctcagtaaccaatgcgatcaactggaagaaagggtatcagcgatggaagacgaagtgaatgaaatgaagcatgaagagaagtttagagaaaaaagaataaaaagaaacgaacaaagcctccaagaaatatgggactatgtgaaaagaccaaatctacgtctaattggtgcgcctgaaagtgatggggagaatggaaccaagttggaaaacactctgcaggatattatccaggagaacttccccaatctagcaaggcaggccaacattcaaattcaggaaatacagagaacgccacaaagatactcctcgagaagagcaactccaagccacataattgtcagattcaccaaagttgaaatgaaggaaaaagtgttaagggcagccagagagaaaggttgggttacccacaaagggaagtccatcagactaacagctgatctctaggcagaaactctgcaagccagaagagagtgggggccaatattcaacattcctaaagaaaagaattttcaacccagaatttcatatccagccaaactaagcttcataagtgaaggagaaataaaatacttcacagacaagcaaatgctgagagattttgtcaccaccaggcctgccctacaagagctccggaaggaagcactaaacatggaaaggatttataatcccaaaggattataaatcatgctgctataaagacacatgcacacgtatgtttattgcggcactattcacaatagcaaagatttggaaccaacccaaatgtccaacaatgatagactggattaagaaaatgtgacacatatacaccatggaatactatgcagccataaaaaagatgaattcatgtcctttgtagggacatggatgaaactggaaactatcattctcagcaaactattgcaaggataaaaaaccaaacaccgcatgttctcactcataggtgggaattgaacaatgagaacacatggacacagaaaggggaacatcacacactggagactgttgtggtgtggggggaggggggagggatagcattaggagatagacctaatgctaaatgacgagttaatgggtgcagcacaccaacatggcacatgtatacatatgtaacaaacctgcacgttgtgcacatgtaccctaaaacctaaagtataataataataataacaaaacaaaaaaatagatatacttgaagaaagaaatagtgaatgggacgatggatctgaagaaattatatagaatgtaacacagggagacagagagatagaaaatgtgagagatattggacaagaggttatgccaccataactaaggaataaagtaacattcccagtcatgagacatattgacatctgcagctcctgatgggatgcactgagaagggcacagtatcacttctatgatgttcttgtcccaaaaaatgtataacctgaattgtctttaattttattttttatttttatttttagagacaggatcttgctttgttttccaggctggagtgcagcagcatgatcatgactcactgcagtcttgaactcctaggctcaagcctcctgagtagttagtactctagatacacaccaccgtacctggctcatttaaaaaagtttttttgaagtgatgacatcttattatgttgctcaggctggtctcgaatttctgggctcaagtgatgctcctgcctcagcctccttaagtgttgggattgcagatgtcagccagcatgcccagccttactctggaatcttaaaaatattgctaactgagccctacccaagacctatgaagtctgatagggtaggtcaaaggcatttgtttgtaaaccaaacatttttcccaggagattctgaagtatgtctagggttgaaaactgttgtgtgtagttttgtatttctttcttcctatacattgttttgtatagttttgtatttctttcttcctatacattagccactatggaaattgtaaaagcacttattcattagattataagataatgtacgtaagggaagtttttattaaaatgtctctagacagacacctctgtatagataggtttgtctcatatacttgaggacatttatggacctctgttttggacagagtaggggccacagcataatctgtgaagggaacttcttcctggcacataggattgcagattatagattcctttgttatgttttcccctttctattttaaaggtcactatagtcatcctcctttgctgcaaatcataaatgaacatactaaggaggttttaaatatgttttagttaggtcttaaaaaaattaacaaatgtttggaattgacagtgcttttaccctgtttttgttctgggttaatgctgcgccctcactaggtctggaatctttatagtttgagacatcagacttggatgaggaagggtaaatcatgctactagtgggccagttactctgtggttttcttatgagactgtgctttaaggaaaaggtaaccacggagcatatggcattgagtttgagtcatgtggaactggttagaagtaaaatgtttctattccagcattctctgagtttgtcagcttttcattattttataggaagaattctagcttcttatcctgagatgagcttgtctccaaatctggttccaattttttgttgttgttgttgagcacatttcgccatatgatatcactattggctgtaggttaaaagttaccgtgtaacttaaacgtcagaattcaaaccaccaagtatacacggttttgttcagccagatttttaaatgaaatctaatttgagtttttggctaaaagtactttccacatttatcaaagtgacacatgaactgaagaaatacaatgtatctgagtaccaggtgttactgaatctggaattgcaggagggtaacagagccaaaggcagtcctttcctcaaatagtcttaacgtattcatgtttgtcaaaaatgtgtctacacaaagtaattggttctcttttctctgtagatttcatcctttgttgaaaaagatgtcttagaacctatcaagtgcagagctgggttttgagggcatggaaaattctgttgatgcttttctctagttttggctttcatgtgagttgtacatagggaggcttataaggagcatcctagtggctttaccttgtatcacttggctactttttccccacacttcattgttgtaatgaagggaaaggcagctgaaaccagaaacctacatcccttgccaacttaagagataaaaggaaatttatctcttctgctttctacctagtgagaaggggtcggtgagaaactaggccaggtgagaaaactactatcagagtttaagttgagtacttcgatatgttcttcagaccatacatcttagttaacataaaacaaggactagtggatagtttgtgtgaaatagcattttcaaccaccattttcagtacttaatatagctgggtggaatcatgctgtgtaagtgctgcagaacataaataataaaggaaataaacatcttaattttgtaacaagtgaaggtctaggctaatattaagggtagtataggatacttttgaagcttttgaatgtacagaagtacatatgtaattattatatattgcttagacttctaggcagtttgccattcatgtcttttttgtctccagattgagctgttttgtcacattagtgagcatttgaaacataattttaagtgtcattctacaaatggttcttaattgatttatgactaatgtcagtatgaactgcaggtgtgtgccgtgcctttggactttttggtgtctgtgtgttctgaacataaattggccttagtatgttatgcacactgtcagtttatcacaatccatggcctctgaggagccagaagtacggaatgtacagacgatctatgtaccttatattattttctgtctcagccctttcccagaattcccaataaagcagatttctcaattacttgcttttatttttcctttctcccatttttttttttttggtaaattaacaatgagagataaatggaaataaggcagttggaagaaaagaggatgaaaacaggtgaagattcttagttgtggaataagctaggttggctatgggttgataccatgtgtgcttgggtagtaaaggtagctagttttttctgcgtgttgtattaagccattatttatcaaatactaattacgttttatgcactaaatactagtccaagtattctatttgatatatggattaattcatttgttcctcctagtgccatgaggcaggtattattattcctgatttacagatgaggaaaccgaagacacagctaatatgtggcagagatcagaatcacaatctgcctctggagccttggcttaatcactgacagagcaacagccactcaggcagagaaaaaggagttggcatttacagttagaggagttaggactttagtaactctgcccgtttccctaaagcttaggattggctgtgataggggaaagtagcttatgaattgactggattgatgtaagtataacagaaaagagagattgtactcaaatttacagccatgttttttgacatttagaataatcagaggatacttttctgtagtgagaaatatacaaagagttgttcacacacacaccttttatattaaacactgactcagtgatgtcagcaatctaattactatagagtatcagttatctaatactgtggaacaaaccaccccaaaacctaaacgcttaagacaacagcagttattattttggtaaagaaatctgcaaattgggcagagttcaggacagacagttcttctttgcctccgtggagtgttagctggggtggcttaggttggaggacccactttcagattggctcattcacatggccagtaagttggtgacggctttcagctgggacctgagcctgggatgtgggccagggttcttggtttttcttcatttggacctctccacagctgcatgggtttcctcacagtttagtgtctgggttccaagaataagcatcatctattagaatagtgcttgctttataattgcttattgaatgaatgaaagaatctcaggttgttttcttgctcatgttggcccatttggcaaatagccactgtaaagtgcaggtttcttcccagagcacggtaatccctggctctgagaactgctatttagagggttcttttatcttgacttgaaggtctatttcttcatttaaccacatttatgtttctaataaattacccccagttactactaggctgcaaaaatcatctctgaaccattcaataaacagagaaaagaaaacctttttaaaatttggaaactaccttgaaaactccccattttttcctccttttagtctcagttgcattgaaagttaacataatgttctgttcctggatctggaaatggtgtaatagtgacttcaccacctgccattcttgagttgtgggttagtttccctaaaatgtagatcttgacaagaggcagatggtgcatgaagtttatttatttgtttattttttgaaaaaggaatacctcttatgaaccaggaactagaacaccccttagcttacattctaacaagaagagagacaataaacataagtaaaatgagaaaattataaattctttggacaaagggataaagtatagtagggtaaatggttttacatgttgaagggtagttgttgggactgtagttttatttacttatttttaattttttttgaggcaaggtcttgccctgttccccaggctgaagtacagcaatgcaatcacggctcactcagccttgacctcctgagctcaagcgattgttccacctcagcctcctgaggagctgggaccacaggcacactccaccacacccagctaattattgtattatgattattattatcgtagagatgaggtttcactgtgttgcccaggctggtctcaaactgctgggctgaagcagtctgcccaccttggcttcacaaaattccgggattacaggtgtgagccactgttccctgccaggactgtagttttaaatggtgatcactgtaaggcaggtgtttgagccaaggcttaaaggagaggagagggttagccatatggatatctgaggaagaacagcattcttggcagaggaaacagccattgcagggatcctggggtggaaatgtgtcttgcatgttcaaggaaaaacaaggtggctttgctaaagagagagtagtaggagatgatgtcagagaggtgagatacagggagaggtcaattgaggtaagacttctgtcgttttaaagatttgggcttttaccatgatagaaatgggaagccatcagaaggttttgagcagaggtgacataataatctgacctagattttaaaaggatcactttagttactatgttgccactagcctgaacctggtaggcaggaagacaagtgtcctgctctgtgtcatctttgggctttataaaccatgttccatctgttgtctcatttgaatctcaggaaaaccttgtgaaatatttgttatttttcatgttttacatgtgaggaattggaggcttagagaagttgaccaagtatcccagacatactcaagtgagcagtctcagagtaacatcttgaacccagatctcctgtctccaaattttgtgctcattccactatttcacattaaaacctgaagatctccctgctcttttcatcttaacgtaatttcagctttttgtgtgtggctctccaagccacagagcagcagcagcttttgaggataagaagcagtttcttttaaggataagaagcagtatggttcttacctggtaagatggcttgaattcaaaattgacctacttgtaccataagaaagcaggtttgcaaggagtagaatagacttggagatatgccattttttgttcagctacttggtatgaagactgagtatctgaaaccacactgtaaggattaagtggcttcataaataatctaaaacagttgttggcttttagaatttaataaatgaaaaagtaaggtaacaattcttataatactttttccagactttcggggaaattgaaatcatttgtgttttattaatccatgcttttcaggaccaatggcccataatgtgagcaaggtttattggtgtaatgattattttgtggcctaaaactactgtgactctttggactagcatgtttctgatcatagagacagctagagacttcttcttttttcttaatatttgtagcttgttttaaacgtactgagtagaacctgatttaagcaattatacaaagtttggttagattgctttattaatattatgaactagaaacagtcaccaaatgcgcattcattatactaatccttactatgattgagtcatttctttgagttcttggaaatctaatttttctaaaattaacaaaaggggacatttgaatgatgcaaaagcactcatggcaagaatctaaaagttcatataaataataattttctcatactcttttatacatttgaccattacaagatctgtcaaattcctttcaatatttgtgatgtcacagtcgtactaaaacaatcttgaattctggcagcgaaatgaagttcttacctgtctttcagatgttaataaaaataagggaaatacaaacctgtagttattcagatggttaaaattagtttctgtgggtcatttcatagagttcaagtatttaaatgtttttttagctgaattggacaatcaacttgtctgtaatttagcttaagagaaattccattttaagacaaaaaaactacagggaatgtaggccaaaaaataataacaaccaaaaacaaacaagtgaaaaacgttaaaagattcttagcagaatttattaatatattacctcttcaaaatatattctagccaatggatagataataaaattgagacccacagactatttggatcctaaattttgtttcatcatgactcccttgttgaaaatactttattgactctgtgtaatgtaaataagataatttttgtgaagctcattgaatgcgtctgagctccttaactcaaaaaaggctaaaagttactgaaatagctatggttaagggtatattgtcattacaatgtgataatcattaccaaagtgggcacttggaaaaatagtgaccacttatgagccaaaccaatcaacattaaaactgatttccagtaagtacagctgccaagtgattatagagcagcctggatacagatgggatagactacaaggatagttaagctcaaagcatttgcctgttaacagccatgaattgtgaggtgaaatgccagtttacatagtgttagtaaaatcattaaaagaacaatgattagtagaagaattctttacaaaccttaaagtatcaatagttctgaattaattcaatttataaattatccataagtcatacaaatagccactttgtactttttcatgtccctccaaactcccccagtccctatttccaaactgtccacttctgttgaatctattgtaaaaatgtgtaccttttagggaactgagataggaaagatgtgaaaaacaggattagtttagaataatggttctcaaacattggtaaagtcacctagactagtacaaccactgcggaaaacagtgtggagattccttaaagaactaaaagtagaactaccatttgatccagcaattccactactgggtttctacccagaggaaaagaggtcgttaaacaaaaaagatatttgctcatgcatatttatagcagcaaaatttgcaattgcaaaaatgtggaaccaacccaaatgcccatcaatcaacaagtggataaagaaactgtggtatatatatatgatggaatactactcagtcataaaaaggaatgaattaatagcattcgcagcaacctggatgggattggagactattctaagtgaagtaactcaggaatggaaaaccaaacagcgttatattctcactcataagtgggagctaagcttgggatataggtgcaccaaaatatcacagatcaccactaaacaacgtactcatctcaccaaatgccacctgttccccaaaaacctatggaaataaaaaattttaaaaaaagataattattaatccagtttttggtgaatcagtgagtgacagtggttatagtagtggtggtttaaatcaaggaataaatgttttcaaagtgaaaggagcacatcctaccacacagttcaaaaacaatcacaaatatggcaggcttgctgagagctttcatacatcatttattgtcatgcacttgtatgattattgtatactgtacacatttttattttacaatgatttgtattttccaatgcgtttattgcagttcagtgtggtagatggctggagcctatcctggtagctcggcgcacaagtcaagaattaaccctggacagggtgccatccctttgaagggtgcactcacgcatgttccgcacactcattcagactggagccatttagacgtgccagttaacttaacatgcacatctttgagatgtgggaggaaactggagtacccacaggaaactcatgcagacttggggagagtatgcaaactccacacagacagtgaccttggctgggaattgactttttttttgtcatcagtgttatcacaaaatgacattgcatgaaccagcattgtttgaagacttgctgtattctgattttttttatctttcatctttgagtcattagcaccaaatatagttcttggaacataataggtatttactacatgaataaattaatggatgaatcattcattctgggaaatgttgtcaacatagtgcagtgatggaattccaatcctgaatccaaatcctgactttcttagttatttagagcataaacttgggcaaactgtttaaactctttgagcttcaacttcctttgagccttcatttccttagtacatagtaggtactcaaaagtggtagctactgttaaaatatactgtatttgcatcttagaagagcatttaacattcttgtgatatctttatggtcaagatgggaaattttgacctaggtggtatttcagttaattcataagtagataaacctacgtttttacagatttagaaggagctttttattttaataacaactcagtacaggatattgatggcatgctgatactttcttggaagaatttcttttgctaatgaggagcctaaaagttcttgattgattagtaggtaagtgtttttaaaggaattgatataaattattcagctggatcctaaaactcagttacacaaattcagagttgaggtgggataggaagagaagcaaaagtaatggttcaaaatcgatttgtgtgaaaggacttagggttttaattacactgggctcaatataaatagagtgtaatataactgccaggaaagcctatgcgatattagactgcatcagtagaacaacagtgtctagaacaaatggaggaattatccttttccattctgtagtggtcatactacctaagaagtactgtggccaattctggacattacctctgagaagcatgtttataggacagtgatcaaatatgctaaaggaacttcagactatgctgtaaagaggagcatgtgaaagaatcaagaaactataatcttgaaaaagaaagcctggggtaagggggatgttagatgtctttggacattagaagaaggcttacttagacttgttctggatagccacagaatccagaactagtatcaaaaggtggaagtttttttgttttttgttttttaaaaaggaagcacatttctagttaaaacaaggggaaactcttaataattagggtggtagagatactggagggatcagggagtgagtacttccaccaaacaggaacattagtatatggatatttcactaataacaatagcggggtcagtaggggttgaattaattgagattctctaaacttaggggaaagttcttaactttgattttattcatagcttactttcataattagaatttttggcaccatgcttgaaagaaaaagtaaacactttttttttaaagttagtttcctaaagaagaaataaaatttcttagttgtcatcacactcttcatttgacttccctcccaaattgctattgttttctgcttctctcatgttttcttaaatactcatcagggtgacttttcttaagtttagacagacattccactaggtctcttacctcatttgtggcaaggtttatattgatgtgtgactgctcaggtaaacctttagtctgaatgatacagctatgacaaaatatagcctcagttgtagcaaaattaaatgttacacaatggctttaattggtggtacacctttgaagagtttgcagtatgcccaagtgctaaagcataccatgtgagaatcactgggtagcaatgatttctgggggtgaagaattgaggagaatggaaaatatattaagggatcagaaaaatattctagagaggtgtgtctgctccccgttttcccccaacactgatttccccaaatttggagacaaactactattatctcaaagaaccgcttttcctttagaaccacaggctccttaactaccctttttcattagccttactttcctcttgcattttatccctccaaatagaatcttttgtgcttctctagggagattccctttgtgttgaattttatgagtagtgtaaattgtgtgggttgcatcataaaacaaagtgcgaacacacacacaaagtcttattgatgagccaagttcctaagcactattaatgagttaaaagtgttaattaaggctgggcgcagtggcttacatctgtaatcccagcactttgggaggccaaggtgggaggatagctttagctcaggagtttgagactagtctgggcaacatagtgagacctcatttctactaaaattaaaaaaaataaaaattagccagatgtggtggcacatgcctatagtctcagctactcagaggggctgaggtgggaggattgcttgagtccaggaggtcaaggcttcagtgagctgtgattgtgccactgcactccagcctgggtgacagagtgagaccctgtctcaaaaaaaaaaaaaaaaaaaagttaagtaggcagtatttgcttatatgtatatattttgttgttttctccaaatgcttatgcctctgaagaggatatacattgatgagtgaagatattagggagggtagggagaaagaatagaagtttttacatataaatacaaatagaagtatttaaaaaatttttttttcttagctttatctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaagtttttaaaacatatagaacactactattgtttaaacagtttataaataaggtacttttatacttagaaaaattgtttttgatatgtgcaggttaccatgctaaggatttgaacaccttcagtaccctatttgtacttgcgtctatgcctagcatttttgttacgtgcatggatctgcaaaggaattgtggtttgtttcacagctgcatgtagcaggcatatgtgtgacatatttttatttcagctattatttcctgttttttattttcagcatgttggaacaggattccaggagaatgaaccctagtgtgagccctgcaaatcaaaggaggcaccttctaggattttctgctaaagaggcacaggacacatcagatggtattatccagaaaaacagctacaggtaagatggcatgcatctatcttttggcctaagtgatttaatgaagctgaaacaagagaattatctgtagtataacattgcatctaaattgttcgtgtatattttgagtagtagaacacataaattactgaaaccattaatacattttacttttaatattgtaaaattaaatttactttgaaaccttttgtagttttaaaattcctatagagatgtaatcttaaaatctcagtttgtgtgcattaatatacatattgaaatatatacatattatatataatgtctttaataattattttatctatcatgtgtttatacatataatacatctaatatttgttactgtctcacctgtggatggatatgatatggtggaataacatgattgaacctatttgcagtcattaggtaaaatcatttatactcatttattgtgatctttgttgaatccctcccttgttgcaatttaataatgacttgataaatttccatattgcttgtcaatagcaaaaggctttaattgtataaaaatgcaatttctatattatgttaactagaagaaggtatagtggacatttttatagttgtatactttttgataaacatttccctgtgttatttagaatttgtattagagccaaatggagccaggtccttgactaacaaggcaaagggaggtcacagtatggtaactattgcacagtataatgcttgaaaattattacagatttgtttacttttatctctttaaggatttgtaggttgagggcaatctttcttcctgatttttactgtgttacatccatactgttgaaagatgatcaccacaatcctgcaggcttgtctccacttagccttcctgaaaaaactgttatttttgtggagtacagtatgccaagtcagtggaggacccaaaggattttatggcagtagctgcaacgcaacatagcaatgatagatgtcataatgttggaaaacatagcatttcctgcttttttacatgccaaaattcatcatacttcttaaaatattcaccttgatgatctcttaacggtgcccctgaatattggtagagtttaatagtatatttaattttcataagtaatttgtgcaggtttgccctacgtgttctataattttgaattctgttagtgtccacataagatccatcaaaaattaaatttaaatctaatagcctttggatttacgagagttgagatagcgtcttgctaaagaatagaacaagttatggattgaatgcttgaaattacagttcaggtaagctttacaagaatattatttattctgcactaactgcagcaagtagaagccttccacattagcataagataacatggtggctcccagaaagcatagtagtctgatcatactagttcaaactaaaagtctgaatgactttctggctgaaatttatcagctttcagagtagtacatgggatgcaagctattttttccctcccttctccaaagtcaccattgagtgaataatctgggttactggtcttggggaaaaaaaaaaaccaaaaaacaacccaggaaagattatggattcttgattccatgcaagtcctttgaaatatttttcagcaacttgagagatttaaataaatgtcagtccattaatttgatgttcttgattttatcagtataaatactgaataaaagataccaaaaaatgtttgtgaaacatttgaaagcacctaatattactttgttctgtgttctgaactgaattttagatgttttatctattttcagccgtgatacctatacattttttttaatgcagcttactttatgtttctttttctaaggagagctatgagacatggttcaaataaaaaatgagtagattctaatcccatagtttataatattgtattagcctatcatttagtaattaactgcttatattttttcagtcatagaaatgtgtggcatataaatagtatgaccatataatgttctatcaaactgggacactcttaagaaggaaaggtagtgctagtaataattacatcagaataccagtactgctgtcttggataaatgagaaaggatggtcaccctatataagatgtcacccagaactgatctttactccaagaattctcattaactctagctccctagcactgtcctttactttatttactttaatgatttatttgttgaatttttttctcttggcataaaatgtttgcaagcagactcgaactctgactgttcctgggctaatgttggtctaattgtctccagattgtatgttggctgattttctctctcctttaactccacccaatccttgtcctggtatttctcctatcagactttttttttttttttccaaagaatatttttggctgatagaacaaagccagttagcacagatgtgcagaaatcattactagagttcagatcacaaatatattttcaaaagcagttttggacttttctcatggactacagtgtttgtatttttctaagtatgcaggcatgatttttaaaataatgcgtatgtcatagatttataagaagaggtgttaagcagcctcctcttagaggcattcagatttatcaaacacaagacagatactttttttccttctcactcaatgcttcattttaggctgatccttttgtgtttgcattcattacctgtgcaccaacatgtctgttttattccaaacaacttaaacctacttaacccttacagccacaagagaggacattgagaatattcctggtgcaagttgcagggaagaatgttctatatatcctctgctattgtttcttttctctcgtgtgtggcataaatagctatctctaacttttaacttgaagttagccttccactctgccagagttatttctgttaaggggccagtgctttctgccatcttacttgccctttcctcagcatttggctgtgtgggtcatttgctccttgaaagactttccttttgtgttactatggttttttagtttcctttttttattggctgctgcttcacagtaatctttgtgggctctttttttacccaactctcaaggtttggaactgtaaactttttttattttctttctgcctaggtgactcatctataatttcatgcacagttcatatctatatgtcctgatgactctcaaatttatgttttcagtccagacttctcttctgagtctccagagtcacatatccaatagtctctttgacatctctgttttaacatttcaaacttaacatgtgcactgtggaactcagttcctctccctgttttacttccaaccaattttctacaactgtgttttttcctttccattgcttaagccagaaatcctgattcctgtctttcaacaagtgttgttgatactcttccccaaaattgtcttgaattggtccactcctctccgtctctgctgccacaaacctagtccatgccatcatcagttcttgccaggattgccatagctctttcctaatcagtgtctcagcttccccttttgcctccattgagtccatttttggtaccatggcaaggtatgaatgtaaattgaaatatatcacttctttatttgaaacacttttatgacttcttattacatttagtaattccttattatgacctggtcttttattatgaccttattatgattcctttccagcctcatcctgttccctctctacctccccacttgcttgcaactcttcagccagtggtctttttaaagttctttgagcccacctttcccccacctgcctcttttatgcctagaatgctcttaccccagtttctatagaggcggcgtcttctcatcatttaggccttgatgtaactaccatctccttctcggaccattttatctaaagtatatactaccattgcttttccatttcaaccatttgtttgtttctttcatagcacttactagagttcggattattttatgcatttattttcttctatttggtccatcttccccattaaggtctttggggacagaaactttgattctctcattccctactggattctcagcacctagcacaatacctggtgcacagttggtatgcagcaagtatttgttgaatgaataaatgaaaagtgtgagtctcactatgttcagttttatatgtttacatgttttcttttgagatattagcatatctagttttctaaatccagatcatcctatataaagaaattcaagagagatgcaagctttgttagtgagagagattaagattgcagactgaagagcataaataacagtaatatccccatctcaaattctaactttcaactccagttttgctccctacgtcacaccttggatatgaattcacatgatctacatcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcattttatgtctcaccctatccttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataataccacttgattttcgcctcaattaccccgttactgtgttactacctctgtaccagcagcattgtgcatgtcttaagctcattgaagatatgatgaaccatgtgttattgtatcgcttattccaaattaattgctcaataaatggtgattagacaaatgtgaattaccatcctgtctctgtagaaaatcagaaaatgacatttcatgtaaaataaggttttgtattttatactttatcttgcagtatattctgtttactatatttttgtttccatgaaaagttaacactaatgatgattttcttatagcaaacttcttaggaatttaagatacaaggaaacaaattttgtgcatccatgtttcagatatgatcattctgtttcaaatgacaaagccctgatggtgctaactgaagaaccattgctttacattcctccacctccttgtcagcccctaattaacacaacagagtctctcaggtgagtgttgtagattattgcagaaacatctgagttggttcccatgtttagttttggaacctagacaagtaattggtcaagttcactaagtgactgagagaatctctgaattatttgtggataactgtaggcatattagttgtccagtttctccaccaacctcatggagatggtgatgggtctattttatgtgatagttgcttacttaaatatgtcttctttaaaaactacagaatgaaattaatattaaaatttcatggtgttaggcttacagttggtaacattcatagcagaaagtacctttttcttccaattaggaagataataatttgtgggtatgtgattctggagatactttaccgttagtacacacttctttatcaatttttcccttgaatttttttttcctgtgattttggaccttacccttaaaacctcaaaaactacctcagattttttgtgatatgtagtaatcaactacagttaaacatagtttaacatcttcacagctgctgtaaaaagtaagcaaaataagggaagttatatatgagctatgcttttatttcgtgtgttgaaaaatttgaatttttttttaccccaggcaattgagttcattctttttcttctcccaaaagagcatgattttcaagaggttttaatgcatctatttgttgttaggggtcctatgacttgttaagttctctacaatgtgtctcaaatgtttgtgtttatatagcccaagaacagaaataggaaatactttttattttgttttgttttattttattttatttttagacagggtcttgctctgttgctcaggctggtgtgcagtggctggatcatagctcaccgcttccccaaactcccaggctcaagtgatcctcttgccttcgcctcctgagtagctgggactacaggcacatgccaccatgcccagttaattttttaaaaaaattttctgtagagacagggtctcactgtgttgcgcaggctgatctcaaactcctgggctcaagcagtcttcccaccccagcctcccaaagtgctaggattacaggtgtaagccactgtgcctggcaaggaaatactttttttggtggaaaaaccttagcatccagtgtttatatttgggaggtatttagctgtagttttctttgaagtttgaatgcatggttgacaggtttaccatgtaaaaatgcatgtcttattaaaaacaacgttaagtgtcaactttttcaaatcaaaaagcaatattgagtcatcaggcacttggaatgctctttggaacctacaaatgattagattcatttccacccacagggtgaaacatccatttctatgtttaattaatttctatgtttaattaattaaactatattttataggttaaatcatgaacttcgaggatgggttcatagacatgaagtagaaaggaccaagtcaagaagaatgacaaataatcaacagaaaacccgtattcttcaggtatgtttctgtttgtctttgaacaatagttggcgtatttgttggaaggcttctcccagctgggttactctcttccctagaaggttggtaaacttgagctttagcctcttcccactgtctcctgctgcttccgatgcagctatcattgccactgaagtcctcctcccaggttttatagcactagtttaggttttatagtattagtagttccctgatcaggcatcgtgctatttcttgctctcaccttcaaatttgctttcaagccaggagttcctatgcatggatatctatatcaaatgtctttgtcacaatggtataataaataatactgcttatctcctcttttcttagagcttttcaaaaagagaatgttaagacctggggcagtttggaaatgaagacatccatttctgaacttagacatttactactatggtttaatgacaggtcttacttagaatctgttaagtgggggttccatctcaatgttgtttgccacaaaacaccattaagtcattccgtcattcatcaaatatttgttgttagaatttagactagcaactggcatctgcaagttcccaataatgagccaaggactgttcttgatcctgaaataaagtaatgggtatgataaagtccctaccttaatggagcttacactctagtgcagagctaaacaataagcaaataaataaatacacaaatacactgaaaattagagctaagttctctaaagaaacacaaagcagcataggaggttagaatttgaattgagaaatgagtgactagactgagtggtcagggaaggcttctctgaagaagttccactttaagacaacattgttaaggtaattaatgctagctgttataacagccccaaaatctcagtagcttaatggaataaaattttttcacttgcacaaaatttgacttcactttctaggattgcttttctccaagcagggagtaagggatccaggttccttctattgtgtagccccaacaacttgaaattctttgcttcttgcttgagatgttagggaagaaagagtttggtggattgtgcaaaatgttttaagaatcaggcctggcttttagccaatgtttagttggctaaaactctgtcactttgcccaaactactgttagaaagactgggatcatgtatctttctgtgtgctcgagaagaagacaagggtttggtgagaacattgcttttgccataggcagaaaagtcactgaaataacaatgtaaagatttaggggaggctgggcgtggtggctcacgcctgtaatcccagcactttgggaagctgaggctggtggatcacgaggtcaggagatcaagaccatcctggctaacacagtgaaaccccatctctactaaaaaatacaaaaagttagccaggcgtggtggcgggtgcctgtagtcccagctacttgggaggctgaggcaggagaatggcatgaacttgggagacggagcttggagtgagccgagatcacgcagtccagcctgggtgacaaagcgagactccgtctaaaaaagaaaaaaaaaaagatttaggggaaaatctggagaaagagcttccagacagagggaacagcaaatgtaaagaccctcaggaaggaacatgaagaagctgagtacgactggaatgcaggggctgaggggagagtggtagatgagattggagaggcagcagatgtaggctcatagcaaacttcataggctttgatgagaactttgggtttcatcatgggtttgaggggatgccattgaaaggtttgagtaggggagtgacttgatatgatttatattttaaaaaattagtagttgctacataaagtggaccatggtggggagtatgactggaagtagggagacaagaagccattttagtgggctaggtgagagaaattgttgtggtccatactggtgtggtagtcgtgaaggtggcagaaagtacctggatgccaaatatattttgaaagtaaagctgatggaaattgttgatataatgataaatcctatgcttaggtactggatgattggtgataccatttactgagaccagtactggggaaggagcagttagaggtggaagtcaagaattttaagtatgttaagtttgttatggctattaggcattcaagtggagaagtcaagtggacaatcaaatatctgggtctggagtttaggagagaggttgaaactggaagtttaatttgtggtgctactagctagagagaaataaagaggaaagaaaacagagtgaggtaccaagttctgggccatctccaacattacaggttgaaagagaaagaggaaccagtacttgaaaaggaagaagagtagctggccagtaaaataggagaaattgtagggatagtggtgtcccaaaattcaagcaaagaaagtttttaaagaaggggatgtaacagttaattacaggggctaagagagctaagagatgctgattcagataaagagtgagaaattacttttggaattgaccatcagaacttgttagtgaccttcgtgaaagttctttcattggagtggtgatggcaaaagccaactgaagtggattcagggaagtaataatagagggggaagtgaagaaaattatttcagggtgatccctatacatgggaatagagaaatggagtagctacaggagtcaagaaagagttttatttttggatgggaaatatttcaccaggtttacatgtttacatgctaatggaaacatcttaaactatttaattatttcctgactaattggaagcagtatgtgttatgttctaaagtacattaaaaggataacaagaaacatgggtttttaaccattatggaactgttttcatacataaaatgagggctagtctaggtgagctcaaactctgacattctgaaattctgtaattatctactgtgtgcttctcttggcctctccaacttttttcacctactatagtaggcaactttattggttgttaatactaatagaggctgcagacagtcattaacaatgtcacatgtaccccaaagtcccaaagctgcttattggcattggtatgtggagcctagtacttcaaaaattcatgtctgccaaagcctacacgtcagctgctaccatggtcagaggaaaaatggaccctctctcccttctgctttccacatctgaagcaagtgcatcttattggcagaatctaaattatatccagagctctggtggcaaaatagtttgagcgatataggtttcaggcttccatcctttgctacacagaggaagagcacaggagtcaggaatagatcattgccagtaggtaatcccacacagctagtataattaacttaatgaaaaattagattaaaattcttgccctaaatgctttttttttggccttatcattagatggaacttgtcatgtttttctttcctagtcattaaatgaatagagcatttactgtggaaggggtgcttggtattctttattcttaaaggaattccaatgcaagaaaaagaattttgttttaattttactgtctttgttcatttggagatgtgtagtttaaagtcttatttcattctgtgctattttgggtacacttctttctgtagggagcttagatatgctcagaaatgtgagaatcttagctactatagaagggaatgatggggaagaatctgtatttgtcagtagtatttgtcagtagtaaagaagttcctggttagaggaaggagaagaattattctgcttttatgctgttgtcaatgccaaagcatatcaagattttaaaaaaattctgtttcttggtgtaaagagcctgtaactgctctcctttttcttttctcatttcaacctttttttcttccggttacctctttcagttgctaagagtatcccaaactcttataaaatattctgtaattttagtgaactgacatttctttgaaatatctgttgtatttaagcattatgtcttataaaatattctgtaattttagtgaactgatttctttgaaatatctgttgtatctaagcattatgtctttgatttgacttgtcctgtttcatagttctaccctcttcctagactttgagtttttagagaaggtaaaggggaaaattaatgaaatatctttcaaaatgaaggcaaaataaggacattttcacatagagaaaaccaagggaatttgtctccagaagacctgtgctataagaaatgctaaagatattttttaaaagacttgggtaaatgataccagatagaaccccagattagcaggaaggaagagcatcagaatgggcaaatatttgggtaaaaagaacaggactttttaaaaagaaactatatttatcttatgtgtgtgtatttaaatgtctttaaaagactattgtctttttaaagcaataataatggcaatttattatggggtttacagcttatatagaagtaaaatataagacaataagaacacaagggggggagggataaatggaataatactcttaataaaatttttatgttgttcgaataatatttcaagattgactgcagtaactgatatcaaagtataatctctagagcaactactaaaagctaacataaagaagtacagctagagccaggcacggtggcttgtgcctataatctcagctactagggaggctgtggcaggaagattgcttgagtccaggagtttgagaagctgcggtgagctgtgatcacatcattgctctcctgcctgggcaacaaagcaagaccctgtgtcttaaaaagaaaagaaaaaatatagctaaaaagacaatgtaagaaataaaaatggaatactaaaaaatatgcagttcagtgaaaagaagacaggaaaagagaaacacataaagaacaaatagaataaattaaaaatgcataccaagatggtagacttaaatccaaccatattagtagttaaattcagtgggctaaacacatcaattaaaaggaagaaattttcaaactagatttttttaaaaaggaaagatccaactatatattgtttataagaaataacactttaaatatgaagacactgacagatggaaaataaaggtgaaaaaggatgtatgccatgcaaacatgaagcattaaaaagctgacatggctatattaatcagaaaaagtagacttccaaacaaagattattctaagagacaacaaaagaaattttttattgataaaaggagcatacaaggaagataaaacaattctaaatgtctaggcccctaataacaaagcttcaacgtacacaaagcaaaaagtgacagaacttgagaaaaagatctacagcataactggagattttaacatcctctcatttctgtgtaaatgcctctcacatttttgtcaattatgatcttttgctaaacccatacagctgaaaatgcaaaagctcatgactagtttttcagaggttccttagttaattggtataaatcttggataggtaaacggaatatctgttttctgtttgcctgatatctctgtaacttggcttttcctaaggcctacccattgctttctgagactagggaaataagtctggcttctttcaaacttctttgctcatttcatatgggccaaagtagcactaatcatttaaaattcaccagttaatctgttcattttcaaccttatatttatcaactagctataatttagttttggttttatttactacttactggataactatgccagtaagtatagtattttattatttaactgtgttcttcttttcattttattggtgatttttttcatttgttgttaaacagagcatttattgaacacctacaatatacaagacccacattagatttttataaaatgagatccttgacttgttacagagccagaagtgggaacccctatattcatctctgcatattggttccatccaccaaacaaaattgtttccttttcttttctcccttaaacttctgtacatgcttctgttttagcgcttatcgcattgtattgttttcctatatctgtcttcccagttaaactgcgagcttcttaaaggcagaagtcaaatatttaattttgtagcttgggcacatgtaggtgctttgattactgaaagatggatatatggacacagtaatgaacaaatgattaaaaaattatttaaaccattgtttgacagggtaagattactttctaatgaaatagaacttggtaatatgcccttgaagtctgataccctgacaaaccgcttctgaaaatcagcttacataactaccagggagaataaaaaggcatagtgcaaagcaaatgctgtgtgaaagacaggtttccagtgtagcatatgtgggccactaatgggtgtagattgaactgttctcttgccaagagtcatcaataagaactctttaatgatggcttagttcatagatgtattttggcatgaagatctctgtgtttaactcagtaaacaataggatctagtttcattatggacttttcatacttcttaggaacttgtcattgggaagataattattttagacaagcagacattgttatatgttcagtaacacttatatagcttggtcataaaatttgtggtgcttggactagcttttgggctctttctttaaacttaatggaaagtgccttaaatgccttaatctccataagacacttctcccagactagaatggacctaaagagttctaatatctgtcagtgtttaattatttgaactgaatatgtcagaaatcttagcaatggaagtttaacaaatttaagtatagaatgaaccagtataggaagatttcatataattttgtgatacagtattaaactttttttttttttaatattccagggtgctctggaacagggctcaaattctcagctgatggctgttcaatacacagaaaccactagtagtatcaggtaagacagtgcagaagctcttggccaaggaatttaaaatagctggtattttaagaaagttgaaattcacacttccctttcaccttaaatttgttctcatctatgagttttatattagtcatatactctaagatatatatatatatgtatatatatatataacatactactgagcagttggaataaagccagataatttcaaaagttcaactctcccaaatcccttaaatacaaatttagtcagaatgctgttccatcataattttgatgaaaatcttgaatacccatagctttcttgcccttgatttgcatctgtttcatgaacctagggaagggaatgttattttttgagtgctctgtaccaggtgtcctgctgagtgttttacatgtattttatctttaaatccatgtaataactaaaagtttattttatatatagaaaaactggtcaaatcatttattttttttgtaattttcagagtcataagacctagtggtagactcagaattcagatcatagctgttttacttacaatgcatttttcactacacaataatacttaagattttgaaagatttcaaagagaatgctgtatctacaggtttaaatgtcttcaaagggaaatataatatgggaagcaatatggtgtcatggttaagatgctagctttatttgccctgttgggcagagttcaaattataactctacctcttactttgtgggctcaagcagattacatgcaattgaagttttctcatctacaaaatgctggctgcacagagttgatataatggttaaattagataatatatttagagcacttagcatggtacataagtgccccccaaaatggtaaatgataatgatgtgatgtcattgacaacagtatcactgaagtgaaatttgaggatctcagcttctatctgtagctctaccacacatttgcagttcacttatatgaatttaacatttacttagaatatactgtgtgccagtgttctaggcactgagaaaaaaatatagatagatagatagatagtaaaaatgaagtcaaaagctattttattcattatactaataactgagaattcctattaaatgacaatgagcagcatatcagcaatcatgaatgtttaaaatcctgagattgtattatcctgttgaaattgataattcaaatatgtttaaataataactaatcattctctgctaaccagaatatatcattcaattacatttattttaaaaatatatcaatttttggatgcatggttataatggcatggtatttcttcattagttaaaatgttttagtgaattacagccaattttcattatttgtggattccatatttgctaattcacctactaaaatctgctaaaatgtatttgtaacccctaatattagcagtgcttttgtcatcatttgcaaacatgcgtagatgctccctggtgaggttgaacaaggcagtgttctgccttttagtctcagctatataaacaaggtccttttcacagtccacatttttcatatttttgtgctttttgttggtaattttgctgtttgaaatggccccgaggcatattgctgaattgctgtctagtgttgctaagccgaagcgggctgtgatgtgctgtgtggagaaactacgtatgttagataagtttcattcaggcatgatttatagtgcagttggctgtgagttcaagttagtgaatgaataatatatgttaaagaaggtatctctaaacagaaacacataaataaggttatatatttatcacttaacagaaatattgtaaccagaggcttgcaggaacctaaccctgtatttcccccaggaggatggtttaggattcactaattcattgctggcagtgactttttagaacataactatcacaaaatagcaagaagcgactatatattcaaaatattgtaatcagaaatggcctagtgaacaaatggagttatttcaaaggaaattcttatgactcatttattacttccatttaggtcagtctttttctcctcttaataatatttgattgatacatacaagttttctctttgaggaaaaatgaagcatttttacaggatccctttaactcttccagatattggtcctaaaccctagaaaatcctgaacacattaagaactctattagaatcatttgactgtattttttggggcatgatgtggtttgaggtattatcattttagtttttaattttagtaaggcacatacatggtacttttaatatcaatgactagcagttgttgagtgactcctatgggacaggatccatgcttggcacttgacatataacatctccagtaacagtcctacaagggttgtgtggttatactctttttattgaggaggaaacagtttgttcatggagggcaatttccccaggagtgcccacttgagaagtgaagcaggaattctaaaccaagtctgcttgttttcaagtcctaagctttttccacctttttgcacagcctcgtaggcaagcataccttcatatattcgacagggtggtgaaaaatgacttttcctcagatttaatttgtattactaaaaaaattaaaaatcgttcaaacctatgcagaaatctctctattttctgatactttcattatttttacatgctttgcaatgtacttgaccatctagtacattttagagccttgattcagaaatcagaattttagcataagtgaatgggttcttataaaatatcctgatccttgggctttacaaaatattgttataaaaattactgccaaagtgcaactaatattttggttgagagagattcttagaattcagacatagccttagaatgggaagtattttgggaaaacaggaaactttttattttagtaataccttatatttttcttactttagcaggaactcagggagtgagctacaagtgtattatgcttcacccagaagttatcaagacttttttgaagccatccgcagaaggggagacacattttatgttgtgtcatttcgaagggtaagttcatcttgaaagaatagagcaaatatttttgagtgcttgccgtacacaagacattgggctgaatattgtggaaaatacaaagatgtgagaaataggaagcaatataaaataaattatgtgagtggaacagtctaagtactgtaatatatgctttactttgagctgttgagtattataaagatgaacatggaattggtgtcagactatgagtttgtatttaggaaatataaactacttgttgatttttattgtttgtaatcctgatagccatgctgtttataaaaaaaggaaaagtaaaaacataaaaatattctatttaggcttttcctatttaggcttttaaaccaattcccatttggttattgagaaacagacttctgaaatgtaggtttgagatggatcatgggctgattattaattgtggaatgtttggatctatgttcctaagaatctctattcctcttttatctcttcttaattaaacatttggttggtgaagaatgtgttagataatcagttagcttatgtaaaagtaaatgtttatactagcacttttgaatgttatgaatgttaggctaaatggaaaaaatgcatagctgtttatatttcatctactttttctataaaatgaaaatattttcttcatagaattgccatgtgaatatctctgttagagtgctgtaggttaacccaggagcacatgaatgaattagaattcctcagtggtggtttctatcccaagctgttttttctttctttctctctgtttttaaacaagagaagggacctcactgtgttgcccaggctggactcaaacccctgggctcaagtgatactgagtagctggctttcttttttttttttaagaatacactgggtatggttagaagtaagtacagttgacccttgaacaacacaagtttgaatgaagcaggtccatttatatgtggatttttctcaaccttagcaggatgccaaacccacttatatgcagggccaacttttcacacatgtagattccacagagctaactgtgggacttgagtatgtacagatttggagttatacaggcggctctgtaaccagtcctccacatatacagagggatgagtgtctatactaacaatagaatgagcaaattcattctctgattattaccactcactgtcactgaaattctcagttaactagttaattcttttcctaaggtataaatatctagcagctcaggtttttaggaccagagaactttgatacttgaaaactagggagatcaaacatcttatatattttcagttattaatcaaacatgctaagagatttggaacactttagccatagcgtctcatgatcactgccttttcacaaaattccctgtgttcaccttactctatcagacataactggtatgtttctgtacaggaccagcctcaaagtttcttttcagcagcaagggggcagctgagaacaatgtttcctgcaaggctccaactgtactggtctatgaaaacaaagtatttcccttactattgacacaattatgttcaaagtaggagaaaaaaagtaaacttttaagaagattcagtactatgaagaagaaacctgctgggtgttaaaatgattgtgttgaagtatattttatggaagttactgtaggagaatgtttttaacactcaaatagacagtttttctgaggttcaggataattactgtattatttgatcaaaacagtataacagatattagaagtaacacttgtcaagccatggattgaagtcatggttagtaatgtttttctaagggaagagaacaagtattttttatagagaagacaatcctagcttttttttttttcttttgagatggattctctctctgttgcccaggctggagtgcagtggtgccatcttggcttactacaacctccacctcccaggttcaagtgattctcttgcctcagcctcctgaatagctgggactatagccgcatgccaccatgcctggctaatttttgtgtttttagtagagacggggtttcaccatgttggccaggatggtctccatctcctgaccttgtgatccacccgcctcggcctcccagagtgctggaattacaggcatgagccaccgcgcccaaccaatcctagctttaaacagactgtatttttataaaagacagtgaatggcggtttaaaaaatatatatgcattgcatttttttgcatttgtaaaaagtgatttctcattagtttgctataaaagtgctgttagaaaattattgatttccactcctccctagtcccttgatgttcattcaggaagactgttaggactggctctcacacaattactattaggagtatgtctaacattctgtttcgatttttcattttcaaattactgatttatcacattttggtgttttatatcaaggaagagtaaagacaaatgaactgaattagataatagtaattaagataacatcctttttattttttttgttttgtttcaatagtagggaaaaggaagttaattttatcttgatgactgtaaactatgttatgggacaggaattttgttctttaatacctggattgttctttttgctcttgctgaaatgaaaatgaaataataaattacctcatgcttggtcttctttcatctttcaatataaaatattctaacagtttcattaaaaaggtgagtggcatcatttcttgtgcagaaggatgtagactttttctcccacttaggttcttaattttattggcagaaattattataattgatactacattggaaattcagaagaagattccagagccccaggtttcggcttagcatgaaccagacatttataacaaagccaataagcaagctatgttattttattttatgaatggacatgtatttaacaaaatattttaatatctaaagatgtagaagtagccattgactgtttcgtactgttatttaagccactctctcccaaacttacactccctcacaccctgcattcctgtaccttttaatctctttacagttgagcggttgaaattattttctctaaagcagacacactcttggataactactgagttcctgttatagctcagcaagaaaaaatgcttatgatcccagtactccagacaaaggtccaaagtgcttctgttcttttgactctccttaaagagtttttaccaccaacatagtaatctattcggctttctttgcttagttccagttatttgtagcttattttcctgtaaatactttgcctttttctcctctctttgatttgtttgttttagtatgatttggagagggaggttggagaataactttttctcaaacttccaagtcactttgagtgtagaataactgatacattaataagaaaaaaatccaattaagtttaatgccttttttgtttgtttgtttgtttgttttaagagacaaggtctctgttgcccaggatggagtgcagtggtacaattatagttcacttcagcctccaactcctgagctcaaacagttctcctgtgtcagtctccagagtatctgggactacaggagagtgccaccacatccagctaatttttatttattttttgtagagatggggtctcactttgttgcccaggcttgtcttgaactcctggactcaataatgcttattttaaaaatacttttgtggccaggcgcggtgactcacgcctgtaatcccagcacgttgggaggccgaggcgggtggatcacgaggtcaggagattgagaccatcctggctaacacggtgaaaccccgtctctactaaaaatacaaaaaaattagccgggcgtggtggtgggcacctgtagtcccagctactcaggaggctgaggcgggagaatggcgtgaacctgggagacggagcttgcagtgagccgagatcgcgccactgcactccagcctgggtgacagagtgagactccatctcaaaaaaaaaatgcttttgtatgatagtctatttagggagggagggaggaggttgattaaataatataacaaaattaattcaagagctaagacagaaacaaatactcaggaaagctcaaataaagttaagaagaagatgattttaaaagggcagaaaagaaacattgagaagaaagattgggaaatgatattaatttattatttcaatacacatttaaataccatccttacatgtagctgtctcatccactaatatataaggaaagaatttcttcctggggcagtttttcattaaaaacaggttctctttgaatcagatggctgtgaatgtcagtttgccatattatctctacttgtttaatatttttcttttgcaaatgagatggatgcctactttgggaacattttttatttctattacattttctgttttcagtacctgtctcaaattgtaagtaaacacgtaaagtgtcttttcatcagtttcaaatacatacataatattacagaagaatctgagctatagccatatgactgcctgagagatgtctctttctcctctctttccaagtattttatatattctagcaatagtaccatatttgggtatgcaccccttactggtcccttataaaaattattaacactgtcatatatacggcatggattataagggtagccttaagtaatagggacttattgtaagttatgtgagattaaagaagcacaggaaactggctcagaatccaaataatccctctgtgcttgtgcttcattgggtggaatgtatactagtcttcatggagaattggaatagtggtttattgtcatttctgatttgacagcagctccagtgattccactttagtcttttttttacactttactgattcatactcctcaaacacaaagatctgattgggtagttctggtcaccatctcttacgcagagaattactatggcagctttggcttatgatccacagttattcatttgtgacaagagaaaaacctggggccactcttctgagaaaatgactttggcaggcactgggagcttcataaactactataccacacagcctgttttttttaattattattcttttttccccgttcttagtaagtgtgcattaaattctttcttgtattggttcctaattgtttgatctaaaaggcccatcttctcatctatatgataagccttttgaaggcaggaaatatcgtatgcttttgtgactacccctgacactcagcaatgcctaccactgagtgcttactgaacagaatggttttagacatgagccattgagagaagtcacagtgatggaagtttgttgtttttcataatcatttaaaaggtttttttttttacattgttttgcttaaagaaattggaatctattttactgatctaagaagtaatataagctgtgctgaatgccagtagaaagtttagttaaagatgatctctgttttgtccatttatgatttgcactagccagatatcatcagcttattcttgtctctgaatctaagctgtagagctaaataattcacctgagtgtagtgtttaacagctttctatgtcagtaagtagaactttgagatacttgcatcttcatttaaaattatttgttggcagcattttggagtagattgttgttagacctcactgatttcttttttggagaagggatgggttctactatttgtacagattcaagcagtaggagccagaaacttgaaactttggaaacactgtaggaaatactgtgattattgcaaaaaaaaaggttgactagtggtgttatttgttcaaaatgtttgccagaggtttagtcccacggatgggcataaaaacgaatttcaaaaatagcaatgatattttctaacttaatacctagattaatacctaacacatgaagaatggcatattttcttaatgcctgttatttatttcttagaaatttatgtttagtttatatgcatatataaaaattcaacatatgtatatatataaaaattcaattgtatgtatatatataaaatcttcagaggcaggaggaatttctttagtatcaaaggaaattcatttataaagtctacttcaaaagggtacagctccttcttttgtttctgagacctcaaaacttgagtgtacacatagatgttggagtttggccattttcttatctccactttcatggcctttgagccaaattctagctggaaaaaaaagtgaatagatgagtttggaaagatacttgcattttagaaaagggtcttatctcagaagagagatgttttaaaaaaccttcttttagaaggctttttaaaattaatttttagctttaaaatatattctcattcaggtctaaagcacattataaaaaaatagagcagagttgactgagtaccctaggttaataaacttaacctagatttatttaatcattatgccaataatgttctttttatatgtccattttctatttcactttattatatacaaatattaacacttcaatgtatactacctttgtagtttacaaacctctttcacatacataatcttagcaattccttacatataatcacaagtattcttagtcctattttatggctgaaaaagctgaagcaaagagagattaagtagcttatctaaggacacaaaaatggtaagcattagaactagggcaataattgatagattctaatttaatacagtgatttttttttctttacattgttgtgcttttttctttatatctggcacttttagatgtattacagcatatgtaaataaattaatctaaccctccaaaatcaagatatttcattgaaaaatctgctggacagttttggcagattcattacacaacttcaaaaattgtttgtttgttaattacctgattatgtttgtttgttaattacctgttaattataattatagattaagtactttaatagattatgctttcataatgctggagaataacttaatggtttgaaatattatagtatagcttcagatttcaagtcagggaatagaataaataggccttgaaagtttctggtttctttttaaaacagtgtctgaaatttccaacatggtggaaaagaaatgtctttgctttgtcttaaaaaggaagtagtttagcaaaaacagaagctgttttaattattggtattctagagcttctcatagaaaagagtggggtttttgtgtgtgtaaatacattttattatggattctgtatatggcgtgctagatctttgagatcagaagcatttgatctcaaactccttgttaaatgtgagttactgttgtgtggttttagaggattcaactatttgttctttgtctctataacattgctagctaacataaaaacatgttttttacttacacttttcaatcacaaagtctaaaataacttgctttatgtttgagaaaagattgttcagtagtctgtaagtagacttgtatatagccacaaacagagaacttataactcaagaataatacgaagtcttcaaaattctcagaatggtgggcagatccatctgagtcatgataatttttcaatggttcttatttgtttgctctatttggtagtcttattattatgaaatgtgtttttcatatgcatttgtttaatctccccttttcaggttgtatgctttctctgtgcagggataaagtctattcattctgttttgtcttttacaagatctattgcaatgcattgcaggctcggcagagtaagtcctaaataaatgttgactactcagaccactaactgtttatttgtgttgtttacccttattttttatgtcctactcttcaaaagattactagaggtggggtttgcagaaacaaaggaggacatttttctcaatgaatgtttaaaattacttcggtgacttggatagcaatgaaatttttaagaatatatagtcagctttggtgtgggtggactttttgctgtggaatagaataattcctgaaagacttctaaagttactttgaaaaaaggcaggaattagggtgggaggtgggagaggagcagaaaaaataactattgagtaaccaggcttactatctgggtgaccaaataatccatacaacaaacccccgtgacatgagtttacctataaaacaaacatgcacatgtacccctgaacttaaaataaaagttaaaaaagaagaaaggtaggatttaatgattgatagcttaaagttctcatcaaattttttgtaatgagggaagaaaatatttccccaaagcagaactgcattcccagaaagaacatttcttcacatcatgaatatgtgaggaaaaaatgtattttaaacaactgataggtacagaccctaggaacctgcattctagccccaatgttgccactcagtgacatctgctatgtgactttagacaaatcacttagtccctctcatcttcagtttccttatatgttaagtgataaagttaatgtagatttgcttttttccttctggctccagaaatctatagtttttatctgtgtgtttgtgtgtgtgtgtgctttcctcttagaaagctgtagtattgctttaaactctttgaagttactaagtgattcaatctagtggagtcagtgtattttaagagttttgaaaaacagccataacaaaaacaacaaaatgtgaagttacaaggtggggctataaattaatgagtttgttttttgaatagctggcagttttgtaatttatttaataacacttatacagaacacaatacgataatctttaatctttataattgagataggtgcagttatcatcattttacagatgaagaacctgaggcagtcgtgtccattgtgaactccaataagaaagattaaaaagaaggaagaaaaagtccgctgtagaaatgaaaaaacaaatttatccattgtgacatcgtttagaaatagcagtcagaatttaaccaagaaagtctggctctatgttcttgatcatttccctctattgcctgtttaagatatccaaatatcatatctttgaaggtagtcaacttggagtttaattccgttgatctctcttttcaaaacatattttgagttgtttcgggatcattttccagagactaagacaaagccctgtggaaaaccaagccacatgttactcaaagtaatagtgtaggaggaacaagagccagcagggaaacacagaggaaattattagaaatataggagaattggaagagtacagatgaaggaaaataaatcaacttgtttatgttattttaaaacctagaggtcaaggaagagttcagaaaacgaggctgtcagtggtatcagatgttatagcgctccctaagaatgagaaatgaaagaaactcatttgtcttgtgtaaacattaaaatcattggtaacttgagattacatttattgtagagtaatcagaacagaatccagaaaagagatagaagagaatgggaaagaaaaacaatggtttggtaaatctgacactggaaggaaatggagatagcctagatatagataaggagaagagaactaagagtgtgtatgtatgtgtttgtgttaaggacaggagagatatagggatagggtataaggtaaataaggactattgtagttagtttatatacatataagaatagagtttatgttttatgcttgacagatgttctaaaggaaaataaacaagtcattgttcctcctctgtattgttttctgtttaaagtaaaagcatggagaaagttgaacagtttttgtttatttgcagtaggactacagaaaagaaaaataaaagagcgtatggaattaaaaccagatttttgaaaaatcaaatcatatttaaagtactgcttgagatatcaaaagtcttttaaatcttaaatacagagctggtttttaataatggtaaagagttttcaaaatgttaaagtttatagaactatttctcatttaattatatgtaaatggttttataattttttctcacattaagttagaaaactagcaaagtaacctacataaaatttggtataacctttcttatgatgtcacaaaacttaattatggaggaagcaattattataattaggaaaaattgatgacttatgatctgactcaggatcaaggtctgaaacactcatgtcatttcctcccctctcctatatagtatacagtgatttgttcattttggactcttaatattttaacttttgacaccatcagcaaatctaaacactgacagttggtgttttcctgaaaaatgttaaggctaataattgtgtgatatttatttcaacacattgctgctagtcttctataaagatctcattatgggtaggctttgaagagatatccagttcataatatgggcatcacactggaagcctgcaagatggatgattggctgagagtaggagtgtagtttctaaataataataagtctgtttcccctgctaggaagtaccctgagggcaggaaccctctatcttagtcatgactttgttcccaatacatggtatatcaggcatgtagcaggtattcaataaacattgaatgaataaatgaacaaattaattagataccaaatccatcagtttgacactatattctaaattagtttatatagtcaccgtaatgtgataaagaaattgtgatagtctagtttactgagcattgttatcaggaccatctgtgtctcatgtttaagtctagaaatcagtctttgaaaatgagtgaattcaaatgcatttttaaaagtctaagtgccattttgcatgagggaaattatatacctagtaagaatttctctgggtttcaaagtcagaacactgatcttggtaatacatggacagaaaggattatttttcagttagggtgttaaacagattgtgctatcattttaacctctggaatgaataagccccagatttaataagctccttatgtataagatgcctgttataatgtgtctgtaatgtcctagaaagatgagactacccctgcatagtgcttatttcttgcatggaatgaatttaagataagcttgtcaaattttaaatctgacatagactatcttttgaataatttatttggagtcatctctgtctgattataatatgccctaaaataaatcttgaaaaattaaaatatatcatacagaataaacagtctacatgtaacagttaacagttacatgtaaagtgttattcagattacattttacaactatttcttttctgattccattttttattgaatagaagttcaataaattttattctgttaagaatgagtctgtcttggagagggtcagtgtcacatatttactttgaagttccttaaagaggttagttgaattctccccccaaaatgtgctttgaattagcagcttttgaatatctattctagtagaggtaggagcaatatgaactagagagaatgatatgcaataaaaataataatttttctttgactttggaatgaggataatctaaaccacagccatgtaggcagacattttctgatgtatgtaggtatgtttgcatgtctgtctatctatccatctccttgttttctatatatttgaccctaacctttcaggctcctattttgccatcaggtccaaaaccaaactgagcgataagagagtggagatccttaaatcagtggttctcaaactttttggtttccacattcctttatgttttcaaagaaacattaatgagaagagtagcattttgttaacattaagaaaaacctctttaataactggcttaatagaaaccagctggattcttatatctgttctttttggtcaaaatatatgaagaaaatccagcctcacacagagatgtaattggaaaggaaggactattttaaaagcctttcagataattgtgggtattctttgatgctacaccaaaatgcaacaagaggtagtttcttaaaggttagttgcaacacggaagccaaatctgtgaacttttagtactctgaaattaaaatccattggttgatcttgcactttgaatggatcttttacctgtgcaaggttttgttacatcatacattggtcatttgaaaatactggttcactgagttatgcagatcttccaaatgttgacacattttattatgtattaaaatgtcacattctttaatactatcacaaatcttatcagaaaagtctttaaatattgtgagcagttcatggtagcagatagaagttttccaaaattctagttttcacttgagggttcaaattttatcattgtcaaaaatatgtcagttttccttgaagtggtagattcactaatttattttcaagaacatatctgtcagatacccaaggctaaacaactataatttatcagtctttcaagtaaaagtggtgttccatgaagaaagtagctagtgcagctcacaactcagttacacaagtggttttcctctagacaacaattgtactttgatatgcagcagaaatgctttatgtgtatttcccattttgtcgtacagaatattaaaaagacttctactcaagggtcaagatttcataaaattaataacttttattgcttcatcaaagacttccttcaattacattgactgtgtgtggtatgtgcatgtatatgaacatagggcagtaatatgatgaactatataatacagtttgatgttgctgtcttaattcatgctagggcaccatcattgcttttgcatcatcagtgtaaatatcaacacagttgtttcaagataaatgatgagatttaagaaagttattcaacactgaatatttcagtactgttagtgtttgttgccaagcattcctataaaaggtctttgttgttgattacttggggctcatactgaataaatctaagcaaaacataaagtttatagattcttccatttgtaaaacaaaagcacaattctgtagttgagatattaactcagccttcgtatttgcaactaagtgtaatttgatgaattaacatatggttggaaagtgtcatgatttcttatactgacttttcagcaggcattgagcaaggtcgattatccacaattttattagtctctcagctattatatgcactttttcagtcattgcattatattaataacttacaatgtaggatacttccgtggtcttttcatttccagtatgataagctgtaatagaatttttttttagaggattcttcacacctgtgtttaaaatatccagttccattttctttgaactctacatgattggtttcagaatgacatcacaacttaattggcaccattatagtatttgaaagattttgttgcataagcgacaagaagatagattattcatatgtctgaaacaagagaaagatggctttcaatgtatggtcattttttattaacaattttgaccagtttctttgctagattccacctttccgtgagtcataaaattctcaaatatatcagttttatcttttctgtatcttatatgtagacagtatagttgtgggttaaggaggcaagttttctaatctcctgtcttttaagccagcaattcattcttaaatataagaaaagtatgtaatagatttttatatgaaatattaaaatttaagaagctgtagatagatttagaaaacttttccaaaaagatttaaaaataatattataaaacaaaacaaagtatacattcttctttgttgtatttagatagaagtttcagtagtggagtccatataactaagctccataataatgtgtttcataactttctccattattctactactagatcatagaaggcttgtttctcttaaggtttagttttttcatgcactcagaaaatagtttttcaggaagtatgtactgagtattctgaggatatgcaaggagcatgggttccagtgataaataatacatagtctctgtgctcagggaacttatagtttagttggtgctaaccagataaattagcaaaataattgacagatatagtaagcatgatgaaaacacacaatggactcagagaataacaaggatgctctcctgagacagcgacatttagctgatatctcaaacatggggggaattcaaggattccaggcagaggaaagagcatatgaaggcagttaagtaaggcaggaaagagctttatttgaggcactgaaagaaaaccaatgtgacaggagactagtgaatgggaagggggatgagtaatgaaaatgaggtttgggagattggaaggggctagttctacaaagccttatgagctatagtaagtagtttgggttttattctgagggccagcaaagggatttaagcagcagaataacacgaatgatttagttcgtagaagatgttcactgctacatggacaatgcattagagagagacctattaacagtaggagcagagagagcagagataccaattagaaggctttttcagtagctccggcaaaatgatgatggcagcaaagtgatgaatggattctaaatacattttgtggatagatttagtgagaattggagagatattagatgtgttcagatttctgtcttgaattactaggtagaaaggactatcattttttactaagatgaaaatatttggggggcacggtaatatgtttggtataaatgtggagagttatttttggatacatttaaatttgaaatgtctgtgagacattcaagggaatgtgtgcaattggctctgtgaatctgggactcaagagaggatagatctgagctaagaagagtaattaagaattgtcagctcatacacatttatttatttatttggagacgagtcttattccatctcccaggctggagtgcaatggtgtgatctcagccccctgcaacctctgcctcctgggttcagatgatcctcctgcctcagcctcctgagaagctgggattacaagtgtttgccaccacacctgactaatttttgtatgttttagtagagatagggtttcaccatgttggccaagctggtcttgaactcccaacctcaagtgatccacccacctcagcctcccaaagtgttgtgattataggcatgagccatcacacccggtcagcttacacacattatctcatggatttacatgggaataatggagtcatcaagaagagagtatatagagagaggagggttcaggaccaaattagattttgaattggagaaggatgagagcagcaaaggacggttcaggaccaaattagattttgaattggagaaggatgagagcagcaaaggaggagggttcaggaccaaattagattttgaattggagaaggatgagagcagcaaaggagactaaataggagcggtcagcaaatagggagaaaaccaagagaagagacttttgaatggggaaggagtggtttattcttgaatactgttgagacgttagataagatgaaggattggttttcactggatatgtcaacatgaaagtcactgatacacttgacaagagccttttagtgatgacatgaaacataaaagttaaagatggattaagtagtaaggaagtgagaacagcataactatttaaaaatgtttgcctataaaagaaaatagagaaaaggtagggttttgtcttattttcaaactctagatatcaattatatattttaaaggaatgaacccatagataggaagaaagcaatgttaaaagagaagtcgagtccttgagaaggggcaaaagggtggaattcagataacaggtggaaggatggccctttgctagtaaggcaggacattatggtagaggcaagatgagttcatagataggaccttaggttccaggaagataaagagaagacacttctaacagtttctgttttcccagtgaaggacatctcaactgatgtcatcagctgaaagtaaggatattagaggaggtgtagaagatttaagcagagaggcacaagtatgaagtagttgtcttggccagtgggatagtgagcctactagagacatttggattgtgaggccttggtggggtgtcagtatgccgtatgctttaaagtcaaatctctgcaacagaatgccaggtgtagagttacagttgattaataagacacagcccctgtactcaaggagtttgtaatctagagaatgaaagacatataattacaatatggtgtgatggttgtgatgaacaaggtaaatatagggtgtcataagagcacacattaaccaatcttggaggggctgtcctatgcaaggaggtcttcatggagacctaacagctaagctaagacctgcctgttctgcaagtaccttacttaaagctattacataatagctgctggggatgaaaatattctagaaggtatgatagtcacactgtattattatatctttatgcagtagcttttatttctgctgacatcatcaggcatctttgaaatttcttttttttttaacacttcgaaatgctgtgaagcaaagtatcatccctctctttcctcaccctcttctcttccttaacacctttcttcagttctagctgttggcagctagatgcaacttaataatgccattttgttttcatttggcatgtcattcatcattttcaaaataaataaactttaattttgtgctgccacaatcaggaatatttgaacatttagtgcttatcttgggtatctgcccttattactttctgaggagctgccctttatagcaatcagggaactataccacttggaagactaattgtctttatacaaaaataaaatccttgtgttcagatttctgtcttgagtggctggtttgaatctaattttctgttatatgaagcaaagatttattatttaacatagtttcaaaattaaaattgatagtgaaattttatgtgccatgcaatgtcatgtgtgttcttttaaggtgaagattcattttttaatagctttattgaggtataattgacatataataaactgcacatatttaacaccacattttatgtgtgatatgtatgtgtgtgtgtgtgtgtgtgtgtatatatgtatatacttatataggtgaaatcatcaccatagtcaaaataatcagcatccccatcagtcccaaaagttttgtttctcatgcccctttgtaatttttccctgccctctcaccagtcaactgatctttctgttactacaaattagtttatagttttaaaaattgtatataaagggatcttaattatatatattttccttccagcagaattattttgagattaatccatggtgttgcttgtatcagtagttcgtctttactgctaatattctggtgtagggatatagcacaatttactaatatattcaccttctactgttagctactacaaacaaagcaactgtgactatttgtgtacaagtctttgtagggacaaatgcactcacttcccttgtgtaaatacctaggagtgggatggctgggttatatagtaggcatatgtttagctttttaagaaactaccaaactactttggtacaagtggttgtaccattttacattcccaccagtgggaataagagttgcagtgcctccatatccttggcaacacttgatacagcctatctttttatttttagccattctaatagaggtatgtagtggtatctcattgtggttttaatttgcatttccctaataactatattaattttgaccaactttttatgtgcttatttgccatccataaatcttctttggtgaagggtctgttcaaatctttcccgattttttattgagttattttctaatgattgagatttcattttgaggattttgtgtgtgtgttgttttgtttagcagcttagaacacacacatttattatctcacagttactatgggtcaggagtccaggcatagatttgctgggtcttctactccagggtttcatctgaaagtaacaatcacagtcttggccagggctgcagttgcatctcaaggttttactggggaaggttccactcataagttcacatgattgttggtagaattcagctcctcgtgggatgccgaactaagggtctcagttatttgctcagttggagattcccctcagttcctgccacatgggcctcttgatatggcagctcacaacatgacaacttgcttcatgaaagccagcatggaagtgtttatgtttactggtttattatgattaacaaaggatacagatgaatagcccgatggaagagatgcatagggcaagctatgtggaaggggtatggagcttccataccctctccaagtaggctaccttccaggcacctcctcatgttcagcaatctggaagctttgcgagttctttatgtattctatatacaagtcctttatcaaatacatgacttgtaaatattttctcccagttttttgcttgtatttaaatttcctttttagtgtttttcaaagggcagaaattcttaattttgatgaagtccaatatgtcagctttttattttatggactgtgtttttatggttttaagaaatatttgcctaactaaaggtcacaaatattttctcatattttttttcttaaagtcttacaattttaggttttacatttaggtgtatgatccattttgaattaatttctgtatatgtgcaaggtgtatatcaaagttcattttgtgtgtgtggatatccagtattgtatgatattcaatgctgtgttttcacctaatagcttttaaaggaagaattaaagcaaagccaagttaaataggttataccagactgttagttttctttgtgttatccttgactttgttaggttgcacattttgctggaacttcttaaaacagtatcctatgattgaacttcttcaacctcaaatttccagtctttatacttaaccaatgaaatgttatttatatactctttggaaacataacatatactgtagataattataacaaaagtgtaatgggtagcagaagatattgccaaaccaaaattctggagaccagatgagacaaacacataatatgtgcctgtatgggtcacagtgctaggaaatacactgaaaagtgaacaaagaactaaaaataagcctcttataagaaaagctgctacttctgggctaatctattagtagtttgttttccttaatttgaaaaagagcttcagaatcagactctagagtgaatcttttaaaactatatatattatgcatgtatacacatatacatactctatgcattggcttagataatataaaaacagcacaggaatagtttatgctgtagtattgtgcagtcttattcagaaataagaaaaatagtttttccatttagctgtgagtcattactttttagtttcgtggagaaattaagttttagtgggggtcgatacagcttttttttttttgtagaaaatcaggtagcatgggctttggagtcagacaaatctcggttttaattttcagtgtccttatctctaatatagtaatattaatagttacctcttcctgggttgttgagaggtttaaatgaaataataagttaagtactggcacagtgcttaacacataataggtattcaagatatgtatacttctttatcatcaggggattgaccttggaagcatatgggtacatagaaagaacccataaaaggatatgacaaggggagaggagtttgttttcattagatttagcaaattcattctttcccccaactccccagaaaaattcattttaatgctattattttccttatcacccataaacagacagaaaattggcatgtttcgaaagagtgttaaaactgcaagagtattacatggtatcattacactaccatccattatctaactgggtttatttatgaaggttagatttagataatttagacttaccctttttccattttgtggggaaagagaatcagaaacttgaaaggaagagctcttccaaacagaaagatagctagaatctctctcaatagtctatataatctcttctaataatctttagcaaaagtgacttttgagttcttttaaatatttcctgtattgattctaattcagtgctcatttcatgtgatgtctatagaactacagacttagattacagtcagaaaactgagtaacagcagacaccaggttttcagctgtttttagggtttattcagattgactacatcacattcatttggatggatttagtgacatcaattgataattgtaaagaaactagcctttaatctgacattttcatattgatattagataggagccacatgactatgtcatgggttcattcacaagatataataaacattattttcacttgtagcataaaagcagtctttagtgttatcttagaagcattaaaacacacacatatataaaatcatatagattaaaaaattctatcagcataggttctgtaattgttaatagatgtaattgcataaggtcgctatgcattatttctcattttcagatgaagcctgtcaccttgacatttttatatataataggaatccacaggttgttaaaaacataaggaaattaagataatttgaattcagattataaaatagttcaggtctattctgatgaagcaatgtcacttaggtctgaggcttttgggtcagcttttaaaagtttatcttatttttcattaaaatatgtatgtataatactctatcatgcaaagagaaatggtcaacagaatttctgtgcatatatggttgctggttatttgaaagccattctcctcctaggattatttgaccaattttgtattcagcttagattagggagaatatagtgtctccttaggtaaaatacttactagaaccaaaaagtccagattaaattgtttttatttttattttactgcagttttgtgcagttgacctgattttaaaatataaaactaggaaggcatatttttcatctaccaaaatgtgaatcttactttcattttgaaacaaacacctctgctttaagaagatgaacggtagtgataaatacaaaaacgttaaaattttttaaatgaatagcgtttgttgatctttaaagaaaacataaatgtgaaataactttagagcttaaaagttttcttcctcaaaccttttaggaattgattttattatccaaaacaactttattcatactaagtgtgactatctgaataattaccttacttttatagttttttttttaaaaaagctcttctaactgtaattatcctcaaagaattggattaagaaattcaataattttctgtcattagtccagcgagatatttactgaatagccattacgttcctggctgttaacactacaaggactccagcaatgagcaaagcaaacaagcccttgcttttccagagcccacattctagagtcagatgctaaacaaatacacagatacatatataataaaatattggtttaagtgttgaaaagcaaaatcagagtaagaaggcaggtagtcattttaaattaacattgagaaatgtttccattttaagcatataaattctttggcttctctttttaaatttgcttttgactgtttgttgctggcgaaaattatttaaagtaattaggaactcatcgtaaatattttgtacactactctaaaaatctaattccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactagtatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctatatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcctaaagtgctgggattacaggcttgagccactgcactcggcctgaagcattttatgatgctcactaccaagtgttcataagcggtaaataaagcccttgggctaggtaatgtaagatccattgcaacctggagatgaagaactttgtaaaggggataattgttatcacccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaaacattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaaccgtatataccattgaagatgttttgggtataaaagggaatttccataataattacatagtaatcttttatagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatatcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacacagaaaccatctttgattttcaactcctaattgggactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttcacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttaggaagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcaggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgcaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcggatgtggacaattcagatgataatttcctacttcaggtggactcatacacttgatatttttcaactctgatgggtaagaaaagtaagcaaagagtaatgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctataatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttagtacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagaccctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttctttctttctttctttttttttgagatggagtttcgctcttgttgaccaggctggagtgcagtggtgcgatctcgactcactgcagcctccacctcccaggttcaagggattctcctgcctcagcctcccaagtagctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatgttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataataaacttaggaactggtgttacaatatggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaaaaattactgaatcgtttataaatttttctttggttattagaggcaacatttgttttgtagtcttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaatttttttttttcttttttttttgtatttttagcagagacggggtttcaccatctcagccaggctgaccgggaactcttgacctcgtgaaccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacccagtgagttacagaaatagatgctggaccatccctgttctctgcattagaaaactatactgctaacacatagaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttccttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaagttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatgtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaatggatggctagcatgtgctttatgcaagccttttaaatatcatatccaggcttttggtgagagactagagtactaatattctgtattgctaattcagggctgctccatatgctttataaaccaaatagagggtagatttagcatgaatattgagacatttacccagtgtttttatctggatgaaagaataacgtacctctggtgcctcgagagtacctataggcagttaggctttttctcaaggagcaatatttgaacactcaattaaatccccatgatttcattgaattcccataatatagttatatagtactcattgtattctgtgtgtgtgtgttttttttgtttttgtttttgttttttttttgagacagagtctcactctgtcacccaggctggagtgcagtggtgtgatctcagctcactgcaacctccacctcctgggttcaagcaattctcctgccttagcctcccaagtagctgggactataggcgcacgccaccacgcccagctaatttttgtatttttagtagagacagggttttaccacgttggccagaccggtcttgaactcctgacctcaggtgatcctcccacctcggcctcccaaggtgctgggattacaggtgtgagccaccgtgccaggcctgtattctgtatttttatgtatatcctcactaaataagtttcttgagaatagtgtagggttttttattcaccctttttccattatggtgttttgcatatggtaaaattctaaagtattctgaattaaattgagctaaaccaaacctggatgaaactaaagaaaatcgtttctcccctttcttattagaggaggcactttgttacaacagaggatatatgtggataagtgtacccaggaatatgtaacaatgttgagacatctacaaatctgattcagaattaaacaaaggccaatgaagtttctacactgttttctggcttctaattaaacatttttttcatatcacaataatataaatattttaaagtactccaggcagttctccttcagtattcccaggatgtcattaagcctattcaccctgcaacagctgcaagttattccaaacatttgtactgaatctttacactctacaagcccatttgaaatcaactgtgtcaccctattaacagcttcagtaattctctattacttttctaaccaagagttagggagaaataagtctagtatatcagaatgaagaatcctgaaaattgcttttcaaaaccgattctctgtggtcacgaacataatgtttttatttacccttccagattttggtacttaaaaagttagtttcttaaatgtgtaaaatttagatcatttgataaatgattaaaaagaatttcccttaagtttattaagtcttatttggtagtaaatataaaagacaaaacattccatgtaaaaattatttcatacattttaaacagtttaaataaagtaagtgtagtcaactcaaaactccactgccttattcctctgggtcttgcatatttattggtggaaatttttctctgctatttttttacattttacattgtgggataggcacagagttattgaacctatgacctatatattccacagcttacttcaatgcttctattaggcacccgtccagagttgaagaaacgtctcagatcacagcaggttctcaaaaaatgtcattttgtttagcttcatttcaatataacattgatgagaaaaaaaatcagttcccagctgggaccactgtctgtgtggaattttcacgttttctccatgtgtctgcacaggttttctccagtttcctcccacatccttataacttttgcttcacaaacatttattgacttaacttacatcactacgaccaccatcacttactgattcaccaaaaattgcataaattatcttacttgtttttattagtttttattaaatgtatagctcacatttatttcaatatttaatattagaagtgcttggggtctttatttagaagtttggtgatgtttttatagccagaaatatgctgtaggaacgtaactctcatttatatcaattaggctatcataaaactggtttcctttatgtcatttcgcttaaagaatttatggacgacgtgaggaatagtactcaacttttgcttataaataattaacagatggcatgaaaaataattaacagatgacatgaaaagagacctcttaggaagcaatttttacgagcctgctgaactgggagttaacattttcaataagaagccattaagtcaaatataatcttttgcatttaaactctacatcattatattactagaagtctaaaaaccaaacagtatggtaggaagaataaaatgttacttatgaatataatttctgattatacttttagaaagaggattaaaagtattgacaacaaatgaagtcagaatagcttgattaaagtagtttatttaaagtatctccttaatgttatagtgtatgctaattatttgctttgcatatgtacacatcatgacatacatttatgcattagctgagacatgttcattctgtaagttttgtacaaaactaatgatcttcagttacacaagaacatttaaaagttttacatttgaaatagataattaagcaatgctgtgtgaaactgaaaaatgaaaactttgattaaaaaaagtattttcaaatataggatagtacatgtatatgagaatacttttttgggtataatcttagtaacatcattatggtgttatgtaaacatatgacatatgacatataaaattatagtagatagatcactgtgttacccacttacacattcttctgtcgtattaagcaacaaacattattcttatctataataaagcagatatttctgtctgtcatacatatgaaatatttgtatgtatttattggaagtaatttttaaggctagtctttttttataatttcaacttttattttagatttggggtagatgtgcagatttgttacattggcatattgggtgatgctgaggtttagggtatgaatgatcccatcacccaataatgagtatagtacccaaccagttagtttttcaacccttgagtagacattgctccaaaggaagatatacaaatggccaatagcacataaaaatgtgctcaatatcattagccattagtagaaataaaaattaagaaatgtttaaaatatttaatgttttatttgaaaaaaaaaacaattaaaattttaaataacatttttaatggaaaataattatatctcccaaagcaaaaaaaaaaaaaattagtgagaagagtagcactgttttacagttttgcagatttttaatatgtgatttaatggaagataacaagattcttatatatttctgtattcagtctgttgcaatatattgttttagttgaaatatatgaagaaaatctaccctcatgcaggtaagtagttgcaaagggaaggagtactttaatagccttttcaaataattgtgaattattgttttgatactacataaaaactcagcaagtgggaatttctttaaagattagttgcactatagaatctaaagccatatcagtgatacttttaccctctgtaacattaaaaatccattgatctatcttgcagtttgaatggaacttgtacccatgcatgattttgtaacatcattcactgctcatttggaagatactggttcactaagagttaggcagatcttctaaatatgaacatatttcattatacaatgtcaaaaaatcacattcattaatatcaccacgaatcacatcaagaaggtcatactcatggtggtagatacatggtttccgaaattcggattttcactcaaaatcccaaattttataatttgcaaatactgtcaagtattttctttgaaatatcaggcttactgcatttttaaaaagtgcttaatgggttacccttgcctgaataacaataattcgccattatttcaagtaaaagtggtattgaaaaaagtgggttgttcagcttgtaaatcattcacccaagtgctttttcttgagatagccattatgcttcagtaggcagcaaaacagttttttatgttcttgccctttcatcacagagaatgttaataatttttactgcttcaacaaggatattctaaactgaaattggctttaaaatattttattcatttattcatttgttggctgattcattgttactgtatgtggcggtgaagaatacagtgactgctagactagcttggtgccactacatagatttatactaaggcctagcagtttggctttgctttttcaccaacagagtaaatttcaacaaagtgcaaaaaggcttgaaaatagtttgacctgaaagggtcttagagattcttgcctccttagggaaaaaactagttaaaaatctattataatagctctcctttagctagtttacattataaatcgtttgtggttacctactatatgaaaggttgtagtagatcctggggattcaccaatgaacaaaacagatgaaaatgtctgctgttatggagctcatggagctcatttataaagggtaacgatatataataggtgttagagagaaaagtaaagcagagaaaggaaaggaggtgtgtttggtgggaatgtgtgtgtacaatttaactaaggtggctaggaaagacctcactgagaaattgacatttgaatgaagatctgaagtgggggcaggtaaaggtgtgtgcctctacaaaggccacagctgaggccgcccttctttatctacctcttttcatctttccaacttccagaccttttttttctgctgataactcataccttttaattaaactttaatttaatttaatttaatttagtttcttccaactctgctctccaccacttccttgcccctagcacacacacaattaatcagcacttacaaaaacaaaaatttacctctttacaaaaggtacagggatagagtagaggctttgaatacttgtgcttcaattatttttctcctgtcatcttttatattaaaggaaataaaatataggggtgtctccttttcctggttgaattggtagagaatatctatggcagttagtgctaatgtttataaaaaggaataaacacaagtgagatcatgatggagagagaccaaatcagtagggaccaaattataaagagatttcatttctaggctaaagagtttggattggtcatgtgtgcctgtcatcctttatttcattcagtagtggaacaatggctctcaactatgtggttgagggaataaacttaaacaacaaatctaaatttcctatatcagttgcatttaactgttgcgtttcctcagggacttcactctcctcaaactttttggtccctttttttaaaaaaaaaattattgaacacttataagtgttgaaatactaacttgtctaatctttataaacaatcggtgcaataggtgttgttactgtccctattttactaaagagaaaatgaggacacagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggcccacctcagacttaccatgtaagaaattgtttttcaagagttgaggaatgtgggtatttatattataaaatcctgcaggtgattctgatatgtatcttttgttaagaacttctgttttagaaggacctaccattggcactgtttttgcttctgatcccagcttcctatgattaaatgctttctgaaagatacatagttagtacagaacttaatactattatactattctatactattttaccccagtttgacttttaagctgttaccacctgaaatttaaatgaaatcctttttagaacaatacttgaccaaacaatttaaaaattgtatttcctacaaatgcatcataccttaaaaatgcactttaaaactgaatggaagccaggtatggtgactcacgcctgtaatcccagcactttgggaggctgaggtgggtggatcacctgaggtcaggagttcgagaccagcctggccaacatagcgaagcactgtctctactaaaaatacaaaaattagctgggcatggtggcgggtgcatgtaatcctagctactcaggaggctgaggcagaagaatcacttgaacccaggaggcagagtttgcagtgagctgagattgcgctactgtactccagcctgggtgacagaatgagactgtataaaacaaaacaaaacaaaaaaacaaaaaacaaaaaaaacaaaacacacacacacacacacacacaaaactgaatggaaactgagaacttactgttctatttatgatgaaagaaaactggtaggctttagaaagtacaccctatgtgatatgaaaagtgaactcttctagattgtggaacagctttatatagtatcatacctccatctttaactaggattgcagctggcaataaagctcagcttctaatgcgagcaagtgttgagtttggctattttgttaacccaagatcctgagagaaaatttgttcactgatgtacataaagcatattatggttaaaatttcttattccactttgtagtttgccttgttaagactagtctttcctaaaatgtgctttaggggcattttatagtcctccatatttctttatgtgacgccaacatcaaaattgctttgaaaaggatcaagatctggagtgaaggctggaggaatagctagacactgaggctcatgcaaggagagttaactttagaaatatatattacatgaaacccctttttttctccccttccagaaatttgtagaatcattgatatgaaagagttggctagtatatctccctgtgttcccttcccaccctgctgtgctatccacacaaacacaagtggcatttgaggtaacttttgagattctgctgggttaaaaaaatatatattttttgtctcaacccaatatgttcctttttttcaacaaaaagtataatgattctcctatatatctatgtttagctttttgctagaagtgtttcctaataacttttctcaggaaacttgttgactcaatttactgtagtcatagagcctcctacctgaccccctgtggtctgctttggtaacacacctgtaggaggcaatgtaatcttcaggaaattcacttcctaccagtagtcctgagtaaagtgaattttctaaaatgaaacatcttgtaaacattatatatgacaaactcccaaatggttaaactctttatgcatttagtgtttgatctttttccttaagaagacttttttttggattgctgtcctgttggcactcaacaaattacaattgctaataagtttcagaggccctaacttattttcctaaatcatatacttcccagtttttgaaaaggctctctattatagctaacaaagttttgaactttgattaactcaagtgtttttgttgttgttgttttgttttttgttttttgtttttttttgagacggagtttcgccctgtcgcccaggctggagtgcagtggcagcgatctcggctcactgcaagctcagcctcccaggttcacgccattctcctgcctcagcctcctgagtagctgggaccacaggcgcctgccaccacgcctggctaatttttttgtatttttattagagacggggtttcaccatgttagccatgatggtcttgatctcctgacctcatgatccatctgcctcggcctccgaaagtgctgggattataggcgtgagccactgcgcctggccaactcaagttattgaatgaagtaatatgaagcacatgggcagagacttcctggtcctatacctgtccaaggcatgtaaccaacattttgtttaagagctttccctagggagatcaatcctgacctggtttagaaacattttttcctgaaactctcatgaaaagagaagaatgattttggatgctactgtcttatcggaaagtatttacaagaaaccattttgaccaagaaactcaaaattaattctggtttttaaaaagagaggcatatattactcttagattgaaccttatgaaattactgatatttgactcaccaaaatgacagttttttatggtccaacctaatactttttggtgttaataaaaggggaggcagggttagttgggcagtttgtgggggacatcctacagagtttgacatgaaaagtatatcttaaatcaaaacttgaatttgtacttattaggatttcaagctcatttttcctctggtgaccttgccagcattatcagatttgtattaagtgtcaaaagtttcctcttgtcaaagtgtaaaccttggctcattcttgggccatctgttgtacactaatagttttgatttattcttctggctgacatgcgtattaatggtacagatgcaagctttatatttccttttatgggtctgtagttttattgcatacattagtggcacaaatacagcattcatattagctatttatatgaactatttctagttttggggtgactaatatactttgcttatgtttttactatgctgagaagccctgtatcgtagacattttaatagactttaaatgattacattctacttaattttaccacccctaattttgttttttgtaatttttattttcaggatatgtcatgatgtatgtctgtatatttttatgatttcaaattcccaaattgccattgctttaatgaatgagcacatttggtttttgatcaggaattactataactactagaaaacaacactagtgcaaaatgtgaatttagataaataactctgaaaggcctacttctagttgatgctttggctctgatttttgagggttaatatgttcttcaacttctttgacagcttgaaagttatgaaatagagtgatagaaaacaaaagctctctaggacagggacataggttagagaaaatttaatacaaagctgtttttgaaataaggctaggtgctatttttatttttgatctgcttttaacagtttcctatattggaaaaccaaacccatctctggaatccagtggatatgggccaaatataaaatgttaagaggctggtgttactattggtctgctatgcaaaactttttccctaatagaggtctgtgttgatctgtgtgaaagctgctcagtgtcacaagtgcagcctgagtttcattcatttctaggggaaattatgatagaaataacattcctttctattaaagataaagggctccaaccttgagccagagttttctaatacagtagaagccatcttatctatatagtgggtactagtagatagtctgttaataaacaatactggctaaaataattttttaaaaagatatgtatctttatttcatttgattatattaatgtgcactcattggctagttttgtatgcagggccaatttcttttctttgagtccaaatccactcttcagagttccatgttgccattcttgcataaactatactcacaaatcagcaaccataatttccagtcttggttacagttactgtatattggaataagaacttaaaggtacttgttaagcaatctgagggcagactattatgatttttatggttgctttgcaaggagagaacattttaaaacttacctttatctttttgctctcttttcacactattagtttatgtaatattttattacacaattatactaatacaattaatgaaagtagtcttgaaaaaagacacaactcaactagtcgtgaatgttccctgtgctatgggcaccagtcagtgagttttatagggggaatgggaagggtcatttaatcagtctgtactctacatagatacgtagaatcaacatttgataactctcagtagggcctgaattttattgtgagttaccataattaatttcagtggagcaaaatgtggtccttttcttttgataagccagtctccaatgcttttgttttcttaaaaagacaagaaacgtaactttgaaggctgtgttatacactaatattctgttggtttctaacaaattgcttggaagagggaattgggagaactatatgaaagtagcatattttctcatgcacaatattgcacaacattagaaaactgatgctttattttcatggtgaaatgttttgatgtttctccccgccccctcccctccatgtttctctaactttttctgggaataagagtaacaatacattgattataatatttgtccacatgatttcattccagaggaaatcctatagtatctaagccctacggaaagcctcataaagacatttcaggagtccattcgaagatgtcttaaaattaatgacattgttttgagtgacagtgccgaaatatatttctttctatggcaacattcttattctactatcctttttatttttaagtagtttcatttttgtcactgttgggttattttaaacgatttaattggagggaaagaaatacaaattcatcaaattttacctccagaattgaatttccttcactagttccttaataagtatttaagtaaaagggggtgcaatatcaagaagactaaattataaatatggtttctatgctgttaaaaaataacagtcctgtccttaattaaccattatggagattcctcttgaccaaatacctttagaactgtttcacagatttataatttaactagtaatttggtttaggtttaggtttaagtgacagaaaatccaaaataatagtggcttagataaattataagtttatttctgtctcatgtataagtttcagagatctaatgatagctacttaatcatcgggatccctgtctccttctgtcttcttgctccataatcctcaacttgcagcttctgtctcatggaacaaagacggctactccagctctggcagtcatatctgccttctagctagcaagaaggagaaagggaaggaggagggaagccttccaccattaccaccttgaagaagttgccatttcttcttacagtccgttgaccagaccgtgtagccttatttggttgcaaaggaggctaggaaatatagtctttattctgggtggccttgtgcccaactaaatatcacaagtcctgttgctattttaatgttacagaggaaggagagcatatattgggtaagaaaaaaaaaaaggctgtttctgccacaattcagtttccccaacaaaataaaaacttggatttatattctttaaaagaaaatatcctctgtagcacagtgctgaatacatgacaggacactgtgctcagtaaattttttttaagtgaacagtaagggccggtcacagaggctcacacctgtaatcccagcactttgggaggccgaggcgggcagatcacgaggtcaggagatcaagaccatcctggctaacatggtgaaaccccgtctctactaaaaatacaaaaaattagccgggcatggtggcgggcgcctgtagtcccagctactctgcaggctgaggcaggagaatggcatgaacccgggaggcggagcttgcagtgaatggagatcgtgccactgcactccagcttgggtgacagagcaagactccatctcaaaaaaaagaaaagacagtaagaggccagtaaatatttattgagtgattacagctcctttgtttctgaaaatgtgactcacagtactaatgatctgaaaaagagtaagatgaacacagagagaaagtaatgattcaggattcattgttgtgaggttcaagaaacatttattttgaggaagtggaggtaaatattcaatgaagttaactacattgtcccagatatatagataagatagataaaatgtatatattatatagacacttatttttattataagatatgtactgttagagttggtagtataccagctttggttccctgcagtctgatttttgggcctcttggtaaacaagtacttaaaaactgttaccccagtttgcaaacctttaataattagagacaaggcaggttaactgtaataattcgtatgcatgcaagatatgattcttctttttcataaatcatacctagtttttagctttctgctgcaaaagtaactagtttgttagaaatttagtgaaaagaaaaagtaggagacattgtgttcagaagatcatgtttaaaaacaacaattagtatggcatctgtatcttagcaggaaactcagaattaagtctgagcctgaccttaacccatgaccagtggaatctaagtttgtttatttttacaatagccttaatttggggcttgcaagttttttggtttgttttcacattcaatttagagaccctgaagcagtattttaatgataggaattaagctatgtataactttcatggcttgaagatcagcaaattctgttttttcttggttataatgttatcttaatcagaaatgtgtgatctttgtgtctaacaatgcacttaaaaaaacaaaacaaaaaattcccttgctgcaatgctggaattctaacagaatttactcatcttctctctcctccccaatttttaaaaacatgttctcatggaaatgttgccttgaattacacaaaatacaagcagttactggaaatgttttctacacagttctgttcatgtatatcaatttcaatttgtttttcactttttagatttttttcttagttttgctgataatcacacttcataatcatatcaactttgaactttgaagttgtgttgaatttttattgctctcagctgtatcagatcctactttttgatgagttatttcatatagtaagtttgttgaatgaatggtgaaacaatgaacacaggaacaagaaaagaaagcaaaatgcatcaaacttaggtttagttttatctccagtttaaccatgctcccttaaatggaaatgctaatatacttctttttttcttttttctgtaacagttcatatgtttttgctaggaagaagaggagttactgaaaacagtagttaatatcaaagtcataagtcatttataatcagccttagaatgcctacagatgtatatacatttttcaaaacacttatactctgccttttctgaagccaagcttctcttggcttattcttacttttagtacttgtgtgctggaaattagaaacctcagatgccctgcacagtgtaggactatacaattgtgctaggcatgtatttataattctttaactcttctaccaaactgtgtgctttttaagggcaaaaactgtacaacttctttagcatgcacctgtcacttgcaaataaatgtctaattctgtggtcccttcaaagggagaagaggaggctaagcaggcaaggctctaggccttggccctgcttcagtcagaatctttcttgtacatgttgataatttctttcttctacagatagaaaattcctgggataagaattttgatgggaaaaagagtttattgcctttaaaaaaaaagtttgagaatgactgtttaggggagatactctcagtatcttgtgacattatctagtctagcccccatcattttacaggactggaaactgaaacacagaaaggatacgtagtcttgtccagattatacagctatttagtggcagaattagaattaaaatcccttgtcttgactgcttgaccagtattctttatagtggtgctacagcatatgtgttgtaaaaacctaggagttttccaagatcactgcatagtgcctgacaacggtagacactctgtaaatgtgtattacattaatgaatgaatgattctaagctggtttgtagttaattaagccaacttcaaataaaaactataatttttcatcatcccaacgaaatattgacctcttagaagccctgaatttggcctgttctaggactaagccaattgttatatataacagattgttctttgttaattttaggatcacctgctgttaccagctaccacccataacaagaccacaagaccaaaaatgtcaattgtgttaccagcaataaacataaatggtaagttgaaattctgatgtatgaacaatatgagatttctttgtttaaccaggattctcttcattagttcaaagacatttaaaatgttcagttaaatgagtatatatccgtacattatttctgaaacatttttccactgttttattatttttaagatccattattcttttaaaaaaaattactacatccctaaaagaaaaagtagctttcttttacttacaaaattggaaaagctagcatcttgactgctctacagacttgcatctgcgacccttctagtcataaatgtagtgtaagaagcccctgctgtgttctgacagtgaatttgtaaattagatttttggaactcaaagcagtttcctgtgttacctaaatgttgatatcatcctagaccatgccacagaagcctgtttatgtttaattgataatactgatgagtttgacactgatagtattactattgcattttgttatattactagccctggacattaaacaaaatacaaataataatataatgcacagatgttaaggcataatatacctgcttatagtttagaagaaaaaaaaagacaagcacaaaaatcactgtactccaaagagaaagtcacgtaagtaatatgtgaggtactaagaaatctagtgaaaagagattactttcagcttgattcttcatggagaagtgaaataactcactcccattaccagttgtggattataaatgagcacagtgtatgttattgactaattgctttctctgacacattatattgaaaatcggagagttggccatctttttcaagtttgtgtatctcacataatgtaggtactagtaaattttctgtctggtagcaaaaacctcagtatatgaagaagatggaaacgaaaagccctttgaactaacctgcagtcgaaccagttcacattttgattgataaatataattaaaccttcaaatacaattataaaacaaaacactagaattttggggggattccagataagtttcaataaaatttagtctttaggggaaaagtggtattcatcatacattttaagaccatagaggaccttagaatttcatgatctgtatatagacagcttattagaaatgcttaggaagtaacttcatagacataaacataaatgggctttttgttaaagcataaaaattacaatatttacttagccttacaaagacattcagaataagtttaagaaaaacagtaacattgagaagaacatctctttcttcagtaaagacatacctttgaagttactcatggaataatcatttactacctgaagaagaatatattccaaagtgcattttattacattccaaagaatgtatttaggaagtctcacttatactcaatctataggtacctaagtttctctgcctaaactagaatagaccaaagggtcagcttatgctcagaaaggctattttctaagctttatcaaggcagaattcacttaattttgttcttctgatattgggttcttatgcaagagaatgcctggtcttattttgtaacagtgagctatctttatattaagccaaaaccaacaagatgctgtttgactatgtttatcttggccaggtgactgatttttgaagaggagcctttcatggatttggaaaaatccagtcattagaggatcattgtctttttaatctgtttcagactctttgtaaatagtctttttaaaaacttccctttttaggataagtcctattaaaaaatcaaaattcaaattcaagaaatattgattgaatatataccgtgtttcaagtaccatgctacatcctcagccttttctcttaacagtcttgctctgaggatacttcttaaattagagcctgattttttccccttcctcatgtacctcaaagtctgcagcagggcaggtggtatccttgcttcccactacaactttcaaattatttctccttcagtccccttaacatcttgcaaatctgtcacatcacactttactcctctaacccttatttgttgctgccgtctactccaccttcactgacgactcctccactgcctctgtcatcctgctgtctaacttcagcatccgcatagaggagtcattagtactctagccttttttgatccagtcatcttttattccgcgccacctcagcctcccatccatatggtcataatctagaccttatcatcatcaacagcagcactctctttgaaatctccttttcaggcatcccactctctgactgttacttactctcttactttaaaactcacactccaactactctcttaacttacaagtctacagtcctttgaccctgccacttcttttctgtgtccatcacatccttaatggccatacattcctccttacccagcttaaattccatggtcctgtcaccactctcttgtgaacaccccttacttcctggctcctttcttaggtcccactttcttggaaaaactgctttctaggtaaacccagctcttctctctatgcctgctctcaagcagctgaaaattgctagaaagtaccgttcagtgagaacaagtagattcacttcaaatttgtgaccattaatttcaaagggatatttaatatgccagtcattactagtaaattcactttccctctctctgaaaaaaagaatttctcaccttctcttgtcaaaactccaacatcctctctccccaccccctcagctgatgaactcaccaaatactacactgagaaaatagatgtcatcatgcaagagctacatcatgtttccactaccaccggcccagctgcatctacacccacaaactctgccttccctcttgttgcactgaaagaaaagtctcttccattgggttctaaatcccagctttgctacttgctggatatgtatcattgggcaagttaattaacttttctgtacctcagcttcctcatctgtaaaagaagatattagtaataccttcctctaagagttgatgtgagaatgaaatgagtaaaaaagctttaaatagtacctgactattttggggttagctgctgttttactgcaataatcatcattgccattgtccttaagacatcattgccaacttctaaggtaatttcttccttttggaccctgactcctagcacttctcacagtgctcaaagactttactctgcatttataacattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaagcagttctcccacttcagcctcccgagcagctcctgaacacaggcacattccactcccagctaatttttaaattgtttgtagagacagagtctccctatgttgcccaggctggtcttgaactcctaggctcaagtgatcctcctgcctcagcctcccaaagtgctaggattacagacatgagccactgcacccagcccaaaatgtcttaatattactgttacctctggtgtagggagacttctttgacttcacatcctatttctctgttaccctttagagcagaactctcaaaagacttacactcactgcttctacttccttacctctgattctgtcttcttttcacccttaccaagcttttgccatttcacttcatgaaatgctcttgcccttccactccactgaaatgctcttgcaaaacggaagtcaatgacaaatatctcgccaagtcaaaggtcatgtctccatggtcatcttacttgacctctcaacagtatttgacacagctaactattccctcttttttttagtccacccaattcttatttttaaaaatttcaaatctatagaaaagttgacagatgagtgcagtaaatatctagagacccttaaatagataccaccaattgttaacatttttctatatttgttttatatctatctatgtacactcaccagattttaaaacctatttgagagtgaattgcagataacatggtgctttacccctaaatatttgaaaatacatctgctatagaaaggactttctcttgcataaccacaataaaatgatgatactaaaaaaaatttaacattgatacagtagagttcaatgtatagcatatattcaaatctctccattttcccccaaaatattctttataactttttgaatatatgttccaaagattatacattacacccactcatcatacctctttggtttcctttaatctagaaaagctcctatcctttttactgtctttgatgacatttacgtttttaaaaattagacttatttaggtataatgtacatacaataaaattcaccaattttttgtatacaatgtaatgaattttgacaaaagtaaaccattgtgaagccaccatttcaatcaagatataaatgttgtcactacttcaaaaaattccctcatgctcctttccagtcgttcccctcctgtacatttttgacatcccttctttcttgaaatatgttattttctaggctttcatgataccatgacttgtctaggtttcctcctgtatctcctcagtcagcttatccagcttctcctcttctgtcaggatggaatcttgtttgttatgttcgccacttaccaccatatccccagcccctggaacagtacctggtgtaggaaaccttgaaagatgaggcactttcatttacattaactcatgtcatgctgagctgccagttaagtgcaggctaactgttctttattcaaatgctgggatcatgtggtgtgaatccattggtcaaaaaggaaagataagaaggacaaaatgcatgggaccagaattatttcagattttggattgtttcagattgtggaatatttgcatatacataaggagatatcctggggatgggacccaagtctagacatgaaatttatcatttatgtttcagatacaccttatatacacagtctgaagataattttatacacaatttttttttttttttgaaggcagagtctcgctctgtcgcctgggttggaatgcagtggtgcgatctcagctcactgcaagctccacctcccgggttcacaccattctcctgcctcagcctcccgagtagctgggactacaggcgcctgccaccacgcccggctaattttttgtattttcagtagagttagggtttcaccgtgttagccaggatggtttcgatgtcctgacctcgtgatccgcccacctcggcctcccaaagtgctgggattacaggcgtgagccaccgcgcccggcctttatacacaatttttcacaattttgctcatgaaacaaagttaatatacattgaaccatcagaaagggtcaggtgtggattttctgcttgcggcattatgtcaacactcaaaaggttttagattttggagcaatttggatttcagatttttggattagggatactcaacttttattctctttattttttatagataatgcctcaagaaagtaattcataccatttgcacaaccactatatagcagagccaagatttacatacattgtataaaatatcttctaattaattatattgttaattcaatattaaagacagatgtgcaaggattgaaaatatttgggactccaaaatttaagatagattttataccattttattcctacactataaggtgggaaagattcattgggagcagtataacataatacagtcatttgaatttgataggtatatgtttgttgaataaaagaataagtaaggtaaatgttatttggtgataactttgtgaccacttgaaaatattttactagtttaataatattttatataattaataatagttagcaagcacagattagtctaatcttttcaagtgtaaagtaattaaaacatatactaggctacctttctaccacattgagatttggacttcagagtgaattgaaattattagcctccttttcagcaattgttctataaataaaaccatgcaaaaagttgtcctataggaaactataattctataggattcttcaagacccagagataaatttctttggcttattagacttatggatttgacaaattatattataattacataatgtataatctgaagagtttaagttatgtaggcacaaaaagtttgagtacctatttattgaaagagcagagacattgtgaggctatccctaatatcagagttgttcattctgagcatataagggtttgagaaagttgaataaaatacattttctgtcatttctgagtttaaaagttacatacaacttggaaacaaaaatgagttgtggaggtgatccctctctctgactcaagtggagcttgtaaaattttggagagggtggcaaaggatagaaagtgaagacagaaattcagattttattgagcaactggtttatgtaatatgctggatggggatatttgtaagatgaatttgattttccaatttaagcacagtaaattacatttccaggtcaatgtctggtcttaaactgtaacgtattatgattatactttgtggttttaagccatggaagaaagtttcagaaatcgctaaagagagtaggatatgggtgtgaaattaatgccatttagaaatcacgtcatatcatctgtgttctccatgccagttttatttttgtaatttattgttttttactttgcattctgtttattatttaaattcctttgtttcataagagagttgaaaacaggttagtgaagctgcaagaaagtaagtctttctttgtctgaggaagttgtcacacaagattattgaaataaaaatagaatgctaggtatgctttgaaaaggcttttttaaaaaaggattgcatggttggtggaacagtggatgatggactaaaagctactgatttcttttttttaaaggattttggaagttctactagtagttactgtaagctaacatttcctgctttcaaattatttctacttatgttgtggtaaaactgttcatttcctttctttcactcttggtaaataattgaacaagatagagcatagaaaagggggtttttaatttgattttttagtgatatgtttgttttttaatggtagatagctaaactttgtagatatctttcataggggaatgaattctatgaacaagccatcagcagatatgtttcataatttggccaacatgttcattgatttgtttttactgtttcccttcccttctgtgtgccaggtacctgtttgtgtggtacatgtgtaataaaaataaacaactgtttataactgttacttgaattaagggcccacgtagatgaacaaatgactaccaggctaaactgtaattatatttaatctcaaggtaatttccatccatataaagaaaatctagaagagcttaatagcaatggttgcaaatactagtgccagcacatgcaacacatttttagttggagaggtcgtaacagaagggtaggaagcaaaccaaccaaataaatgtgttggttttaaaaataaaagaatattcatataactgcttttgatgatcacagttttttggactatcccaaggcaaatatatttggaaaccgtcctattcattctgctcaagcagcctggtttcctaagcaggtcgagagtttttccttttattcttctcaatatatttctccttaaaggtctgcaggttgtctattttttttaaaaaagtattatctaccttgcattttcattgtaattcatttcatttcagtttcatataattgcatccagacagttgaatggagtcttcacttaaaactatgttttaatttttaaaaaatacataatcatagttctctttctctctctctctctctttttttttttttttttttttttttttttgagacagagtctcgctctgtcgcccaggctggagtgcagtggcgcgatcttggctcgctgcaacctccacctcctgggttcacgccattctcctgcctcagcctcccaagtagctgggactacaggtgcccgccaccatgcccggctaattttttatatttttagtagagacggggtttcacgatgttagccagggtggtctcgatctcctgacctcatgatctgcccgcctcggcctcccaaagtgctgggattacaggtgtgagccactgtgcctggccatcagttgttttttgtttgttttattatattgagaagtccacagcaaagaatcacagtgaatgagccagttgctgtgttgagtcaacggcttaagagtggctaaggccgagattgcagaaattcttttggcctttcccagatgatcacaaagtgactgttgcagttcaagccatcatatttgtattacaggcagaaaaaaggaggtgtctatcaagaaagcagacattttccagaaatttctagaaagctctgcttatgtcttattgaacataaactgtgtcaactatttaggcctggcttcaaaggaggctcagaaagataatattttaactaggcacattatgatttgaaaaaaaatttggagtctttttagtaaggatccaccctcggcctcccaaggtgctgggattagaggtatgagccaccgtgcctggccatccgttgttttttgtttgtttgttttattatattgagaagtccacagcaaagaatcacagtgatgaaccagttgctgtgttgagtcaacaacttaagagcagctaaggccaagcagcagctgcttgctgcagcactccatcatatgctaaattggaattgagcaaagtgtctgggaagagacagtaaagagaggattcatgttgaaaagagaaataaatatttatttattgcatgggatgcagccagatgatttaggtcattaatgagttgaggaagtaactttaaactatcaaacataagaataatacaatgaagactctattaagagattattaatctggctaagaattgtatatagaaaaaaatgaagagcgaagatgagctaggatagatactaggatagatactttggaacaatctcaagatgaggtgattcaaagcttggaatgggaagaaaggaaaaatttccaaagaaattccaaaggaaaaatctatagcatttggcagctgatgatttataaaggagagagaaggaaaagctgattccatgattttgagaccagaccactgagagactagtactgccattcaaagaaatggataaaatgggagggacagtgtgagatttatgcatcttgaattagagatgtcattggtgggtatttttgtgtatctcttgtaacagattggtgtgtatttctgtgtatctcttgtaacggaataccaagtaattcttgactgatgaatttcattttctttcctttttgttagatactaccagccccctcacaagttagtgtccctttccatctgttgtattgtcttagacttctcctcattcaccaccttgatgcttttacaagataacaaagcttatggagataggcatggggcagcaagaaatatagagtgggaatctgcagagaaaagaaagatgagccctctttctttgcttgttttccctgtttgtttgtttgttttttctctgctttgccttgggcatgattgggattactgagattattcctcttgtctatattgttgcattagtattttaactggtgtccctaatttattatttttccatcttaattcctacaattcaccctgcatactgctgccaagatgagtcatccttacatactgcttttgttatatcattatccttcttgagaaccagcggtggattttcagtgtctatcagatgaaatccaaatgctttagcctggcatctaaggcccaggacagtctgtccccacattaccttttcaactcagttctaaccaaactgttctactaacagttccttgaatctgtattcattagttcatttaaaaatactcattcactgattctcctttatgcctaatgctggagataccaacatagaataaggtacccatgatttgtactttactgtagcctctaagtgcaagagacagaagaaaacaaaaaaaaattaacaacccaaacaaaacaattgcagcttatgacagtttgggagaaagaaagaaatatggtcccttcatgaaatatggtgggagtcaggggtagagaagacctttttgattgggtaatgaggggataacagttaaaccaagatctgaaggatgagaagaatcaactgtgaagagtcaaggggcagaagattccaagcagagggagcaacaagagagcagaggccctgaggctggaaagaatgtgttcgttttaggatttgtcagaagaccagtaaggctagagtaggacccagtagggagaggaaggaatgatacgagatcagatcgggaaggtaaacaggggccacatcagacagggaattgtaggccacggtgaagagttgtgatttatcaatatagtgggaaggtgctgaggagtttgaggtgggaagtgacttgatctgatgtacatgtaaagagatcactctatttttgcacatgtggtgtccatgtcttggattacctgtcctcttccctccaggctatctcctacccatccttcaaaatccagctgaaatcctaccacctctgcaaaacttttgctttacttctgtggaccactagaatacttctgtaggtcctagaataaatagtctttcctccactgaacatccttaatgtaaccacctctcatttatggctttatctaacactactcaaagataattaccttgaaggtggtggtgctttttttttatttaactgtgtctcttcctcctcttcatcccatgcctaaagaaatgctctgatacttaatttttaatatatacttagagttgggaaatttttgcctttttatgattcacaaaaaatagctgttctatagctgtatcttacctccctcatttcctctggttggccttacttccctcttatttcttgaagtcattagtgtatccatttttaactcttcccaaaccattagattttctcccacttagcagagcctcttctgaactctctactataaggtaaacctggaaataaatagatttcttaagtggaaaaaatagggttaatggtagagctgcctttatatacttggaatgttattactttgctaagaatgattattgtgttgatgatttattggcagttgcatgggtaatttttccatgaatagtttatattcattgtatttgatttactaattaattatttagtttattagaaccttcacaagaccccagaggtttagattcaatcagcttgcattgatccttctaggatattagttacttctttgacccaaaggagccagttgctgagccccctgtacctaagtgaccttcagagtcctgttagctttcagtgagatcacattcactctttctgccttatggcaaaaatctgtttctactcaaacagatggtttagctttcaacaaataaaaactagagatcagcatctacttaagccaacagagttggtttgagcctcccactaactctccaaagtctgttattttttattttttaatgttaagctcctcctaatggatttatctttgtacggggaaatcaagaaccttgcactttgtcagaagatgagccacttcatataatctcaagtttctatgttttagaagaattgcttagtaagcacaggttcgactgctctgcgttctctcttttgcagttacaccaactggaaacattggggatcataactttctgtggagtgttacataggtgtgtcagcagttacatgatactttctttgttatttaagacatctgcaagctgaggatggccagtgtcatttcagagatgtacatgccaaagacatggtagttttcattgacattgggaaatactccttctcttgagcttttacaaataaaagttagagagtgctaagaaatccacatatttaaaaaaatctagaatcttgacattgaaaatataaatgcagattgttaattatatgttcctgtgttaagaaagcattcttgctttggggatcttgagtacatcagacaaaagttgcctttgaactcaaccaagtatccatagagatatttgcctctatatgtattattaattttacagaaacaaatgcctagcttaaatataatatttagattaaatagtgagacaaatgtaacctgcacaatagtttgctgctaggaaaggaattgttaggaaggccatataagcagtttctttgaagatacctaggacctatctctttcttttcactctattatgtaggacagaaccttgtgggaaatgtgatctacttggcatcattatggtatggattaggacaaagaaagatgcattaatattcctgtactcatgccataaaatatcatggttaaaaaggctttagtacaaagttatccatggtaactcccttcgagggattggattcctttctgcaacatgttgctctgtggccaaccagtttagatataatcaccgccatgtatagagactgcctgctttaaatagctctggcaatttgtaaattgttccttttctgtctcttaaatccacaggattatatataaatataatatttcttccacatgacaaaccttcagctgtgtgtatactatataccctctgagtcttcacatcccaagaccttccggtttttggaagctattcttgtgacctgggttcatggtgcctcgattctggtcattctcttctgaatgggctctggtttttccacatctgttaaagagggctgatgaatgctgagcatagtggaggatctcctaattctatatagtgtatttctattggtgaaaccaaggtgtttttttctagttacatcatacattgtaccttctgtcaaatatagtctttagctttttcatatatgttactaccaagctttttaattttatttgctgatttggatttttggcctgaatttagaactgtgtttttatcctgattagatacagtttttcattaagttccttactcaataaacattcagagaaggcttccctaagtccatggaataggttaggatcccttcccaactttatgtacccagaatactccaaactttcttatttttgtaacattcatcttacttgtaatcagtagttatcatcaacttccctgctaaattggaggcttcttaaggttaggaccttatttattcaatattctttgttattcctactgcctgacaagagtaagtgcttaatacatagtagctgctcaaaaatgtttgttgaattgaattaaatatatgaagtatctatataagccaggcactgtccattgtatctaagaaaaaaatgtaattaattaaatgaacacacagtgaaatttgaactgaatcttcaatactggccaagtgaatgaggcattctgagcatagggaacagtataagtagggatatcagagaaagaaaagtacttagtccatttggggaattaaagttggactaaagtgcacatggatcaaggtacagatgaagctgcagaggcaagcagaagccagttcatcatggccttgtgtaggacatgatacagagtttgacttaagcctctgagtaatggggaactattaaaatattttgagcagggaagaggcacaaacagagttacatttcaaaagatttccccagcagcaacataaaagatagattagaggggattatgcttttatagggacaacagttagaaagttatcatctaggcaatagatgatgggtagttcatatttaaaaaaggattctttctgtatactatctattgtgtgtaacaaattactccaaaacctagcagctgaaagaaaacaaacattatctcagacagtttctgagggtcaggaatctagggccagcttagcagggtgattctgcttccggatctctcttgagattgaagtcaagctgttgactggggctgaagacttgattgggtctcagggatgtgcctccacattcactcacgcagcaggtggcctctttctggggctgctcacaacatggcttccccaaagcaactgttccgtaagagtgagaaagcaagtgagtaagagcactcccaagatggaagccactgtcttttaaacttaatcttggaagtctcataccatcacttctgctgcgtgctgttggttacttagaccaaccctcgtacattgtgggaggggactgtacaagggtatgaataccagaaagtggggatcatttgggggcatcctagaggctgccttccatgctgcttgtcaaagaatgtaaagagtaagtctacaagtccataatattttgatggcttatggagataagagggcagaacactccacctagaaactatcctattacctagagcaggtaaataaagtcatttgcttgactgaaaggtaagagggttaaaacccaccattctaaatgtcaagtaatagttacgttgcagtctgcttagttttatactataaattatgatgatttggttccatgtttttttttagtataatgtgattgctgttcagctttatattcagcgcatagcactatgccaagtaatgtacaggtttcaaaagaagactaaaatgtgattcatgccttcagagagttaatttactggaaaacaaggcatacatagatcatagaaaatcttagaccccagagaaaacttaggggagtttaacacaacagcctcatgaaacagctaagaaaacgggttgagggaggtgaatggctgatccagcccagctactgacagagctgagaccagatctcagacctttaggtctgtaggcaagcattttatttaaatataaaatgtaatttgtttacgataccaagaacattcttttttaaatataatgtaaaaaacatttatagagacagggtctcacggtgttgcccaggctggtctcaaactcctgggctcaagcaatcctcctgcctcagcctcttaaagtgctgggattacaagcgtgagccaccacaccaggccaagaacattgtctgaggacttaaatcatttttctatttgaaatcagaatgacttagtatttgatgtggggaaaggcaagacataaatgtgttagaagacatttctgtcttctcttgaaagaccaactcatcctgtcactgattactgtgtgactttgagctaaattacaacacattagtaaatacagaagaaaataatgagcaatgccacatcccttgcattttttaaagcaaggaccaccctaattgacagtgagatctttatattaattttcccatttaaaatagataatattcagtgttcgatgaagaaagaattatggggtagattatgaaataataattggaatactattactgttaatagtaaaaaatgtctgaactatactgttggaataataagagtagaaatgagtaaaattaagtatttacaaggtttaaagtattttggagttttgtttccttttttaaaaacaaaatgctttttaactgttcattgcctatattaccaaatagttttaagttgtacattcaggttcagctccccttttttgagtacccaccatttatgttaagtatattactgggttctttaacagatataattgcatttggtcctcataaagcctatgtgagataaacattttccccattttacagctgagataactgagaaattaagagaaccacaactgaactttctgcatggtcctttgaggtcatttttctgaaaagcaagtgctaacttttaatagtgtctttagcctttccctcaggcaacagcgtatgactaagtcaagacagcagaactaaatacgagtttatgttaccataatttcagagtaacagctactgttttatgttctggtcatctattacataaatatttaatactgagcacataatttggcatgatggcagcaaaaagatgtctatcctggagtttccatgataaaccagaaaggctttttttccccaccagtatgttaaaatatggagaaataaattaggagatggtaagctatagctttcttatcatcttaagtttacctaattaaagcactttaaaataaattcattccatccaaatttagcagccatctattgcaaagtttgcttcctttttccatgacatttaaatatacaaaagcctttttttttaaaaaaaaagcattttttagtaggtaaatgtcagtcactttcttaaactagcctgtcctagaccaacagaccagttctactttcaaaacaaaacatagcatttaatagtaaaaataaactgtcttctcactaatgaatttactgtctgcatttccatagatgtggccatgtgttttcccaggaaaactggcttgaactcaaactaagatagctactaagatccatttagacaaagtgggctataaacatgagaaatcttccgccccctattctgtgtttggttaattttgctgctctcatacattctagcaatgtaccattctgttctcccttttactccagggagcctcatttggcatatagttagtcatacgcatacacctttgaaaacagtcaatgtaactcccagttattaagaacctgatgggtgctaggcattgccttatgaactgagaggtacaaatatgaaaactatataaaagctcctgccccagataaactatgatacagaagaacatttgttagctactttttaggtgctgtgtatcaatcagttttcttagtttcaggtgacagaaactaactctgggtaacttaagtagaatttctaggagggccaaagaatctgacttggaggtacggtaaacaaaaacaaagtcctaaattacaccacagagctggacatagaccatagcttacatcagtgatagtgctgatcctgaactgtacttccagaaccaaagccatggctggcccttgcaactagataccactccttctaggccttctagggccacccttctttccagaagagtctcctttgcagtctggagctggtgcatctgtgtggcagagcctaggccatatgcctgtaccctagttacaaggaagtctgggaaataaattatctggtactttatacacttaactagtaggaggtcagctctatctcacaagataggaggttctgtaaacctaggtatgcagtcaggcactaagtggccaaaaacttctatcagcagcattttgaataatcagagaagattcaacacaggagatgagaaccaggaaacaacaaccaaaaaagaaatatggtgagtttggccttaatatcacaaaaagatgaaaaaacaatgtgttcctaaaccagtttacaaacccacagttagtgaaaggctaggtgatagcttatattctccaaagttataaagtcctaaagaatgtagcctctacttgagacccatttggtctgtgcaggtacaggcactatcatctctctctgtaaagggtcagtatgatgtttaggaaagcagcccacatttggagtcaaagccttttgttcttaccctgcgcagcccttaaccagatgtgtgacctgtaagcaaggagttcagttagtatcctcatctataaaatgagaaggttgaggtaggtgatctttaaagttcccccttggctctaaagttctatactttgtacatgataggccagtgacaactaatgtttttactcaagccgattgtatgttttagaaggcaaataaattatgagcttattttttgatgacagtacattttcataaacccaaaataattaaatctccacctcccacttagtttagttgttttgggttttttaaaacaattttattttcccacacagtacagtttaagcattcaagttgcagcaggggaaatactcattgaatttgtcatcattatttttggcttctatctttatgagagccattttagttttctagtttcagtgatctattttttagattttaagctacaatatattttaacatttgagtattaaattgcatttgtcataatgaattagaaccttacgtttctttcaaaaatagctttatctcaatatgaaatgcaagattattcacatttattataaagaggagaatttttgagacattctatatccactggtcagttactgttttgatttggtgatggaaaatcatagcaaattgtacatttaaagtaaaccaaataaataactttatgcagagatagagattgaagtagccatttggagatgagaattttatctccatgccttcaagaaagaccatatgtaaaccaggtcagaaaaataaaaattacaccatatttattttaataggaccatcttagaatacaagacataacacaagagaatttatttctggaatgacgtgaaggaatttattatacaaactgctccatctaaaacatgttcctaaaatgtaggttcgtagaattttttttttttttcccctggggacatagtttcactctgtcacccaggctggagtgcagtggtgtggtcttggctcactgcaaccttcgcctcccaggttcagtctctcctgagtagctgggattacaggtgcacaccaccatgcctggctaatttttgtattagtagagacgggagtttcaccgtgttggccaggctggtctcaaactcctgacctcaagtgatccactcgcctcagcctcccaaagtgttgggattacaggcgtgagccaccgcacctggctggttccaagaaattctaatatttgttctgtttttaaggagaaaaattattgaacaacttacctctaaactatagtcctttaatgataaacactactgttaaaaaattcttataattaacataatctgatattgttacttaagtctttgaagaaatagagaaaaactggctaacatcccttatgactgcatgtttttatatattaaatagcagtatcgaattgccttccactatctttttcagacgaaataatatatatttaaaccttgcaagccttatccttttttatacttcttttttctagaacagctttattgagttataattcacataccatacatttcacccatttaaaatctataactcagtggtttttagtacaattttagaacatatcaccccaaaagaaacccatccccattagcagtgactcctcattcacccctttccccactccagtaatgctgagcatctttttatgtgttactggccatttgtatatcttctttggagaactgtctattcaaaacatttgcccattttttattggataatttatctttttattgaattataaaaattatatcttctaggtacaagtcacttatgagatatatgacttgcaaatatttttactcattctgtgagtttgtcttttcactttcttgagcaagccttatcttgagcaagccttattcttaactctggttaaattttggttttctgaacattttgctaaattttctaaaggtctccagttgtggagtagcctgaaatgaatactttattttttgaaagtggaactaaactctaatttaagtctataatagaaaagagtaattgctataggaaccaacattttttttggttgtttaccctgtgccaagcattgtgctgagtgctttgcaaccctaaaatatagggttgttattcctgttacatagatgaagaaacaaaggcttgaagaagttaagtaagttgcacaaaatcaaaaagtgctaataaatggtcaattggaatgacaatgcaagttattttttttgaccaactttcacattttatgtggggtgtttgtattccactattgtactttttaagacaatattattttacagcctcattttccatccactacaatccctagattttttcaggcatattggaaccgaatcattcacttctgtctctttaaaactggaatttcttggtttctgaaccaagaaatttgatttgatttctatagccttttgattttttgactgtcccttccaaattggccctttttaaacaaattataacaattttcaaagctaaaaaaattctaaaggtaaacttgccattaaaatgattaaatgtaaattgcagaccattttaaatgtctttttgattagctactattaagaatttagctgatctacttcattaaaatgttatattagctcaatgaataattatatatttctgtgtaacaaattacccccaaaactttaatggcttaaagcagcatttgttatttcacagtttctttggtttaggaatccaagtagagtttagcaatgtggttctgctctaggtctctcatgaggtttaagtcaggctgctggctggtgctgcagtctcatttttggggaggatctatgtgcaagctcactcgtatggttgttgggaggattcagttccttgtgagcttttggactgagacctgcaattcctcactggctgttggccagagttctccctcagttccttgccatatgcgcctctctatgagacagcacatgacatggcctctggctctgtcacaatagcaacacaagagagtgtccaagatggaagccatagtatctttgtaacctaatctcagagttgatatatcatcacttttcccatattctactcattagaagcaaactattatgttcagcccactctctatagaagggaaataccaagggtatgaacaccaaaatatggagcttactgagggccatcttagaggctgcctgtcacactcagtgaatctattgtttaatcatggagaatccaaaagtcatggtgtttttatatagaacgttgatatgtacagttccatcctgcaaacaagtgataattttatctgaaaatatataaggaagtctctccatcctaaaatatgcatatgtgtatatgtattatttttaaagcatctttagtctgcatatacatttgctacttattaatctgttttatcaagagacaacattaaagttgtaagacacaattagaatagaaaattttatgtgtaactttatgttctccccttgacttataaagattgctattgaattttagtattggaaaactttggccaatgtaaagatgattttaatttgaacatgtacaacatgcaaaagaatattttttctccttaaatcatactttagaagtcaaccctaatttaacaaaataggtgatcctgaatggactttaattcatttattcagcaaggcttattgaattactcttctaactcatcatgagttacactcataataaaagtctgcactcctaattttggcctcccatagctcagtcaatctctgtctatgtttccagtttcatttcctattgccatctcccttaaccttccactccagcacagtttttcttgctcctccccatgttgatgctcatgcatgcctcagggcttttccatcttcctgaaaacctcttacccagatcgttacatggctcgcttcacttcatttacttctctgctccagcatcactaccataaagaagcatcccaccagcactcttcacaatacagcagggaccatcaaaaagcaagagacacaataaaaatgatagttgaaaagattaatctcatgacagtgtacaagataacttgtacgtaaacaggctggattagacatggatgagtgggggccacaattaggaactttcacattcattcaggtgtgaattgataatgatccagttatgaccaccttgggcatgagtaaagctacacaaacattctcccaaaaccaggtcttccctcggatttgtgatgccggtaaattgttgccaccttcctccatcctcctctaacagagccatttcagaaccaaaactttttaaagaaaagtttgaaaaaaataagaagcaccaaagaattagcaggaaatggttaggttttaggactagaaaccacaatgcagtaggggctctgcaagaggaaggagtgagtgcttcaaagtgacatagcagctgtgtgctgttgtgcctgagactccttccaatcctagatgtttcctagtggtgctggcaaagcttctgttggctgtaccacattctttcccaatccaactccctctatgtaaagtctcataattctaaggatcctgggttcaaatgtaagtttcttccgtagtagttaccatttgggtgtttctgcttcttctaaactcccttctaattgtttttcctcttgtttttaagctagtgattttttcccctgtattttacatatgcttatggaaagaacagatatgttttcatggcacttagcatgttataaatgcattgttttccatggagtaagatcattctaccactgagagcattaaatccatgttcctaaggtaacccatgttttcctagaaacaggggaagagtcatgaccaactttcacattgtctgctttgttcttggggtatcatccattgtgataaccattcccaagaagtttcctccccaaaacagaattacttctctgcctacccttgattcaagtgacctttcattacagataatctggttttatagggaaatctagtaggttctgcactcagttgtaaagaaagacagatgcaaatgggtttcagtaattggtacaacattgtcacaaagctctttagattagcaagtacttataaactaggtggaatattttttattccatgttgttaataagaatgccctaatcctctttacacacttgaaaatatccagggaatgcagagagagacagacagagagatagactcgtatgtaatcatggacttttgagataggtaggtatagatgttcctgtaaactaagcgtttgtagcctcccaaaatttatatgttgaaatccctaccatactgtgatatggagcctttggtatgaggtcagaggcttcatgcatgggattagtgctctcataaaataggccctggagagcttcctcaccccttctgccatttgaagacacagtgagaagatgaatatctgtgaaccaggaagcaaaccctcaccagacattaaatctgccagtgctttgatctagttcttctcagcctccagactgtgaggaataaatttctggtttttataagccatcctgtctatacagtttgtcacagcagcctgaacagacagagacaagtgtaatcccatcttttccttagctgtattattaggttagtgcaaatgtaattgctgttttcgccattttaatggcaaaaatcacagctacttttgcaccaacataatatttgctcacttttctctgttgtaattttctcatatgagactgtaggaaagaatgatttaatatattctataaagtgcctagtaatataataggtccagcatatgaaagcattcataataggttctcagtaaagagtggcaatgctcgagcatttctaaagaaacggaattgattatattccattcctttttcagacagttataaatgttagaaatttctttctgttactgctccagaatctgtgcttttcaattattggttctaattcagtatttttaggcctcagagaaaaagccttaatgccgtcttcacgtggtaggctaccaggtctttgaagatggccattttgtatcccacatcttctccacatctgctcatagaaatacagtttcttcatttgctcccttatggtttaggttcgaagcaactcagaatggaacacaacgctactggtgtgttaattagcaggtgagaatggaactatcaccttttttgttgtgttcttaacacaaccttagttggcatgaatttgaggagcagttatatttcacctttgacttgtcaaacttacacttgactaaaacctacagatgtttttctttttaattttttttaatttttaatttttgtgggtacatagtaggtgtatatatttatggggtatgtgacatgttttgatacaggtgtgcaacatgaaataattacatcatgaagaatgcagtatccatcccttcaaggatttatccattgagttgcaaacaatccaattattacactctttaagttattttaaaatgttacagatgtttttcaaacatgtctctgttctaccctatctctctcatcatatatttgtatgggattttacattttgacatattaaatttcatcttgttggagtttgctcgttttcttcttacctatgaagctgttttgggaccctaactatgacagtaagtcacttggctatgcacttaatcagcatgtgtttaatatccacactcacatttttataaatatttaacaggaagggaaatttatacctccaaacccactctaatccctgaactccaaatgcatgtaaccaactgcctgttaaatatcttcacttagatgattcctgtcagttcacacttaaccaaactgatttccaccctcaaccttctcctgtagtcttctcatcctagtcacagtgaagcatatccgtccttcacattgcacagccaaaaaccttccttgcagtcatccttgacccattttgtttcctcccacatcccatatctaatccctcagcaaactctacttcacaatgcatcctgagtcatacctttcttacttcttaccttcttgcactaccactttggaccaaatcatcagaaatagattcctaacattttctgtatttacccttacattctttagtctttttaaaatattgacgctagaatgaacctgttaagacttaaattatgtcactcctactaaaaatacaaaaattggccaggtgtggtgaggcatgcctgtagtcagtccctgctactcgggaggctgagttgggagaatcacgtgaacccaggcagcggaggttgcagtaagcagagattgtgccactgcactccagcctgggcgacagagtgagactccctctcagttaaaaaaaaaaaaaaaaaaaaaaatcaccttaatgccttttatctctggttacttcaacaccataattaccataaataattcatctctgttggaatatttgtgtcccattaaaattcgtatgttgaaatctcttcactaatgtaatgatatgaaaatcagcctttatgggggtgattaggtcatgaaggcagagccctcatgaatggaattactgctcttataaaaagacaaaggactttgcagggacgtggatgaagctggaaaccatcattctcagcaaactaacccaggaacagaaaaccgaacactgcatgttctcactcataagtgggagttgaacaatgagaacacacggacacagggaggggaacatcacacatcggggcctttcggggggtgggggacaaggtgagggatagcattaggagaaatacctaatgtagatgacaggttgatgggtgcagcaaaccaccatggcacatgtatacctatgtaacaaacctgcacgttctgcacatgtatcccagaactgaaaagataataaaaaaaaaaatcacgccactcctctgttcagaacttaccagtagctttccatctcactcagagtcaaagctaaagccctgacaattgcctgcacaactctacatggttctgcctccccttcccacacatgtacacaaacacatttgcttttctgacctcattttctagccttctacccttgcttcctcctctgcatgcacagagtcctctttgctgtcccctgaacatgccaggcatactcccaccttagggcctttgcatctactgttcgcctgtctggagtgcactttcttcatcccatgcactatgaatcttccttctgctctcatttttgtttaaggtattatatgagactgtgctactaatagaaattatagggctcttttggctagtgtcaagtatagatttgcgttttggactcacataactgaatatgttagaattacatctaaagaaataattgcctataaatggagtattgtgtgtgaagagttagagtcctgccccatctcctttcctattaaatgatagtgattttcacagtatctgagatagccctttgaatatcagagaaacataagagtgtaaagatttcaaggaaatggtcatatttttcagatgagaaaagttcaccaaagattttacccattggtgccagaaatgtaaggcaggcaagaagttagtagaagaaagtcatcacactgtaacaattattttttttaagttgtaggcactgatttccaaatgagttccataaaccactgctatttccatttgtagtatagcaataggttgtgatactaaccttaaaggtctcaagttcaacagcttattatgaggaaagctgccattcctttaagaaggtgagtttctattatctttttaaagagagaattactcctttataaaaatgtaacttcttcatactgtatttcagatctcttgctttttagtaaaacttttcattgcagtgggtttgataataatagtgctcacttttaaaaaattccctaaattttagtttcccctccagtcaccagctcacttttctgtgatcctctttagcagaactccttaaaagactcatctatacttgctgtttcctccttctctcctgctgttctctctataacccactccaaataggctttcatctcgtcgctccactgaaactacttatcaaagtttccatcaccgtcatgctaccatattatcttctccatcctcatcttattcccagcaacatttgacatcaccttggaacactttatttacgtgatttcactgagacctcctgtctggttttgtttttcatcttatttcattagatgctagttctcagtctcatttgactctttctcttctcccaaaccctatacattgaaatatcccaaggcctagaccctctagtctttggcctaggtgatctttttttatatatgtattttaagttctagggtacatgtgcacaacgtgcaggtttgttacatatgtatacatgtgccatgttggtttgctgcacccattaactcgtcatttatattaggtgatcttattcaatcacatggtatataaattacaatataggctactatgacagaggccccagaatgaaggtgcctaaacaagatgaaagttgatttctttttcctataaaagtgtgggagcttgtccaagactgataggatagcttgttagtactggagacccacgctctttctttcctgcactctgctgttctcaacatgctgtctccatcttctggtcccagatggctgcttcagcccctgcatcctgtcagtattctaaccagcaggaagaagaagataggaagtgagaacgtatcccttccctttaggactcagaagttaaacatgtttcatctgctctcatttcattggccagaactgagtcacatgatgataacttgctgaagagaatttaggaaatatagtctttaggtaggtagctatggcttccagctaaaatggagcagttcttttactagaggaaaaagagcgtgatggattttggaggacagggagcagtttctgctgcacatggctttaaatactatctatgagctaatgtctcccagatttgtagctatttcctgagttcaggactctttcctcagctgcctccctaacattctcgaacacctgcctgttcaaaattgaactcttcacttttctccccaaactcctacccatcttaggtctcccaggtgctcatgccagaaacttagaacagtcttgattccttgccttctctttcatccacttttgatccatctgccaatcctattaactttaccttcaaaatggactccaaatccaaccacttctcatcagatctatcttccacattaccaccaatgacttattttaataaaatacatatccccatcctgtttcttacttccttaaaaccttcctctgtctccttattgcctttgggataaattctaaaccctgtgtgaaccaactctttctatctctctggcctcattttcccattttccacttatattttgtatttcagtactacctagcacaacacacctcatgacttgatgtatttactaatgcttatccctctgtagaatttcccccacctcagacctggctgaagaatcccttagtctcaagtgtcacctccttcagatctttttttttttttttttgagacagagtcttgctctgttgcccaggctgaagtgcagtggcacaatcttggctcactgcaacctccgcctcccgggttcaagcgattcttctgcctcagcctcctgagtagctgggactacaggcatgtgccaccacacccagctaattttttttgtttttttttagtagagacagggtttcaccatgttggccaggatggcctcgatctcttgaccttgtgatccgcccacctcggcctcccaaagtgctgggattacaggcgtgagccaccgtgcctggccagaaaatgttctttgtcatctctccacctccccaggctaggtaggcaccttcctctttattcttgttgcaccatatgcatacccgtatcacacctatcctggatgataccagtttacatagctgcctcttttcctagatgcaagtgccttggtcaggggcaagggcttactcatctctcagtgcccaacacataatagctgctaagtaaatatttatgtaattgaatcatattgatcatgggaacaaactcccattgggagagcatcacctctgccttacatatctgagaaaagcccttgtttattgtaccctatcaactgaatctgctgggctatatattaaagtgggtattttaggccctgcttaaaaaataaaggttaaattgagcatattcattgctctgttaggattacataatgcctgatagtgcaaaaacatggttgttgactgaactttacagttgtctggggtttgtgaggcccagctatagtctaggtagctttgtgtgtttgaaggtattctgactagatgagtcagtagtttaaaagtaacaagtcactgttggtctgtgggagaagttgtgtggacttagacttgccttcactgctttaaaatcttgctttttaaaaaatcccaagaaaggtaggttctctttaaaaagtttatggcctgtatttgctgtcataaaccaacccagttttcagcctttagccgggctccactcccttagagatgaatggtaacccatataaactacatggcgattctagttgtttttagtcaggaaaagccccaaggtttttattaagaagcccagaaagaagagatgtcaaggattccggtgagaagtactatgttataagaagcagattaggataacttgtcttaaaaatgaaaaagggatgagaaacttgacaagtttttagtgctttcttagcactaaatgatgacttaaagaaagtttagtccttgccaaattttcccctttggaactgtttccactgtgtgatagagatctgccgctacgagcttgtcatcattctcatccactgtcttctttgtcttcttcgaagtcacgtcctactcctcttcctcttatcttttttttttcggcggggtgggggggttttgtttgtttgttttttgcactaagtcatagaactgaaaagactctgggtaatgttttcaaaataaagccacattgtttccaatacaacagctttctctgggttctttcactgcctccttaatgtaagtcttaatcacacttgtattaacagtagaaacactctgcagtatctcgtttcatacagtggtgttagaagcattaactcctcagccctcataccatcacaggaaaacagcaatcattgttaacccccatccattggggagatgaagaaaatgagcaaactatgaagaatgcagtttatttcgtctccataagactgtgaggcagtggaaggtaagggctagaccccaggatggctgattcctagggctcttttcctgtgctccagaatgcagtgacacctttcagttgttgctgtattcagaggtgtgtgttgcatgtgataggtacagtacttgacattattaactcttgcaaccaccctatgggttaggtattaatatccccatgttatagatgaagtctgtgattccaaagcctgatgtctctccactgtgccacacacactgactccacacaataacaattactcccatttcatatcacttgacatcctgaaagtcctccacaaacatcatcatatttaatccttaagaactttggaaatatcagtgattatcacacactttgaaataagcaagtcactaatcaatgtgatcttattaaaatttaagtcagttcatgatgctactactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccacctccagggttcaagtgattatcctgcctcagcctcccaagtagctgggattacaggcatgcgccgtgacacccggctaatttttgtatttttagtagagacgtggtttcaccatgttggccatgctggtcatgatttcctgacctcgtgatccgcccacctcggcctcccaaaatgtgggaattacaggcatgagctaccacacccagccccaaaacctcatcttgaattataattcccacatgtcaagattgagaccaggtggaggtaattcgatcatgggggctgtttcccccatgcggttctcatgatagtgagtctcacgagatctgatggttttataagcatctggcatttcccctgcttgtactaactcagtcctgcccccttgtgaaaagggtgcctgcttccactttgccttctgccatgattgtaagtttcctgaggcctccccagcaatgtggaactgtgagtcaattaaacctctttcctttataaattacccagtctcaggtatttattcatagcagtgtgagaacggactaatacaacctgtaaggagagtggtccgctggtttcctctccagcctcatcgcctcctactcttcccttgattctctctgcttcagtcacactggtcaccttactattcctcagatactcagggcacgctcctgcctcagggcctctatacctgctcttccctctatatgtaatgccctctccccagacacctgcttgactagctcccccagttctgccaggtctcgaacaaaaaatcaccttttcacacgcacacaaaaagccatcttgctggtcaggacttgccagaccactctttgcaaaattccagtctagcccctaacatgtcatatccaccttccatgctttagttttatccttagtctttatcattttcaaacatactgtgtatttacttacttctctcgcttaccatctgctcactagaatgtgaatgctgtgagggtagggctttcatctgttttgttgttcacttctccactccagcacctgtaacatactgggcacatagcaggcactcaataaatatttgatgaatgaaaacagattagaaaatagaaagtcaaagaagctaagtgagtttccccaaaatgatatggtatagcagcatcaaagctaaaaccaagactggtcttctgatccacatgcagtttggtgctcagttaggccagaatccgaaaaagttgtaagttaagttctgaaataaaactcagccaaataaagtagtttggtgtaatttgcacttttaaaataatttttcatcagttactatatcatagaggatgaagagcagtccttcccttggactgtctccaagcagcaggaataatgagaataagttacagaacttaaaataaacccaggtgtttctgggcctgagattcttaatgtccacaatgaagggaccatgtcagttcagagctcttcacagctctaatcttgaatccatctcatggatgaatgaaatgcctggttttctttgtaatttgttcagttctatgcatacaaggtatgcagtttgttctgtagataaactacacatgggtatttctgtaactctccttttatcatcattaccgtctgtttgattctttcccctacatttgtgcaaaatgtaggcttgtcatctcactgtgttgtattgcaggatcagcaagcatgtcaaggatctcatgtgtcttctaatctcatgcagcctctgctgcaaggaagctctcaccactgcctcctcagagttatccaatgggcaaagaaaccagaaggcaggacgacttaaggccagggaactaaatatgcaataatggtgtctgggggtcaggaaagcaagtgtttgtacaacatggcctggcattctttgtcactctgaattaaatctgcacatggtaatcagacctaaaagaagtgcaccaataagtcaggccattggttatccagctctatacaagttttggcaaagaaggttaaatgcagtgtttggcattgtatctcatcctggttcatttcttcattaaaaattccctctgtagagagtaaaatacagttattttgaggtggtgtccatatccttaggaacaggaggcaccgtcctaagctcctttacacataccagctcttaaatacacaacttgagtaaggtttataattctcatttctattatatgctgcacatggcttatgataaagtgaacctgcaaatgatagcaagatagaacaagtctgcaaaagtaagaatggcacgttaattacagaagttggatcctatcagtaatttaaaccaaagcatttatttgaaaacaaaatgaaacaaaacaccaatgccctcagtcaccttcttattccattcccatttgctccagtaggaattaatctctttatttctccttacccttgagcacttttatatatctgcacttgggttaaaggcagttctattaatttctttgtttggacagaagtttccttaatttaccataatcatcactgttgtcactatgccagtccagtatgtttggacttcacagataagtcttgcagtttccaaaacaccatcccatccttactgcgtttattcttgaatgacttttcactgggagatagtatacttatctttttcaacaaaactacaaatgggatcctaataacaagtttactgtttgttaatttgtgttagatataggcatactgtcatattttcctgtaatttttcatatctggtcttgtgaactgttactagtatttttcttccatatgtattttacctaccaacttgattgtaaactgcttaaagatagaagctatgttatataagcatttcacgcatgctggctcaatgaatcacaaataattgggaatttggttagacatctcatctgaacagtccctgccctgataccaccctgggacattcagcccttggccacctgctttgatgagcacatttctatgtctcctgcttaagtacttacgtaagatgctactgagtacctgacttcagacctacagagtctgtttttgttttgttttgttttcttttgttttgagacagggtgtcagtctgtcacccaggctgtagtgcggtggctagatctcagctttctgcagcctcaacctcccaagctcaggtgttagcctcctgagtagctgggactacagacacaaaccatcatgcccagctaatttttgtatttttcatagagacaggagtactccatgttgccccagctgctctcgaactcctgggctcaagcagtctgcctgctttggcctcccgaagtgctgggattgcaggcgtcagccactacacctggcccctgcagagtctttatcaaacagaagtgaatattaggaggagcctggggaagaattctctttgatttaccttggtgttaacactccagcgatacaactatggatcctccagaaagactatgtttttgctgtatcagtgccacctattaggaattgttccataaaagagcatgagaaactctctggagttcaaaaagtcaaaatgacatccttgctaaaaaatctctttatggtttgagttccatagttacaaccaggaatctctgggaatttggtctccaagctcttctcagagcatgtgttgcatacattctgcaaagcccttgggggatggagcaggcctagtttttggttttcagcagtgtttgttatcttcacagttaaatggaacactggaatgtgatatttactcaattttgcccatttttcattcagtatttataatttttaatgtggcaggtcttctaaaaaaccaacaaaaaattgctgattttgtgattttagtttctaaaacaaatgaaagcaaaaaacttctcgcccctgaactccatccctggctgttacccttcattctctgttcttactctttcctaagcaagtaagatatgacatttattcatcagagcattttatggttaattcactgttcaattttctaaaataccatttggcttcttacctacagagctatagcaccagaattcactcggtatatgtgtaagaatgactgcttccattttccgagagaaatagaaatagaactaagagcagtgatttccttgtgttaaagaaaaattattcatgacccttgttgaaaacaatagagaagactttattcaagggaggctatgggaacgatacaaggattacggcagtggagtcttgcagtgtgggagagagattgggctggagtctgactctgacaaggacaagtagggatttgtagccaaggagcaaggtgtgggggtcagtagatggaaaattactaagtggaaacaccaatgtaagggagattcttgctagatggactcaacagaattcttgctgaaggcaggccagggtgattagatgtcgagggtaatcagataacaagggtggaggatttttgttaaactttagccggattcttgctcaaactggattctgtaaggacagagagggaagcccagggtcaggcccatttgagcagggggcttatggagatctgattagagttagtttaatgagagtctttgtcacctgctgaaaagaattcgtttttatggctcagaataatagtgtaatcatagcaagagatgacttgtctatgtccattttataataattcaaaaatctcaataatttctgaaaaaaagaagcatttgttatcagagtcataaatgttgctatttatatgcttaagtagtagtatatcagaattcacagaaaggaacaattatttagtgtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtctcagcctcccgagtagctgggattataggtgtgcgccaccacatctggctaattttgtatttttagtagagacagggcttcgccacattggtcaggctggtctcgaactcctgacctcaagtgatccacccccccgtcagcctcccaaagtaccttaagccattccttttgagactctgaagaaagggtacgttcctaatgtttttggtttggattatcagttcatggcagagcagtgccttaattgtacttggtagtgaccactactagttgttcaatcatgaatcctccagtactttttatctgaataatatggagatcctttcttagtactttgttagacagcttttctagatcggtttccaatagtagcgaaagagaaaatcctttatcccatcttttccagaattaatattttctgatcacttcatttgcaagagtaaagtaaatattgaaaataccaaagtgagcttcagtcatttataagaattgtttaaagaaggcagtcatcagttacttttttcacatgattgtattgctgagagtagtatctgcattagtctcttaagcaagactttaaaaaaatcctactgttgtccccacctttatttttgaaagataaacttaaaatttacatttttaaaaatttttaaaaagtaaaattttaaatgactcaacaggtgattagattccatctaaggatgagattgaattcacgatctcagattctcaacatatatttggccttacctattgttaatgaaacttgcctgcaaggagggctgcatgttgcagaacttaaacggagcaataaaactatttataaatccagacacctttatgaggatgtttccttggtttcacttatgtaagccgacaaaacgatcagttgtaaggaactgaaggaagtaaacacttgaatgtactcaaatgtctaggctttgctgaacattatatgattaaaaagcagccaagttcagcgtggactgagaactgctgacaatggagaacatgagacccagaatggcaaataatgtttcagacattgacttgtcagactggtctccaccctgtacttaaccccattctcacccttttttggaggggaaaggaattatctagttaaaaactgaatctataggacaacctgtctctcctgaggcagctgacttatgctaattcttgcttagctcagtttcttgagtttagcagaggagatcactgtcacccacaccctctttaaatcagcctcctgtggggccatgtctacacaaccaaggcctcattcattcgtttattccaaaatatatttattgagtgccttctgtgtgccaaggactggggattcagtggtgaataaacagataaaaacacctgtccatagggaactgatattctagtgtgattactgctaggagtgtgtctgagttgaattgaggctcagaagtagatgtgtctgagaggcctcaggagtttggaaatgggggtgtccaacctgtttctttgtcctccaacaggctttattacctgtgcaggtatggtagtaagtctgttttgcatttctttaaggaatacctgaggctgggtaatatataaagaaaagaggtttatttagctcacggttctgcaggctgtacaagaagcatagtgccagcatctgcttctggtgagggcctcaggctgcctctactcacagcagaaggtgaaggggagcctgtgtgtgcagaaatcacatgatgagagaagcagcaagagaaagagggaagatgccagactctttttaacaaccagctcccatgggaactaataaatcaagaactcgctcacccctgagggagaacattaatctcttcatgagagatctgccccatgacccaaatacctcccattaagccccacctccaacattagagatcagattccaacatgagatttggaggggacaaatatccaaatcatagcaggaagagacactccctcctatgaaaacacaaatttgaagaacagttgtcttcagtgttatacaaactgctttctgactgcatataagagaattccgtttatggggttttggtctaaaattatagtgtcatgtcagatctcaatcattttaacttaaggcagttattctagcctttgaatacatttttcccctgaatattcgtggtgttgtgtgacaactatccaaaatattttaagattccattttatcagtaaaacatatgccaggctttttaataggcagagagtaatttggtagtatcattcctcttatcctttaaagttccttcatgctctagaatttaattcagtgattccttgtagaagctagcctgcccaacaccatgggcagagatattgcagagaatgccattttgatactctgagaagaacatgtaattcccatgccttgattttaaatgcaattaaagagccatagtttttcagaagaaagagtactctttggcaaacagtagtcattgcagaggtttggtccttaatctgttttcagggtagttatttcatggttactggatgttatagggacgtgcttctgaacattggtttagtttttatgggtcttgaatttcagattgtgacataaaacagttttctagtacatggtgccagtgttttaatcattagaagccagaaagtaataggccattcctcatgttggctgatgaccccaggctaaacctccaagctgtgtttaggacagtgaatcaggttccagggctagttcactcagccttcaaaatgattttttaccccaacccagtcttctcatgggcccctttgtacacacacctgaagttcacttgttttctgtttttgaggcactaattgtaactacataatcagatgtcagtttggtagtctagaaactctatttgaagaaaatacgtaataattttgttagtcattttctttttaatggtgtttcaagaagtgtttgagatcgatgaaatgatattcttttctatgatctaatgaagaaacctcccacagttgtgggcagcatttttggaaaagagtagccaggtccagtgaaaagcaaatctaataccattagtctttgaactttaatggaattagccagatttcctgaaatagtcctagaagactatcaaaagccctaggggagctaaacttgattgaaaatattataggaacttgaccatatatagcttagacctctgtggcataggctgctaaatttcccaagggagaaatgtcattgggtcacctttcaaagagtcattgttgatggttatgaattcaacagataagcttgaggttgaagagaagtgactttgattgtgttttagggacaaggtcttaacaaagtattgtctaaatttgtatttgaggatattagaaatccagaaaccaccatttctggaactattctgcgatggcactttctcaagttggagccaagaatggttgaattttcagaaagcaaaggatttcttgatgacttgaccagcaagtattagaggacagccttctcattgctgaaggttgtgttctatattttcatcatctgctgggtgccaggcactgtgctagctttgggcatgtagtggtgaacaaaacagatgttctctctgaatttatggagtggatagtctagtaggggtgacacacattattaaataagcaaataagccaaagtttaattacactttgtaacagatactatgaaggaaaagaacagatatgatttgggagtgctattagagttttggtcataggagaagacctgaggaaatgcatttgtttgatgatttaccagtattttaaatgtaatttctggtttcacagaacttgagtaagctgcacaagggaaaaaaactcatcttctgtaattcctcccagtttcttaagccactcagtaaatgctgactacggttttgtggatccattttgtggtgtctgttttcctttaggcaatcctccctctgtctaatttggatacagaatctaaatctttatgagtctgtaatagtacctggccattactggtctataatcagtgctcatataattgttgaatgaattagtgaaggttacaaattgagtgtggtttatcagttaaaagtgctctcccaattatctgatggaaccacaaaccttctcttttcccattatgcccctccttcttaacacaggtgttcccagcattctctccccaagagtaataccctatggccccagggctccatctatctcttttctacatataagtcccaagcctacaggttctagccctgttttctcctgcagagtatcagtccccaccccagtttcttactgcttgccagtcctctccactaaaatgtcctcctggaaactcagacgtgtgtgcaactcttccccctttgcctccttaagtctttagaggtcaccttctcagagagtcctcctctgggccctgcacttaaaactgcaagctactctcccatcccacctcaccccacactcaatccctaatcaacttccatgctttttccccccatagcacttattcatcattctctataacttattttctttattttctgtatccaccctctcactctctttttttataagaattaagctccatgaggacaggatttttttttccgttttgtttactactgtgtccccctgtgcctgtcatgtggtaggaattcactaaatgtttgttgaataaatgaatatttaatgttcaggcattatatatatataatatatcataatgcttctattgcattaggagacagtgaacaagtcagacgcttgcactgatctgtactgtcactgtgaatgtaacaaatacagactgatccaagtgttcctggtggtgactcagatatcaggagtgtctttgaccatagatgatgtgattttctgaaatgatagacaattcttgattgaattcagacaaaaacaatgctcccagcaaagtggaatggtggtgagaaaggattctgaagccatactgcttaggtttgaatctctcctgccatttgccagctgagtggctagtcacgtgatgtctccatgtttcatttcctcatctacaacataggaataataataattcttcctcatttaggagcttgttacaagaattagatgagcagtgtttagcacacagaaacactaagtgtttcttaagtaaattattattcagtagcttcgttcctggaaatttagggtatattaaactcatgtaaaagtactttatatttaaatttaaaacagtgagcttctagactaatttagtaataatcaagtttctttttaacctacatgaattatatgagatataagacagttgtcatatgggactgtcctgtgtgtcacagaacggccagcatccctgacccctgctcactaaattttagtaatacccttcaatcatcatgaccacttagagtgcctggaaggttggtggtttttacatacactgttctagcgaggcctatacatttgttttgtgacatcattatagatcatctaactagacaagctctccctatctgaatcctcattgcccagtgtccacaatacccttatcacagtgaacaaattctgctatgtcacagctgaatgtgtgctgtctctttttttccctccctgcctttggacacttcccatcctgaatctctcctgtcagaggaactgtttttaatttatttcagcaaaaggaatacgtggtggtggccagaagctctttgccccatgcatgtgttctcccttaagcctccagaaagattcttgagtttggaagcacttaccccatctgcagttttactgttactcactcagcgttcttcccacttataactgaggggctctagttttaccacgctccctgaccagcttcaatttcaccccacctcaatttttgccaggcacttcttaagggagccaaacttcatttctaaaagtattttaacattattcaattaaatggaacatttataaattggttataagggaaaagatcaatattggagttcccatggaaggtttataagaagaagtgggcctcaaagaattaatagaattggactaagtagaaaattagactgggcagaaaagagcaggaaaggagggggtttgtttgtttgccaagcagagggaaaaaatactaacagaaatgcagtgcatggtgtgtagggatggtcaaaaccaggactcagattgaaaattataagtaagaatggcacagtagagttaacttagggaagttcttggaaaccacagtaaaaacatgacattctaccacttccttgttcattgtgttcccgcctcccttgtttttctgtttgtttttgttgaagaggtctctcgtggtccatgagtgagtggatatttatttaccttccatgcctccacacttgtgtaccccacaccccaggggattcaggcacatatacagcagcactacctgtcaccagcctagtttacacagagaaagctacctctttttagggttagtgtttgattctgaatagaaatctcattatttatgcttctttgcaaagtactggtgaagtcttatcactttttaatattaaacttcatgtaaatgttttggatatttaattgtttatgatcaaggtgtctggctagtgtgttagtcatctcccagctaacagtctcttggcaggccatgcttaattcagttattgcatgttaacaggctgttcaaaattccacattgcctagagtttttccacctccaatgtccagacactttttctggcttctccaaccctctgggcattcagaatcatagtttagtgctcatatttgaagccatttagctctttcctttttatttgcctgattaattttgaatttgaattaatcatactttatacccttttcctgactcagttcagtgttcatctcattctgtttactcagaaagcccagaacataagatttgaaccatttgtgcagtgcccaaatgtgtgctgatggaagagtgaacctttaatgttttgactcccatactatttggttctatttttcctaaataagtcatggtcttttttcattaagtatacatttacaaaaatggttcagtctttgcacataactcagctctcacaattccctaatctaatgttgaccatgttctattttgtcataaaacccatgattttactgctttctctttactagagccctgcatattagcagtgaagacctggtccttaatgaaagtgtggggtccatcctcagtgtctcatatccctgcctgtgttttccttcaggagaccttcctttccttcctatctaagccagagtcttctctgtttccccagttaaaactcgatctgatagtttttattcagactgacaggcaagttgtaggcaacgattgaaggtggctttcttcccaggggtggccagaactcaaagtcttaaagtaaagggtagcaggagcttcatctgccatgattaagaggagttctgggggctctctgctgctcctgggtgcatactatataaacagatgcccagccacccaggggagggacctacaaagatcatgagttaccacgagctgtttccagtttgtcctcctttaattaaaataattagagcctcgtcagtaatgacgagattgcctcactaactgtccaagggtgttagtactaagccacccaaagaacctttttataatgtctcatagagtagaccagagaatgttgctgtgactcctttatcatttatagagatgtggctatgttgggactcctaatggcatgttaccccaaatgctgaactatccagcttgtcactcagaaggagcttcctgacttcagcttcaggcattcacatgctatctggtagagtcgtcttctagcaatgctgatagtttccttggtccagaatttgttaccttcagaagaagagtgtgaggaagagatcccgttctaaagccacctagaccaaacctagcctgagtctccttctggttgggcttaagatgacaatgccattccaaccatggctaggaactcctgagtcttggaatcagatcatagctttacatttccctcaaagcatctgagcttacattcccaggttttccatctcttcttgatatttaaagctttaaaaaaccgcagttatcagtttaaaccataacaggcacgtgggctctaatgacttctgcaggtggtttgggctgtattagagaacctagtcttgatcttaaactgtcatctggattctgagttaatccaggaaaccagtaagaattagtaatgtgtattgcatgtctctgatacatgtgttttccattatttggtcttccacagtgcatgcgcatacacacacacacacgcacacacagcccttcagtttttctaaaatggggagagagggactatggttccaaaaggaaatgactggtgtggtgccttgaaatctgaacttagtcacgtgttgtaaatgaaatgactccaggcacattaacaagatttctttctttcatctcctactttttggaaaaccctttgatgagaaacattggctaacttatagactttcagatttatttctgtaaagataagtaatagccattgcaaagcagccgtacttgtgaaattggagttaagcttccataacagcggtcttaaagaataggtagggttagttaatacacagcagcaaccagctgttcttcctccctgctgagactgggaaagaaggaaattaacttcaactataatggaagagattttcaaaactggtaatgggaaatttatcatcaatgaagactattttaaacattggaacaaatgagtgaccaacagaaatggaggaattatgtattctattggatttaaaatagaatatatcatctgctcaagacacttagaattggtagattagatctgtctaataatttttaactcttgggggtcacagaccccattcagaatctgatggcccctctctccaaaaacatgcacacacaaaactttgcgtatgatttcagggaacttacagactccctgaagtctataaattagacctgaatttaggacaccctggactagatgatctccaaaagtctgttttagctctctaagtgacaagctccacagcatagttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctgtgtcatctttgtagaaaggcagtacagaactaggttgttgccggcagttcttccccagccccacaccccgctctggattcatggatgaaaatgcaaactcagatgccatattaagtactcagaattctcccatgttcacacatctttttactgtattgctgtgattgttcagttgggcttgaaaaatattatttattttctcatcagttttatgtctaagtttcattgactacaagttggaagatgaccacccagaattacaaatcagggagtaatttggtcctctccctaaaataaagagcttttatcctcttaagaagtaggaatggagtatagtctgtgtctgtgtattttaaactcatgataatgagttgccccatatgtagaaagcatgactctatatggttttcccattcccttctgtaaatattctctagcttacctgcaagttctgtagactccctttaattccatgttggaattgtacttgacactttgtgcctggaatcaggaactctggaaataaagatcgcctcaatatggaagggaagtgatctctggaaaagagcataattgtcagatgtctataacttgtcagttttcactgtacctcacactcctaatggcaaacctttaaattcatagttggaagtgtcttaatgaagtcagaaatattactgatgaataggagctaagcgtacttggccagggtctccttaccattcacatggaatgctggtccttttgacagttgtttcttcccattgttgaaggcagggaggaggacttagggattcttctctgtattccccactaaaaaccccttctgttccagttgctccaatcagagtaatacactgcacagaaagcatacaagatatacgatgtctgtggacagatgctctgtggcattattaaccctggcagttgctttagctgttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcagagatgcacattctgttgaatatttattctttgtgtatattcctgtctgcagagaatgtgatcaatgggcaggactacgaagtgatgatgcagattgactgtcaggtgatggacaccaggatcctccatatcaaaagttcgtcggttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggagaaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggcggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaacgcagattagtgaacgtggattcctgctgagggagtgcatcccataatatggcaataattttcagtttctccaacgaaaagatagtgaaggaattaaatcttttgtcctcccatggttaaaaaaaaaaaaaagctgtgttcatttttactgtactatgcctcttttttcaccatagtagacaattatgtttcatttgatgaattcatagaactggatctcatacagcgatgtcctctctaatgttctacctttcagtttctaaagtgagtcttcctccctctcctacaaaacttttcaattttttgatgtaactcatctacaaatactgtttcttaccccagttgacttgcctttgtcagatttcttcttgttccacactatagcaatcaatttctcttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagctagttaaatgctttccaaggaaatcagttcaacttttgtgagcggggaaaagcagggctttattgttgtgttacctgggagtctggagtttgaaaagtgctaattaaccttcctctttttccacattacaaacctttttaagcagcgcagcactccccttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggaactgtcatacgttatcatggtcaatgtaaacctggtttgtgtggggtgattataaatagagtttccctcctctctgtgacagaatcacaggagaaggacccatctcgtggccttcttgttcttagcgc

SEQ ID NO: 17171 - DNA, 42250 bp, Human
cattagctgatacctttggtgtaatgtcaaaaaatcataggtagtgtgaacatcgttgccttgttttcttcaatcagctcttaaaagaccatgtatataaaaagtatttcgaaggacagaaataactctagtgttagacatttctggacatttagctggcaagatgagattatggcccctcttatgcctagtaaccagaataacaaacaaatgaaacttcagcaaaaaagggtaaaagtacaaatgtgattttatagtagttcattaaaaacattgagctggacctcagttctatcttttttctttaaaggattgctaactaataattttgctctttactcagtcattcatctatgacttatagaatgcctataatattccagacattatcttaggttctttctcattttttactatacccatgtgaaataggtattagcttcatttcataaaaggacattggagtttggagtggttaaatgacttacccaaagtcacacagttagtaagcgtagactgattttgaatctgggtctcctagtttgaattaataagtgctcaataataaataataactaaaggttatttagtgtttactgttttacatacttcatttatatcgattggtttaatacaaccaccaaatggcattttcatctttattgtctgttttttatagatgagaaaactgatagcacaagtagcttgccaaagatcacaagcaataaagctgaaattgtcttcagatcccatgattaagaaaccaatcactacactataaaccaatcactacactattcttctttcaaagaaacgaaggaagttctaggatcatgagagatggagagtattcaatctcctgaatgtaaatctaccagcattacttaccaagtttaagtttttctgttgttacttgaggcagtgggtgattatgcaattggtaaagggaatgaaaaggcctttgcacccaagaaagtagaagaaaggcgcctgaatctctttatgataggtggtatgttaaatctaggtattttcgtatttcaacatattccacttcttgcaaaagctgcaaaatgcaacacaactttaaatgtaaacatagcttccaagggcacagtgctgaacatataataacctgtgtgtgcacacccacactaggttatgtaacaggactgtaaacactggtcctggaatggcctgggaggtcatctaggtcctccaccatctttctgcagagtactgaggcctagcgacgttaagtctgcaaactcacaaagatgaccccgggcttatactaccttaggttacctactacctttgcttgcatttcctctctcctttcctgtctgtttgtgcaaaagaaaaaaggcctggcttcgccttcttgggagccaaaacacaaccaaacagagagcgagtttggagcccggccaggcatcttgtgaactgcacacaaaataactagcccaaggtcagagagcgcgccaggcccgccctgaaagtttctccgcaggaaaatccaccgccctttcccaaccacccgcgtgggtggctcggaaatccgccaccctggggacacagctccctgcccatctctgtggcccgcttgtgccccgtgccgctgggccgactaagagcctcgggctcgcacctcccagtacaacctagggacgtcaggggtcctgggacccacgagccgctctctgccggccggctcctggcccctcctagcagacccaaccgacatccttcaccctcagttagtgcgcaggagggaccgggacgccagccgactgcgctccagaactattcccattgggccagagaatgagtgacgcactaggccccgccccggcccggtgggttactcctttcatgcccggcccccatccctagccccgccccggcgccccgggccgcggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggccccccgcatgagggtatatattcggagcgagcgcgggacgccgatgagtggccgcgcggaaggagctggagacggtcgtagctgcggtcgcgccgagaaaggtgaggggctcccagcccagcgaggagacggcggggctcgggacccgggcgggcggagggcctggccccaccgcacacacggccacgcgctcagacgtggacacgcgtcgcacgaacgtgcacagcgcgggcagccgagcacacgccgaggagcctcccgctcgcccgcagacacacaccccagcccgtgcgccccgcagtcgcaccccatcctccgccaccccgcgagagggtgtgtgggctgggcagccgggtggatggcggggccagggatggaatgagcgcgccccagatggactgggggcgttgtgggaggaggtctgggccagtgtctgagtccgagggggtcgtgtaggcgtgtggggttgggagtggggcctctcccgggtgggcagtagagacctcgaggctctcaggctagggccttgtggacagttataccaagtgtgggggcctgtagtgggacaggagatcgttggcactgtcaggtggaagcgagttggtgtgtcttgaatatatgaggaaaagatttgagaggtctgacaaagacaggggatacatttggaggacaggacagtgggacaaaacctgtttgcttgccacttttttctttcttttttttggtttggtttgccatgatactggtagtgagagagaattgaaatttctgggtttcccctctcttggccaagcagaaggatggtattggagggctgagcacacgtatgctgaacatatggctgcttgaactttggcctgtcgctgtgctacacttacttctacatggtttatgaaatctgaaatcaggtaataggattatgatcatatgtgtgtgtcatttggtattgcaaaagtttaaggacttttaggtgaaattcactgggtgtggatccaagagttcgccggaaactcaaggcagttgtctattccttcacggttagtcagttggctcacttagctggagcaaagaaagacttcataggctgtgctgccaagcatttataggattcagttggtggttatgtctcaactctgatactgtttttcaaaagctttaagaggtttacttattcatttcgagggcatacgtataccagcagagataggggctgggtgggggaagccagaaaaggagggagaaatactggatttctttaatactggtatttaaattctaataaaaatatatttgataatggtagattattaccaaatttttcatatattttgatgcagatggattaggctgtgggcatgtaccaagttttgtcataatttctcgagcagattttcaactttttcagatttcggttgtcaaaataaaaatccatatcttttaactcttctgttaattgctgcttaccattacacgtgcctctaaacatcgttaatgggaaacatgctactatttttgtggcatgaaggtgcttatatctgcctcaaataaatataatagatgaattgtgcttgtccaaaactcaagtatggtcgttacattatgaacattatacaacatgtagatgaacacatgttaccagtggtttacgcccagatatcaaagtttaacctatgaggtaccctttttttttttatttttattttttgagacggagagtctcactctgtcgccaggctggagttcagtggcgtgatgtcggcttactacaacctccgcctccccggttcaggcgattctcctgcctcagcctcctgagtagctgggactacaggcgcgtgccaccatgcccagctaatttttgtatttttagtggagatggggtttcaccatgttggccagaatggtctccatctcttgacctcatgatccgcccgcctcggcctcccaaagtactggaattacaggcgtgagccaccgcgcccggccctatgaggtatcttatttgcatggattcattttcccaagtgtctgaaggtggaggagtatctaatgatcttttaggaaaagtttggtttatatcttaaaatgttatagtaatatgtttgtgtatgccttttatcagacagagcactctttactcttgactatcttgaaggcatgtgagaaaggttggttgtcttatattcatgaggaaatctatgcacagggaggtaaaatgattgcatagaatcaaatgatagagaaggaccaagaacagggacttcctattctttggttatctggttccttgctgatcttcctactacaatgtactcccttaaatcagaggcaaagcagcagcataaataaggtcttgggaaagactacattccttggaaaataatttaatataaatctgttcctctcaagtgtcttttttaatgtgattttttaaaattaaaaaataatagcatcatgactcttgaaacctatataaatcaataggaatgccttttaataccataatgaacattgaaagctgagtgttgttattaccacctcagggaacacacagatgtaggttctctagacctgagcttgtaaatggagtttgatgtttaatgatcctggtgaggtagatactattattaatctcattttacagataaggtaaccgaggcatggggaaattaagtggctcagcttagcctagaattgtgctctgaactaccatgtgtattacttttcactgttcttataggaagagaagataagtgtctttagaacctacttttaacctctgtctctcacatcgaagcaattataatgcagtgatgattctttacagtgaccctcaaatttattcctttcactctcattttctctgccactaatctggttcagacctttggtatttcatacctgcagttgtcttttaacttcttttcctgcttctagttgtccctccttacaatctattgtatccattgctcctttctctcatctctttaaagcatggtaacactgccctgtttgagaatctactgttcgctttctattacttattctctgaagtctaaattcttttggttagttttcaggcttttcatgatctagccctaccccaggccattttatatcatttgtcatacgttaaccttcttactgctttccatcccacacgtgcttgctcatcatggccaccaggctctgcttgtttcctaatcttttatttttttgagatagaatttcctgttgctgaggctggagtgacatgattacgcctcattgtagcctcgaccttccgaattcaggtgttcctcccacctcagccttccaagtagctgggactacaggcatatgttaccacatctggctaatttttgtgttttttgtaggggtggggttttgccatgttgcccaggttggtcttgaactcctgagcccaggcctgtgctgggattacaggtgtgagctaccatgcctggcctctaatcttatctatgtagtctgcccaacccttaacacatggctagattgtgcctgtttgtgaactttctagacagcacctatctcctgttgcatttgtctgtattgggcaagtagattaaatatttccccattttcttattttttagcactatgaagtttaacattttactatattatcacagaatatagctctttagaaaacatttgtcttattcactgattgttatatgtgtattgcttgtctctttaaggaggatccaagtttttaatgagtagagaaaatagatgtgttattgcttctttgcagaagttgctaatgaaatgaaatgtatttttccttattataggttgttctgtcttcctgaatatttcattatactgactacaacaacacatgatagtatttctatcattagagatacaaggaaaacatttaaatattaagcagtcaggtgttctttcagtggtagcttagtggtcagaggactaatacagagacaactaagtgtggtagagagtgtgaaccatgtcatcaggctgcctgggttcctgtcccagctccactcaccggttaggttacttagcctctctgcctgtcttctcagctgtaaaagagtggtaataatagtgcctatgccatagtgttgttgaaaattaaacaagaccatgaaggtaaagtacttagaagtgcctggtacatattattgtcttacaggtttgatctcttacaaatattgagtgatggaaaagcagaagttaatttttttaacatcgttttgaaatattcttatttttagaggggaaaaaagccctcaattttggaggttggattttgacatgccattaattacttttctcttttaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggtactgggcatgtacatatttcttactgaagtttatttgagatatactaaaattgttcaggtagctggatcatgtcactaatattttgattcatactacattaaaccaggtgacctagcagaaagtgacaaaattgtctttttatttttgatgctccatttaaggcttctctcattcaagtcttaatttgcctccagtctctttccctcctcaatttccatacttctgctagatttcttttcctgaagcacaagttaaatacttaagtttaagctggcttaattttttttttttttaagacagagtctcactctgttgcccaggctggagtgcagtggggcgatctctgcttactgcaacctccacctcctgggctcaagtgattctcctgcctcagcctcccaagtagctgggattataggcatgcactaccacgcctggctaatttttgtatttttagtatagatagggtttcgccatgttggccagcatggtcttgaactcctgacctcaagtgatttcgcctgccttggcctcccaaagtgttggggttacaggtgtgagccactgcacccagcccagctggcttaatctttaaacctgccctaacctgatcctaacccatatttccaatcaacattttagctgaaccaaataattcacctttccctgaacatgataccatgccttccctgcttttgctcatgtttatccttagcttgatgtgccctttgccctttctctacctagctaggtcaccttgtaaggtcatttcttgcagttgtgcagtgcagtagttctgccagttggggaacttacactcattcattaaggtttaccacacataatattttatctatgaccttttcttttgtgtcccaagttagaattagttgttcatgcttttatttcattctagcttatcataagagttcttcctcaataaattgtaaattcttgaagaacagcccatgtactagttgtctctgcatgttacgtagcatttagaacaagagttttatagttataagttgatcaataagtgtttgttgaattgccccaatgcttttcattctaaagcatgtaaaaaaatctttccccttaacctaatactaatttgtgcttttgagaatggcaaaatagctcaactgtagcttttggtggagttgaaagctgtgttttttataatctattactcctctgtaagtaaaatgttgactaaatattgtagctgattccctcagtgttggtacatgatccttgtcaaatctgggcctcattttctcaactgtgaatgagaacttgggcaaatactttccttagctttttaagacattattttattgcaaaaataatattgaaataacagattgcccataatctcatcaaagctatatttttatttgctcacattaccacccagtacttgattgtgtacatatttttttgtttctttgtggttttttttgagacagcctcgctttgttgcccaggctggagtgcagtggtgtgatcctcactcactgcaacttcgcctcttaggcttaagcaatactcctgcctcagcttcccgagtagctgggattacaggttcgtaccaccatgcccggctaagtttttggtatttttagtagagatggggtttcaccatgttggccagactggtctcgaactcctgacctcaagtgatccgcccacctgggcttctccaagtactgcgattacaggtatgagccaccgtgcccgggcagattgtatatatatttgatttcatagatgtgtagtaatactatacatacaatcttatagtctatatttacaacatggctatttttattttgttttccactctttggcatccccttaccccctgtaaaaagaaagattactggcattatcaacctgctgtatacctctctctgtctttctccaggctgacaaatttactgattttcaaagggtgttccaaagaacccaagggttttcactgttggggaagctgcctcttatagggagggagggagcagatactaaactggtaggtctccaacccctttatcctctactatgagtagttctgcctttttctgttctgtgtgtttgatctttacatgaggttttatttaaaagagtttagaagtttaaaaacagtttgaaaataattggatcttcttcaaggaggtgcttttcagatgtaaaatgcttggtagtagctaacctagctttttacttaggatagggctctgccactaagatgtgagagaatgatgcctaggtatgtccttgtgaatgaagagtttgataccatgacttctattactttggattcactaatccttcccttcttccctgggtttcaaaaaggctactattccaaaccaaaagccacacaggcctttctttaccctctagtatcccagttgcctatatttttcctggggattttaaggggatgaagtcttagtagtaactcttatggaaagtcaacactttgaccttgttggggaacataagccacaattaaggtatcctataatttgagtcttctttatgtcctttttgttggactatgtggagctagtctacatttatgacttttcatgtaaactaaaatccggaactattagaaccaagtatagcataacacggtgcaaacttccttttggcttagtgtcaaaggaaagatatttatctgtagcttaaacagtaagggtggagaaggagactttatgttgacattatatccttttcacttagccagaaactaccgtgtgtctgcaaattcataacaaaatgaagtttctgcagtaagttatcaaagcgaagagaagccattgtgaagatcatggcattgtatttcaggtagtaggaagatcctggtaattgtatcagggacagtttttacttccccacacccccacctcctcagaatgggggaatgaaagcattgtccagtaattgcaaagtatctggtggttattcagatgataatggacatttttacaactggagtggaaaattatttatttctgaaggtcgaatataagtgaccactgtactccttgttgaagagagatcttgctttatttcttgaagttttctgggcagttgtagaaaatggaatgtaaaggagcaactagaaaatctttattttacaaagctgagatcttgaaagagaagtaattataagctttgagaatgctgtattagtaaagatacactgggaaaacctgtttgcttgataaaaattcccattctttattaaaacaaatgcatgcttatttgaacacagatctaccaattttatattacaatatctaattagtattcagtcttagctttttttgcctatgagacattttcctattaatcataatggtgcttctctaccatatagcactatagtaaagtaagtggattatttagaagaaatgcattcttaacattatctcctctacattttttgaaatctagggtactgatgtttttaatagatttgttttattttaaaagtaatacagccgggcatggtggctcatgcctgtaatcccagcactttgggaggccaaggcaggaggatcatgaggtcaggagatcgagaccatcctggctaacacgatgaaaccccgtctgtactaaaaatacaaaaaattagccaggtgtggtggcaggtgcttgtagtcccagctactcgggaggctgaggcaggaggatggtgtaaacccaggaggcggagcttgcagtgagccaagatcgtgccactgtactccagcctggttgacagagcgagactccgtctcaaaaaaaaaaaaaaaatacttattttagagaaattggaaaatactaaaaattacaaaggaaaaaatactaatctctctgattccaccatacagagatactcactagtaatattttacagtcttttctttcacacacacacatatgcatatattgggattgtgtatagttttgtagcctgcacaagaatttatcatgaaaaatgtcaaggatattttgaaacaaatatttagtggcaaatttagtatagtgaacccccacataagcccccttgattaaaaattatgaaagttttgctccttttgctttctctctccctcttttttttcccctttgctgcagtattttaaggcaaatcccaaacatcatgttatttttatcctcatatagtttggtatctatgtctaaatatatgggtgttttcttactaatcacatgccattattatacctaatgaaattcatctaatgtaatctctgctatcaaaaactggttcagatagagattttcctgattagtctgctttttgtgcttactattttggggaaatattgtagtttctttcagctataacgtgattaaaaattaaagacttaaattattctctctaactttcttggatagctttcctttattcctaccagttgagtagcctgtttacccaactccactcatcctggagttctgataatttaaatgaaagttctgacagtgctttacttcaaaaggacctgtgctatcttccttgttaaagtgtataggaggaactagtctaagtaggaagttatccaggaagcatttgacctctgacaggccactgtaaacttttctctctgtttcttgtgaatgttatcagaaaaagtgcttagattctcttgggcccacaatgcatgactctccaaggagagagatactccagccctagaaatgtgtcagtctggctttctttttttttttttttttctaacttctgatttttttgtttgtttgtttgttttttgaggcggagtctcactccgttgcccaggctggagtgcaatggcatgatctcggctcactgcaacctctgcctcccaggttcaagccattctcctgtctcagcctccccagtagctgagattataggcgcctgccaccacacccagccaatttttgtatttttagtagagacgggggtttcaacatgttggcccggctggtcttgaactcctgacctcaagtgatttgcctgccttggcctcccaagtgctggaattacaggtgtgagccactgcacctggccgctttttaaaatttcaatttcagttttgcctgtgttgagttcccttgtgtaggaaaattattaacccttatgtcttatcatggagagatagaaagggtgatacagtgttgaacttttcagtgtttttcagtatttctgcagaggtagctttaggatagaaatttataatttcctaattgtcacatgggtttaaatacatttatatttagttaacatttttcaggtaggtgctgtgctgcccatataaaatttatgttatgacaaaagcagtcccaaaaagcttattgaattttattgggccacttaattcaaaacagcattttatctgtcatcataagacagatactaatttatgtgttacatacttttgataaacattgcaactttatcgtagtaacagctgaagtagatgagtactgagtacttcagccagtgtacacacaatttgatactgtgaacaatagctgtagctgcatttcatttgtgaattacagctggccttgattctccaggaactgctgccttttctcttgtttttcactgtttgctcataagtgagatgtgtaaacaggaagaagttaatgaaaagcctttttattgcaaatatatgtggattgtgttataattcattataatagttgtggttaaatagagatgagatgtaaatggatatctacctggtagtgtacatctgattggcatcatctcagtgccactgttaattggtgacttgactggttatcaggttcggagatggaaagaagcactaaagagcgaacaggagtttaggaaacaaacacatgccatttatctgaataaagaatgaggccactgtgagctgctggttagcaaaactttaaatgtgaaacaactggagagtaggaatgaagcagtaatttagggaacccatctaaggaagagaaaagtttatacagggctattttcatacctggttagacctatagaaagcactgaattgatgttgaatgccatcaggtgagcaggagctgagacatggagctggctctgggagtgtagcttttacctttttcaggtcagttagctgagggaaataactttcctgggactgagagtgaaagtaagaagtcaggaagaaggttggcaccatgttaagagtaaaacaacttaaaacacatgtgccatatgaagaaaatgtactgtataaaaagaacagagatctctgtgtccaaaatgtaggtatttggcacttcttttgaagatgttcagaaatattttttattataacacctttgatggtatgcaagtgtccagacaggagttctttatctgcatttcgaaaatggtacaaaacctgacctgaatagacatgactatttgtcaactttatttatcccacttaatgtgattatagggtgctgtttcatatctgctggggacatatataattataatatagcattttatatatgtactatagtccttttataaattttgaagagttctgcgttctgaaacaaatctgacccatgggtttaggtaagagattgtggactcatattttaaaacaatgctttgtaggtgacagcagaattaaatttattttctagaaaccatagtttatttgatataattcagggaataaccaaatataaaacagttttcaaatgtcttgaaaggttccctgttccctttaaatttcttcatctcagtttttgttatatagtggtttatgggtcttgcttaaggcacatacaaactcagaatggctgttaaaaatttcagtgtttgggaagttttggagaatgttggctcttcttgctcaacagttttttcatttaggatggtgggtaagacagactaaaaaaaaaaggcagcacaacctctggtggcagggtggtgtggtggtgaagaggccctggagtcaggtcctaatcctgattcacatttactagctatgtgaccctgggcgagactcttaacttctctgagttcattatctctaaagtggtgaaaattacacagtaactgcctcttagattatagttactattttgggttctattttggtacacctgattttatgttcttattttcaaactctgatgaggtacaattaaatgctatggagttaatgaggacaattctggttttagggaaggaagaaagaagatttaactctcaggtagctaaggtcagcttcatatcaaaggtgaaaattatgaaaatacataatgtgctgttgggtttttaaattgaaaaaatagcaggaataggctgggcagggtggctcatatctgtaatcccagcactttgggaggctgaggtgggcagatcacttgagcccaggagttcgagaccagcctgggcaacatggtgagacccctgtctactaaaaatacaaaaattagctaagtgcgctggtgtgcacctgtagtctcagctgcataggaggctggggtgggaggatcactcgaacccaggaggcagaggttgcagtaagccaaggttgtgccactgcactccagcctgggtgacagtgtgagactctgtctcaaaaaaaaaaagaagaaatagctggaatgattgctgaataatgttcttggactatacttactaataaaggaaaaatagagtcagaactggctctaaatttataatggagttatttttttcttttcttttctttttttttttttttttgagacggagtctcactttgttgcccaagctggaatgcagtggcacgatctcagctcactgcagcctccgcctcctgggttcaagcagttcatctgcctcagcctcctgagcagctgggattacaggcatgcaccaccacacccagctaatttttgtattttcagtagagacggggtttcaccatgttggccaggctggtcttgaactcctgacctcaggtgatttacccaccttggccttccaaagtgttgagattacaggtgtgagccactgcacctggccgggtttatttttctttatgttgttgacctactagtgtattagctttaagaaaacccaatatgtcaaaaacaaagcacaaagttggtaaatgaaataaacccacattacctaaggattttaaaataattgatagttgccatcactgactgcgtcgtctggcttagcctataattgtggccagtggccaggtttgttcacagaatttctaagaattctaatgaaagtatgaaactcagaaaacaagaacgaaactgtttaccatggttttaattttatagtttttctagcttgccagagacccaatttccacatagcctcttctcacaagctactctgccttatggtactgagactgtccacttttgaataataagatgggtcttaggaatggattatggcaagatttttttttttttaattcagactgagagctcttttgtagcttttatagttacatttatttgcatttggatctcaaatcatcttgaatttattttggtttgaagaataacatttttattcaaacattatgcttgatgactatttattgctgaatattcaactggcaaaaattgacaggcttccagaccaaagaaataaatcagtaatgaagatagtctgagtcttacattcttcttagctggtatagatggcccattttttaaaaaggcattttatttatttatttatttttgagacagagtcccgctgtgttgcccaggctagggtgcagtggcacgatctcagctcactgcagcctccgtctcccaggttcaagtgattctcctgcctcagcctcctgagtagctgggattacaggtgcttgccaccgtgcctggctaatttttgtatttttagtagagatgggatttcgccatgttggtcaggctggtcttgaactcctgacctcgggtaatcctcccgccttggccttccaaagtgctgggattacaggcgtgagccactgtgcccagcctacaaaaggcgttttaataaattaatatatatttacatataataaaatgcattagttgtaccttttgattttgttttgtttttgagaaagagttttactgtcacccaggctggagtgcagtggtgcagtcttagctcactgcaacctctgcctcctaggttcaagcaattctcatgcctcagcctcctgagtagctgggattacaggcatgcaccaccatgcctggctaatttttgtatttttagtagagatggagtttcgccatgttggccagcctggtgtggtctggaactcctggcttcatgtgatctgcctgtctcgtagttttatgtttttgtattttgttttttttttttgagtctcgctctgtcacccaggctggagtgcagtggcgcgatctcggctcactgcaacctccgccttctgggttcaagcaattctcctgtttcagcctacaggtgtgtgccaccatgcctggctaatttttatatttttagtagagacaggtttcgctatgttggccagactgctctcaaactcctgacctcaggtgatccacctgccgcggcctcccaaagtgctggagtgagccactgtccagccaattttatgttttaacaaatgtatactcatgtaactaccatcccaatcaacataagcacatttccatcaccatacaaagacttctgatgccctttgcaggtgataccccaagcgcattctgttgagttgggtttcaaaccagaaatcctaacttcagagcctgagttctcgcccattatactttactactttcctaactgaagatttattttctttatgtagcttacctgctatatttgcatgctcattgattatttattataggctggaggtaatttgatagtgtcatcattcatcccgaaactttggtattttctttactctgtcttttttttgacttgccacatcaattagtcatcaaatttttgcgaaacatttattatatctctcggttcttacctcctgacattatcagcaaaaaatatttagttcactaaaatgcatcgttcattgtttggtgttcggttgggttatataaatttaattgttttaataatagaaatgtttttattagcaaggtagtcatccacgattctatgtagattctgtattctctgtgccttacgttgataagcccctatcttgttatttcagtcccatgtgatcaataaaagcagcaagcaggctttggtccaagccagattctccaccactagcctgtacccaaaatcagcaaatggcctcaggacaagacagctgtatagccttacttcctttttgatgagtctttgctgctacctatgtatatttaatactaaagtgttgaattgtagaggttttgtgatacaagtgttttcttttctaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtaagatacgtctcattattggagtgtgtctgaacatatattgttttataatattcaaaatgcatatatactttatgcactcacagacatatttcttgttactgttgattttcttgggaggtataatttactatatatgttaaaagtgctatatattattgcttgatagatgaccactattgacttaataagcaatatatactcaccgccaacttttacattcctgactgagtaccttaaagtactcagtgagctctctgcatctagaaactcatattttcaggtaccaggttatttagctctcccacacccatgcgcctcttccgcatacacaccaggtgaaagctgcactgacttctgtgctatgggccatacttgtgtcctcagcctctactagtatgctgtattctcaggttctcaggggctccaccttggtcagtgttagttccttccctttttttttttttttttttttttttttttttgagacagggtctgtctcggtcacccaggctggagtgcagtagtgcagtcttagctgaccgtcacctttgccttctggtctcaagccatcctcctacctcagcctccccagtagctgggaatacaggcacctgccaccatgcctggctaatttttttttctttttgagagggagtcttactttgtccccaggctggagtgcagtggcgcgatttcggcccactgcaacccctgcctcccgggttcaagcggttctcctgcctcagcctcctgagtagctggcattacaggcacacaccaccacacctggctaatttttgtatttttagtagagatggagtttcaccatgttggtcaagctggtcttgaactcctgaccttgtgatctgcccgtctcagcatctcaaagtgctgagattacaggcatgagccaccgcacccggctatttttttttgttttttttatagagacagggttctggtctcaaattcctgagctcaagtgagctgcccccctcgacctcccaaaatgctgagattacaggtgtgagccactatgtccagccagtgttagtttcctaaggaccaagagattacagaagatcctgctctgctttttataagtttttggttcagctctttagtctctttccccgagcagttttggaagttagcatgttttgaggggaaaatcagctgtgtgtttgaggtcccccaagtccctatcttgttatttcagtcccatgtgatcaacaaaagctctactagtttctgtccccgagcagcagcctttggtccaagccatattcaccactagcctgtaccccaagtcagcaggtgccctcaggacaaggcagctgtatagcctcagttcccttttgaaagattctgtctctggacttacaatctattttgcctctgaagttctctgatgcctttaaaaaactgctttttgtaattttcgtagctcttctagctcttctcaccacgagtactggcctgctgtgaactgttttgttcatcttgatgcctgtggggaatttggaggaacatctgtgttctaagtggccaacattctacttacagccctggcctcctactatcatgttgaattttcttctctctctttcttccatctcttcacaactcaatttctgttcttatgcagagaagtttagccacttcttctgtcatcttctaaatatatccaaaccttttgtacctaaagttcaaaatatccaggataatttgttaaacagacagatacctcctgtggtatgaaattataccattttgtttattcatttaacaaatattaattgagtgtctttttctaggtattgaggataaatcagtaacccaaacaggcaaaaatcccttcttatatgtagtttacattctagtaagggcaaaagctaccacagtcactaattatagttttagaaataatttttttcttttttgccacactagcatgggttggatttttgtgacaacagaaagtataattatacttttatgatttttaaatggagggttagcagagcccagactgcatttcagatttcaataaaaagaaccccaagagatcattaaactgtattgcagttacccttttcttcctgtttattcagaataggcatttcaaatttaaaatacactttcacagagttctaaaatgtttacttaagccattttataggttctcttgaaggaggtgtgtttagtatgtttaatattgtaagtagatttatttcatacgtaagagttgatgaaattactgaaagaaattccccttgggtaacagctaatgaatgtgtcttacccaggaaaaatatgaaggaagtcaaaataataagcaagtgctttcaaagatatctttagcttaggaaatagacgaaactttattttgccctagtccacctagcacggttgcttagaagatctgattttctcttgtaaggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccaggtttgtaatcatccttatttaatggtgactagaaaggataacaacataaatcatcaaatgttgattttctttttaacatggtgattttgatatttaaacattaatatatatgtgttttttgcagcttggaaatgatttaaaaagatgaaaatgcccgttggtgtaatggatacacttttatgcttgttgtgggtgtctgctctatggagcaatttgaggagcattcagggtattctttctctataacaagtattttattttttattttttacaatttttgagacagagtctcactctgttgcccaggctggagtacagtggcgcaatctcggctcactgcaacctctgcctactgggttcaagtgattctcctgcctcagcctcctgagtagctgggattacaggcacgcgccaccatgcccagctaagtttttgtatttttttgtagagaagggctttcgccatgttggctaggctggtctcaaactcctgacctcaaatgatgtacctgccttggcctcccaaagtgctggaattacagccgtgagccaccgcgcccagccatatagcaaatattttatgtatactgcaatgttcatggctacattgtttattatagtgaaaacttggaaaccatatgctatttaataaatgagaggctaaattatagtttaaaaatagcattaattcttaaatagcattaaaataattggtggcattaaattctaaacattatttcagcaagttaagtaagagaatgcaaaatgaaaaactgcatacagtctatgattagggccactgctttgcacaattccaggtagtgcatacacatcatggtttgttaatgggacccactagaattggacagtgtattgcctgtgtagccacattcagtgaccctgagtacaacctcagtctataaaaatagacctactgacagatttatgtttatgagaatctgtacttggaggaaaggctgaaaagaaattaatagtattaacagtggtgctctctagatgtaggcttttatttcatcttaattattttggttaatggaagagttactattcttagctgtattttgtgaagttgtctaatttttcatcacttaagctatggttaaggttgttattggacaaagtacattaaagcagcattataaatagatggagaaagaagaggctttatttatatctcgtttaaatcaccttaggcctccatatcaatctgtttttttaacaaatgatttgatacaaaatacttacgtatttttgagatgggtgaaattgtcagcattggggttataaatacagagctaacttgaatcatacaaatgttaatgaaacttgaaatgttatgaaataatcattgcctgataaaggattttatatcatacaatatattactaaaaggggctgagttaaaaagaaagatatggtttttggggttgcctgatcttacattgatagtgttattctctggatagttaatgctaagtaaccttcaaaatcctatagttcaatttttttgacacctgattccttccttatggatattcagttttcttgcctttgtaaagcgaattttgttttttagggatcttaaccctagtttggaaacaatctttgtgttacctttatgatggattttgatatgctactaatgggctattttgttttccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtaatgcctttctcaactatggtgaggcttttgatggtcttgctctgtcatatacgcattccagaagtcaaaccaagtttattagggtgatttgaatattttagaaccatttatctctctaaagtaactaaacggtcccacacccactttttttcttaaattggcaagacttgattctagatgtaatgttgtatacttatcacaggtaagagtttaaactatgtgaggaggatttgtaagtacttcggaaagtggtcatcactagacctgggttggattcattaatatcaaattgtgttcaatcagattaacccaacttttttcctgtgacaaagttattggagtaggtaaggaaaatgtggtagaaataacagatttagacttcctaagtcaggtgacaaggtatcttacgatgttctttcgaataagatagaaatatgcaagttgggcataaggacaattaaagaggtgaataactgcttgaatgaccacacacagactgatactaagttggagggaggtttgtaatgatatgtaatgagtctgttcttggcattgtacttttcaacacgtttttagttgtataggtgatggcatgtctttatggtagcaaaaaatatatatattatagctagaaataaaatagacagcaaacatgcaaacctttaaaaacactttggaagacctaaaaatactgatataaacattactagaagtctgtataggtatccattctcatcaaaaacagtgtaataaaagcccagtcaaaatctcagtgagactattttggggacacttgacagaatgattgcaaagtttagaataaacatgtaaaggtggccaggaaaatgttgaaaaaggatgaagataagggaggaaagggggccgaagaccatctatcaagcattaaaaggaattgtaaattaaaagagtgtggtactggaaccagaatagaatgacagattaatgaaaatagagtaggtcagtcagaaacacatctgtgtatgtataagaagaacacattttataaaatatggcattttgactcagtggaggaaatgaatgaaataactggctaacaataaagtaagatctctctgtcaaagctcatacaaatatcagttttaggtggattacacagttaaatatttaaaaatgaaatcataaaggtattagaagaaaattagaagaattttataattgtgatgcaaaaggaagacctttctactgaaagcagtaaccatataggcttctgacaaaaacaaattcgatttcaaattattttgaaatatctgtatttaaaaagaagatctgccaaagaagttatttctctcaaagttaatctagaaattttatgcaaagtctcattggaagccgaaatcttaaatttactgatacaagttttgagagattaagctgatagacctaataagcctcctctggactctgaaaataagtgttggtttagttcagttatttaagacttctatctgttccaatactctgtgagtatctgaactgtatttttttttttttagccacagactcactatgtcatctaggctggtgtgcagtggcaggatctcggctcactgcaacctttgcctcctgggttcagtgattctcctgcctcaccctccccagtagctgggattataggcacacgccttccacttggtgtcactcttttttttttttttttttttttttgagacgcagtcttgcactgtcgcctgggccagagtgcagtggcatgatcttggctcactgcaacctccgtctcccaggttcaagcaattctcctgcctcagcctcctgagtagctgggattataggcacccaccaccaggcccagataatttttttgtatttttagtacagacggggtttcactatgttggccaggctggtctcgaacgcctgacctcatgatccacacacctcagcctcccaaagtgctgggattacaggcgtgagccaccgtgcccagctggtgtcactcttttttcctaaaatagaaacttaaaattgtactgttacgagcttcagaaccaatttaaactttatgcaatcagagagtgttcaacctggaagggaccccagagatcatctggtcaacccctttgatctcagaaatgagaatcctgagttctagtactttgtttgtttatttatttatttatttatttgacagggtctggctctgttgcctaggctggattgcagtgatgtgatcttggctcactgcaacttctgcctccaggctcagcaattctcctgcctcagcctctggagtagctggtaccacaggcgtgcaccaccacacctggttaatttttctgggtctttttgtatttttagtagagacagggtttcactgtgttgcctaggctggtcttgaacttctgacctcaggtgatctacctgctttggcctcccaaagtgctgggattacaggcgtgagccactgcacccggccagagttctagtactttataagactcaggctcaaggttctttatcacattaacagagccaggattagagttcatgtttcccaacttcctagtcttatattatattacattatagaaccatactcttcagattagtttttgctgacagttcaaaaatctttaaactggtgtgctaacttttgtgagtacactaatcatgcaaagatgcaagtgttaagtcactcctctccattacctgtgggctctgtaggataaatccagactcagtcttccttgcaaagacactcactgtttagtcctgtgtctggcatgtaatgtagtagtcattcagtgaatgaataagtaaatattcagatggaaccaaaacatgactagactggcatatattaaaatcttttagaaatgttagaagccgtttacataattgctcccctgcccttttaaaataagaaaatcaaagcattaaaatatgtatcttaaagcacctaagttaggggatgattcatactgtggtagtagaattatttgcagtactttatttttattgtatttatttattctgagacaggatctcactctgccacccaggctggatatgcagtggcattatcatggcttcactgcagcctcgacctcctgggttcaggtgatcctctcacctcagcctcctgagtagctgagactacaggcacccagcaccatgcctggctaatttttgtattttttgtagaggtggggttttgctacattgcccaggctggtcttgaaatcctgggctcaggtgatctgcctgcctgagccttccaaagtgctgggattacaggtgtgaaccactatgcctggcctgcagtactttaataggcccctgtcttggtgcattaagtattttttatggagtgaagaacatgagaaaagactgaaagagtgaggtagtttgcaaaagtacaaagttaaaaaggtaggaaccattgttaactgaagatcattttgtaaagcaattatagtaactctgaggttaaagtgttattttggactcagcttttctctcagctcactgcaacctctgcctactgggttcaagtgatcctcctgctcagcctcccaagtagctgggattacaggcatgtgccaccacacctggctaatttaccatgttggccaggctggtctcttaactcctgacctcaagtgatccacctgccttggcctcccggagtgctgggattataggtgtaagctactgtgcctggccctggactcagtttttctggattaaacttatgaaatattgagtacaccttttaagtttatactgtatatctttttttttttttctgagataagagtctttctcttgttgccccagctggagcgcaatggcgcaatcttggctcactgcaatctctgcctcccaggttcaagtgattctgctgcctcagcctcctgaatcgctgggattacagtgcctaccaccatgcctggctaatttttttttttaattttcagtagagatggggtttcaccatgttggccaggctggtcttgaactcctgacctcagatgatacacccacctcagcctcccaaagtgctgagattataggtgtgagctaccacgcccgttctatactttatatcttttctgtataatataaatggattcccacttcattcagtttacaaatgctttcttctgtaatgtagacttttaaaatatttagaggttaatagttgccatagaagtaaacctttgggaaatgtaaaatgtgaatatgtatatttttatttttatggctggttgggagtaggagtatatagtggtgactggaaaataaacctgtgtgcgttaaaaaaaaaaagagagagaataaggggaatctatcccaaattccctgcctagtaagatacccactgtaggtagagtacatgaagtaagagatggtgatgggttggtagataagaattgtaaataggcccatgattgatttaaataatttgctgcataatgttccccttcagtttaatctacttcctcggtagaaagtttcttttcattaagaactgtgttcctttcagggtggcaaacagtgaaccacacaacaggcttacttatccagcagtcctgcctcactgagctggactcagtgcctatatctctaattgctgtgtaaatgaagttctcaatagtggctttagttttctggatgagactgttactgactgtatttattttaagaaatcagttgttgaagaaaagtcttaactttattaatataatttcatgtctacttaggatagacttgtcaaattggggacagagttttaaacatattttgaagcatgctgaattgataattagactggacaaacaaaacaataccttcaaatagatagggatttttgagacagggtcttactctgttgcccaggctcgagtggagtgcagtggtgcaatcacgtttcactgtagcctcaacctccccagactcaggtgatcctctttcctcagtctccctagtagctgagactccagcatgccaccacgcctggctaatttttttattttttaaatagaagccagggtttcaccttgttgcctaggttgacaaatattttttattgtttgtttcttcggttggatatttatcttatctgaaccttgattttatattagtgcattgcatatagttcttttataattttcttctaaacacttaagtcagtgatgtgtgggattagtgtggtggcataccaaaatcacttgtgaggtttttaaaaattacatattcttaattttccctctgattttagtataccctcttttctcagctccccatcagcccagagccattgataaattatcacatcactggttttcagaattatttttttgaagtatagaatcacttatttcaaacaaaattgagtatacaaaacagataaatatgggtgggttttctaattaaagttggagtgggaggctagtgacctgcctgctctaaacccctttacctcctactcaggtccctgaaacacaaggaaaatgccaaaattaaagaaatgcttttttcaaatgaaatatcgggcaatagaaaatgagagacaaaatgcctaacttaggtcttttgtcttgtgaatcccagagaaatttcattttatttattatgaaagtaattgaggtggttaaggataaattaaataaaaagtacaagatacatgggggatgttgactcctgatgtaattattcccactccaatgtgatttactctgtgctagatatatgtatatgatggaatttctagcccaaggtttagttaggtgataaataggaaggaaataatatacctcatttccagttggaaagtgcctgtcaaggtatataaagatggatagttgattgtctaaagttaaagattcttcttggctttataccttttagtgtaagcaaagttgtaaatgtcatctttgacaatggcaaatctccaaagaaacatttaattcaatttcctcctctactgtttttctctggtggacaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaagtatgggcaagatgggggccttttaaaattatatttattgttaatcagaaactaagacacttgagagggatgcagacaccccaagtccatatcccacagaattcatctttcctgaggatcacttatcaaatggacatttatctcatgttgtgattgtttttagtaagatgtattgtaaggtgggaatcatcggagcccattccccagcgcattaatgggaggccaaagcatttctcccttctcaccctcccacccccaactatgtgctaggttctgttgaagcaaagcataagaaatgaaactttctttaccacagctgtgagctttttaaaaatacagatgttcaccttacaccaactgaattagaatttcaggaggtgggttcggggcatctatatttttagaaagctgcccacaaagttctaattcagctgattcccaggctggcatttagaaactagtgtgctaaagagtgaagaaattacttgacacctgcatgaaaattagcgggtagtgctacaaaggataaaataagagctattttatcccaccatagttttaaatgaaggacattctcactatcgatttcacttagcttttagacattcaagatgacttgtctactttttaaaaagttaatatgcattactttagaatatcaactccagttccaaaatatttcccattctatgccatttgtagctgtgttactgtttcatccatagtaacttaatgcgttttttaatgtacatatatacagttttaaggcatttgtaatgaatacagttttaatgcacacgtacacagttttagtggagactgttatttgatttttttttaaatataaagagatgattgggggaaagctattcatttactatttaaatatgaactgaaacttaaatgctcttcactttgaaaatcttagtattggttgttgacacatttgctcctgaatgttgtaagattttctggcattttaaatctggaacgtgattatatcttttctcctcctgcttcttagtgtttatgaacctcagttgcagcaccatgtggctcaaaagaagattccttatgtggatacccaaggacagttaattaagccagacaaacccaatggaataaagatggaaaaatttgtctttgacatcttccagtttgcaaagtatgctttgaatagtaccaataaggttaaataaatgtcttaaaatgctgcttttcactctcttaggcatgaaactgttttcaggaaacatttgatagcacatatctcacatggcattttgattgtgagtatgtagtctagattcattatagttctctggaataaaaccaggagtgtgatctgagttgcctatgagtacaactttttttttttttaaatcaactagtttctggctcctataaagtttttttcatatgtatattaaatatatatattatatatatattttatatatataatttatatatttatataatatatattatatataatatataaatattatatataatatatattatatattatatttaaatatattatatataatatttatatattatatataaatttatagttatatataaatatatatttatttataatatatataaatatatattgtttatattatatatataaataaatatatatttatttattaaatgtgatggggtcttgctatgttgagcaggcgggtctcaaacttgtggcctcaagcgatcttcccatctcggccgcccaaagtgctgggattataggcttgagccactacgccccgccttggtctcctgtaaagttgttaaagtcatttattttggatgagaaactgaaaaggttaagataaagagttgtctcgttttgtatttaggatatcttcttactgccctgtgaatagatgtttcagtaaacatgtttttagattatatagctctctataaagatcacatttgatgttgagatgcttgtctcagaatttgacgagtgcaaaaatgagaaagacaaataagctgtataaagttaatgcgtggtggctcatgcctgtaattccagcagtttgggaggctgaggcgggtggatgacttgaggccaaggagttggataccagcctggccaacatggtgaaaccctgtctctactaacagtacaaaaattaggtgggcgtggtggtgcatgcctgaagtcccagctactcaggaggctgaggtgagagaatctcttgaacccaggaggagaggttgcagtgagctgagattgtgccactgcactccagcctgggtgacagagtgagactccgtctcaaaaaaataaataaataaaatgaaattaatctttccatttctaaatcattttttttgcctgttttttttttttttccagaacagatactaatgtgatctttgtacattaagatttctaatctttccgacttaagatgaactgttctatagttgaggggggaaatgatttctcattttgcattgaaaaagaaaatttcagctttctttagtccaagggtgagcaatattttattcatcattcagattggaataggaaagcctattgttgagaccaaagccttagctatgttaaagggttagaagctgtgtatgcagtttcataataaagaggtctttatatggtttcgctctaggaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccggtaagtcagtatcttttctcttttgtatgaatcctttcttggacttttcctcttggacttctctctctctctctctctctgtattcctagatcttttttaaaaagcaaagttttgatgtgtgaacagttcctgatgtgaaataacagtagctttgcctattataaagagaatgattgttttactttcttgtgaagaggagtctttcagatctctctttttttaatttttattttttggaaacattgccaccatgacagcaaaaagacttctactaaataatgatcagaagatttttttttttttggtgtgccatatggttaaagcccatcagtaacacactataccacagggcaagtccttcagccacagaggattgtttgttgttgcccatatatctgtggcctcaccactattttttttttttttttttgagacagagtcttgctttgtcaccaggttggagtgcagtggcacagtctcagctcactgcagcctccacctcccgtgttcaaatcgattctcctacctcagcctcccaagtagcagggactatacaggcacatgccaccacacccagctaatttttatatttttagtagagatgggctttcactatgttgaccagagtgctctcgatctcctgaccttgtgatccacccgccttggcctcccaaaatgctgggattacaggtgtgagccactgggcccggctgacctcactactgttaatagtactgtctgtgagacccactcatagctccaccacccccaggctacctacaaattgtagtccaatggcagttttcactgtagcactttcaggtcactgaggaaggtgtctagaagagaagtaaatgtcagttacattcactgatacttagaaatggctttggttttgagaagttaaaaaaagaaggtattgtagttatttaaatccaagataaagtacttttcagctaaatctgtttttttgtttgtttgtttgttttttggagacagtttcactcttgtcacccaggctggagtgcaatggcacaatctctgcccactgcaacctctgcctcctgggttcatgtgattctcctgcctcagcctcccaagtagctggggttacactcgcctgccataaagcccagctaatttttgtatttttagtagagacaggatttcaccatgttggtcaggctagtcccgaaatcctgacctcaggtgatccgcccgctttggcctcccaaagtgctgggattacaggcgtgagccgccatgtctggccaatctttttttttttttaagacaaggtcttgctctgtcacccaggctggagtgcagtggcgcgatcttggctcactgcaaccttcacttcctgggcttaaacaatacacccgccttggccacccaaagtgctgggattacaggtgtgagctattgtgctcagcctaaatcttgtattttatgatgaaaccttcactggcacctagaatttccctttctgaatcatctggtatatccgtacttatgtaaaaagcattctggcatttaatttatattcctaacggataagatggctggctgcaagaatgcctcaataaatggtaaaatattgggctggacacggtggtttgtgcctgtaatcccagtattttgggagactgaggcaggcagattacctgaggttcaagaccagcctggccaacatggtgaaaccctgtctctactaaatatacaaaattagctgggcatggtagcgcatgcctgtatcccagctacttgggtggctgaggcaggagaattgcttgaacccgggagggagaagtttcagtgagctgagactgtaccactgcactccggcctgggtgacagagtgagactccatctcaagaaaaataataaaatgttagagaacactgaacattggaatttactggtacataactggttttacaagaagcagcagtggtagctttcatctcccagtccaaggccacttttgggctctgtattgtcaacaagcttgctcttggcatgtcacattgtcctcatgtttcatctttggccattgagttttatttttatttttttacccccttttggtctcttgggacgaatttatgatttaccataaatacataccattcaatcaagtatattttgcaactccatttcattgttattgtttgatttgcttccattcccattaatccttatttattcccacatagcagtgctacaaatgggaagtcagagaccatcacagctgatgtcaatcacaagtaaatataccagcctgcctacagtgcatggtgatggggctgtgcttccctccatactaactggcatcgtagtttagtgctctgccttttgggggtctggagggaggatggttgaaactttggtgtgggtgcactgcttacttggtggcaggtatctctctggatgacactaactcagaatcttgttgcatgctggaaatggggagcatgctttactaaagaatctgaccacaggtgttagagctggaactgacagattttcagatgataggtaagatccagagcaggttacaggtcagggagaacacattttgcacctttaacataagcttatacggggttaaaaataccattctgaagatgtgtcttgtggaattgggtgtatgctctcagtatacaggctgattgttcctgtcatatttgatggcccttaatatggagaaaactgttctgttgatttattctcacactaacagctctcctttttggtcactgcattaattttagtcagttactttcttgcttctaaagaatctttttatcttaatggcagatcatttttagttagaagtaacacatatcctctcccatctgggtactgacagagtttggaaaagccattatctttatagtttaagagacagcttgatgttattgttacactttgaaagttaaagtttttaaggttgggtgcggtggctcacacctgtaatcccagcactttgggaggccaaggcaggcagattacctgaggtcaggagttcgagactagcctggcaaacatggcgaaacctcatctgtactaaaaatacaaaaattagctggtgtggtcatgcacgcttgtagtcccagctactcaggaggctcaggtgggagaatcacttgagcctgggaggcagaggttgcagtgagctgagatcgcaccattgcactccagccttggtgacagagcaagactccatctcaaaaaaaaaaaaaagaaagaaagaaaaagtttttaaggtaatttgggaaatatatgcagggcaaaagatctggagatggaagttatctcagaaatagagtagcaccttcatcagtgtcacccacgtgctttttcctgtctgtgccattcctctgcccagacaaattcctgtgagtgtcagtgtttctgggatgtgattctgtaaacaaggaagtggactcaaagatctgatcaatttcttataggtgctgtagatcagcggtctccaacctattttggcaccagggactggctttgtggaagacaatttttccacagacttggggtggtgagggtggtttcaggatgattcaagcatgttacatttatagtacactttatttctattattattacattgtaatgaaataattatacaactcactgtaatgtatagaatcagtgggagccctgagcttgttttcctgcacctaggtggtcccatttggggatgatgggagacatcatcaggcattagactctcataaggagcacacaacctagatcccttacatgggcagttcacgatagtgttcacattcttaagagaatctgttgcggccactgatctgacaggaggtggagctcaggcagtaatgtgagtggtggggagcatctgtaaatacagatgaagctttactcacttgcccactgctcatctcctggtgtgtgatccaggtcctaacaggccacagagtagtaccggtccatggcccaggggttggggaccgctgccatagatgactgttgtctctcctgccttgggaactgggatgcagagccctttatcactttctgtctcatccaccatttttaatatatggaagcaagctgcttttatatttaagaaataaaactttgattaaatttctttgtcattgaaccatagcttttaacctaacagtgtaatagattgttaattatataactgaagacagcatctagctatcttagttaagatacaaaaagctttaaacattattcttactcttttgtttaatatcccccatcgcccagtttacttcattttagccatttatagaataattaaagtgaaatcaaagtttggctttaaatgataccatgcactgaaaaagagttcctgcgtaatccttagcaccaaaggatgaccttacacagctgaagaacatcatgtaattgtgagagatgaaaaggaagtatattatgtaaaagagggaagaagcaactaggaggtattctgaaagaatggaaacaaccatgctgagttttgactcgatattatttttatttctcaccttaatgcttactgaatagtgttagctaccaaaaggatgcatggctaaagaattgtggggcagtaggtttattgggctaatttgcttatatcctgagattttacatttggtgatggtagcttctgttttccctccttcagggcatccaattttgtttactgaagttcactccttagtttcttggggtatctttgtggtagtagaatggaagttacatattcaggccagctgtatatgtgtttcttgggttcacaaccaccttctgttcctgctacactgaatccttcaggggtttaggtgggactgggctatatacatcttaatggggtgggccctcattttttcctttttttttcctcggcatgcctactcaagattcatttggttttgtatgactttgagttgccccagaaggtctggactagacctcttgagctcttgtggtagaatctggcatgtatgtagagaggtgtgtgccccactatgcctcctcttttcccttcattagtttgtcatcattttcatagtgttatttgttcagacaacaagcattcgtaggcctgctcataggtttataggtgctattagtatcctaggtgctgaagtatcttatacaagagaaataagtcacttcttacagactactgggatgttcaagatgcacatacataaaagttaagtaacattttcaggcagtatgtgattatgtgctaaatgtgtgctatagcaataattactctgggaggcagtgacttagcaggtgtctaatacatttattttttatttattattgttattattatttttgagacagtgtcttgctctgttgcccaggctggagtgcagtggagcgatctcagctcattgcaaccttcacctcctgggctcaagcgattctcctgcctcagcctcctgagtagctgggattacagatgctcgcctccaagcccagctaattttttgtattgttagtagagatggggtttcaccatgttggccaggctggtctcgaattcctgacctcaagtgatctgcccaccttggcctctcaaagtgctgagattataggcatgagccaccacacccggccacattaattaaattaattaattaatgtatttatttattttcgagacagagtctcgctctgtcaccccggctagagtgcaatggtgcaatctcggctcactgcaacctctgcctcttgggttctagcgattctcctgcctcagcctccggagtagctggctttacaggtacgcgccaccacacccggctaattttgtatttttattagagacagggtttcaccatgttagccaggctggtctcaaactcctgacctcaggtgatccacccaccgcggcctcccaaagtgctgggattacaggtgtgagccactgcacccagccacatttattttttatatgaataaatggatggagacaatcactatgaaatgcagtggtcaagagaagattggggcttgagccaaatcttggaggatgagtatggtttttatgggaccatagttgagaatgacttggaataatccaaagagtgtgactgatctggtttgagtggagagtctcaggataagtaaggtgaagtaggatagagagtgctttgaatgctagagaaaggttgacctgtagctaaactcagaagccctctgatttttattgactccagcaaagtttgagactacgtacttggggaaagcacagaaagagctatggtttgacaagagactaatatttttgtgccctgtgtcttattggtaagattcttgaagtggcaaataacaaagaggtctaatgactgcaaactcattgactatttattgacttttgtgttagataacttagaaattcagaattgctgtaaatgttaggttgtgacctagatgaaacaaatagggactttgaccttgccttcgcttgagtgcattctgccttagctctttaaaaagggacttttggtaacagagaagtactttgaaacatattgaataaattagctcagctaatctaggacatttgggttgtacagaaaaaacatgtactgggaaataatttaactgtctgatagaactttctgcagtgaaggaaatgttgcatatctttgttgtccagttttgtagtcattggccattcatggcttctgaacactcgaagtgtgattattatgactgagaaactgaattttaaattttaaattagttttaaaaattttaattaaatttaagtagccctgtgcagctattggcttctgtattggatagtacagctttagaatgtttgtcaacattaatagtaccaaggtagtggtgaagattaaaatgcaatatgaaggcttcagagcacctagcattgggcttggcatatagtatatacctagtaagtagtcacctttttatcaaattgaaacttggaaatggttaaaaatgagatgtatgtaaggggacagtgtgtaaaaactagtgaagtgctgtaaagagctaccagtaattattggcacttgccccaaatagtgtccttctgacctgagaatttcatattaacttaatcctcagggaatttagtgatcatcagggtagcatctattccatttgtttaactggaagaattatctgcaagcttctcagaggaaagttatggtttgtacttttgctctggcaagtaacatgggaagcaaagtctttaacacatacttgttttttttcttagcttgaaggatgccaatgatgtaccaatccaatgtgaaatctctcctcttatctcctatgctggagaagtaagtctgctttactttttcctctattcttttacaaagctttgtatatttcaaaataatgaaaaagtggattttaaatgttctcaccataaagaaaggataagtatttgaggtgatagatatgttaattggctttatttgattattcgacagtgtatatatgcattgaatcatcacattgtatctgaaaaatatatacaattattgtcaattaaaaatgaaataaggttgggcacagtggctcactcctgtaatcccagtactttgggaggctgaggcaagaggattgcttgagctcaggagtttgagaccagcctgggcaatatagtgagacctgtctttataaagaaaaaaaaaattacaaaaaaagaaataaaacttttttaaaaagtagaattctggcattgttttatgtttaagtagggatgtccttagagaagatgcagcattttctgatggtcctgccctgaggagctcttcctgggaacaagttgagaagctgcatttgttctgaattcttctctttgagaattcgtgttatggctttgcatctatcccataagtgggttagttgccattaacagacatctgcaatatctagtccatttcacctactcattgaaatgtagtaggcttttgaaaaatatataatcagccttgttttttagatgaatcacctggctttttttaaatgcaatgtaagttttctttcaaggattctagtttgttcaagtacttagtactgtcacttttaaaacttggggatttagaggtctctactcttttacttatgtaatatttttcctggagatctttgtattgctttgttgtagcattagagatagctttcttgcttagaaagttaactctactggccgcttgcagtggctcatgcctgtaatcccagcgctttgggaggccaaggcaggtagatcatttgaggtcaggagttcgagaccagcctggccaacatgataaagccctgtttctactaaaaaatacaaaaacttagacgggtgtgatggcaggcgcctgtagttccacctacttaggaggctgaggcacgagaattgcttgaagctgggaggtgggggttgcagtgagcataggggtgagactactccgtctcaaaaaaaaaaagttaactctgtgagagatgattataggaaaaatgtttatcttattaactgtagaaatgatcagagtaattttctttttatatttttgttttatgcttttacaagtcagtcattaagtctactctaaaatgtctattaaatagattttgacttttatattctgcatctcaaccttttttggcatttgtgctttaaatcatcattatagcaagtccagcactgcatgacaagtgcaaattttctaattgtgtttcatttcaatcctctttttagggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctggagtgtcatttgtacttgaagaaattatttcattgagaaaatatgaaacttgggagaaactttaagataatgcataaaaacaaattgatgcttcagtgaggttgcagagtcatagaacttctttcagtgaatatctaactttgggctttatcttcttatcactttataatagtagctctcacccaaagattattttgtcctccacccaaaggggcatttggcaatgtctggagatatttttggttgtgacaagtgggaaagtgaagtggtaccactggcatctaatagggattagggatgtcactaaacatcctacaatgcacaggatggtctcctacgacaaagagttatctggcctaaagtgtcaatggtgtcaaggtcgagaagccttgtttcaaattattcatttactctgttttgcccaaatatttggtggcacttaggaattcaaaagaatgtagtttctgaattttctctggtaggctattccagttttttgttattgttgttgttattttagaggattaaaaaaataaaaagacaaaggtggttctttaaatatgggccatagatcattggtcattagtaagggttctctgtgtctaaaatgctgtttgcatgaaaagactgagctttataaatgcatcttaaataatatttaagtattgaccaaaagtataaaaaggaacatctggataaatgattctaaaaattatatctagaaaagagatgaataaatttcattttccactaacaagttgtcacaagataggatgtcattcatggggtgggtcttttgtttaaggatcacttttttttttttttgaagagcatgtgatgttcatatccatcaatcttacctattttttttttaactaaggcctaaatcattcatttagcatattttctattttatttcaataacagctcaattttgctattgttatctattccagttttcaaaaagattagtgaagtttgacttctcattgaaatgagctccaaatgggttgtaagaatggaattgcagagtctttagctcctgaatgccaaaaactgatactaatggtatgatccgtttctttttttcttgaaccttgctatttcctctgctatttccacctgctatttattcttctcctgttgtaagaaaatactagtgatgctaggaaaagggaagaatggaaatgggattgtgtagtggttttgttggagaggagcgatggctggggaacattgggtagttaagagcaaactctgagagcctctgagccatgaaatgataaggtgatagcattatgtatttttatgagttcttgttaaataattgttataattcagaaaatacagaattgggtaaaatgtttatgaaaataaaagctagaataatttggcagtaacagtatagaatttatgtgacagttgatagtcattttgagtctggcttgatcgactggctgtgatttaataacttttttgatagtcacaagtgaacatataagcccaatgggtatgttacttgaatatttgatttttgttcaatttccctcttaacctctctaatttaatccagttttgatgtccacaaaggaatttttagtgacgtctattggaagataaagaaaaattcagttttcaacttctacctcttctattcctggaagttttggcttttattggtaattttgattttatttctaattccagcttactattgctagcacttcctctttattcatcacagtacagtcagatttcagttatccaggtaaaaagaggcaaggaaaaagcatgcatactcttagaagagtgactaaaacacaaatcattcagttagtttggaaatctgtttttctgttggccaacgtggacatttttgcaattcatggtcctgttttgagccctggtttaggaaatacatattgggaagtgatgaatgaatgagttagccaataaggactgagtgcttgtcacgtggccagcaatattagatgggg

SEQ ID NO: 17172 - DNA, 11380 bp, Human
cgagctcccaggaaaaactttcctccccttttcaggtatatacacagtggactccgtgggaacttgcacaggaaggaggggggcttacctaaaacaaacctacagtgatacaaacaagagaacccacgctttgtgcttgcctagagacatacccacatcggcagaagataagggaagttgcacagacagatttattcataagagaagttactcaaacaactatagagatgagaggagtttcttataataggttttgaattcagctgtaaaaatggcaccccacttgggctcccctctctgctgtggagagctttcttcttttgcttattaaacttttgcttcaacctcactctttgtgcccatgctccttagttttctcggtcgttagacaagttcggataacaccttagacaatgagaccattaacccttacctgtttcaacatttttatcaaatccaaggccatgaagctttccccctatgttttctactaagaatgttatatttttaggtctttaatctatttggagttattttttgtgtatggtccaaggtaaaggtccatcttcattcttttgcatgtggatatctagtttttcccaacactgttgaggagattgtcctttttccattgtgtggtcttggcactctttttgaagattattctaacatatatgcagtgttgcaggtgattagcagctttctgggctggtgacatgggtggtaggaagaatttaccaacacagttgtaggtaaagaaaggcaggtttattagataaagtatgaaaatacattgcaagggtgcaacaggcaggtcagcaagagagaagctgactgctaggaaacaaaggcttgctggggattttgtagaatggtgcttatgttgtgggtggaagagggctttgtgcagtactaataatgccagggttgcagtgaactaacttccatttttctatcagctgagggtctggtgatggctgggcacaggcagattgtgagttatttgcacagcagggctatgtgtcctggaccacgaagaaaggcagacttatggcttgtctgctttctccttttgcttcccttcgtccagccagcctgactccttttccctaattaggactccacacgcaagggtttgttctgttccagaatagagacacgtcgatgtatctatctttataccagtactatagctgctacttcttgaccaattacagctttagtatctctctcacctgtcctccctatacaaaagatatataaaatatactcactgtactgagtatcttcctgcagcattcagtctggagcaaagcctgcttccttcaaccctttccaaaatccccaaataaaagcccaaaatctgtagaggatcttcctaacatcctcgtgctgagatgccctgaaattctccataactcatgactgagtaataaaaccaacttgcttaattaaagttggtttcttgtagtcctggccggaggacattgacttacaaaaatataggattagtatcttcaaaataaatagacagtaaacatcaacaaggattcacaccccaataatgaaattgggcagaaaaaggaaaaataatcatgaaatgcacagtaaagatggctccataatattgaaaaaaattttacttcaaatgcataaaatgatgcttctgattcagctggtgcgacatttatttcacatttgagttcagctgctcctgatgtctctttcctgaaaatttcaatactaagagctcgagaaaccctgtatttggggaagcttatccttcaccatcaactttgggggtaggggtcagagggaacaagggtggaaaggccgcgctgaatggggccgaagctccgcccctcagcgataagtccagattcctgcggccgacgtggtcctccgagggagcagcagagccgccgaggctggcgagtcccaggggaaggatgttctagccggagtctactcgatggtagggcaggaagccgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactggtgagtggccgggtcagtgggtgacgtgccccgccaagcttccagccggcccccgtcgccccttaccttccgaggccgtcgggaggacaagagcgcggtcatgccgcgtgaacctcctcccgctgcctcccgcaggaggcgtgtttccaagagaggaggagggttgaggcgggcccctggtgtgtgcaggctttcattcattcatgctttagttggttcttcctgcagcagcagagggcgggggaggtgtcatctgataaatgacaaattacctacaccctaaggagtttacagctctgttggagaagctagacacccaccccgattattgtaatgcagattaggttgcttggtgtcttgtaaacgggatttacaaagatttagggttaaatgtttttgtttgggatgggtggcgggtggttgatgaagagatgaattggtttggatctaaaggatccctgggctttgcctagggaggagatggttgcagcaaagacaaaaagaaaatgggaatcccgcagggcgcggtggctcacgcctgtaatcccagcactttgggaggcaggaggatcacaaggtgaggagttcgagatcaggctggctaatatggtgaaaccaaaaatacaaaaattagccgggcgtggtggctctcgcctgtagtcccagctactcgggaggctgaggcaggagaatcacttgaacctgggaggcggaggttgcagtgagccgaggtcatgccacagcactccagcctgggcaacagagcgagactccatccctccccccaaaaaaagaaaatgggaatccctaagcagttcttggttggattggagtataataatcgtttaaatttattgagcacataaaagaagatagtgatgaaatcaaaagaagtctgggaccagattttgaggtccctgaatgctaagatgaaaggagattggatttgtttttgttttgttttatttatttttattttgatatagggtcttgctctgtcacccaggctacagtgtagtagcgtaattacggctcactgcagtctcaacctcccaggctcaagtgaacctcctgcctcggcctccagagtagctgggactacagaccccaccacatccggctaattttttgtagaggtggggtctcactttgttgcccaggctggtctccaactcttggactcaaccaatcctctcacctcgcctcccaaagtgctgggatttcaggcgtaggtaagccactgtgtctagccaggagtttggatttgttctgagccattataaaaattttaaaaattactgttattatttttgaataggtaatagattcacgtggttcagaattcaaaaggaaaaaggaataattattttgtaccttgataatatttcagaggcaatgggcttatttgagaagcaaaaatgaagtgggcctaaactttactattaatagggggctgggctttgtgtgtttttttttttaattgttgctatttgctgttttattttaaaggtctctttttcagtcatgcaggagtcagtcgaagtgtggccataataactgcttttctcatgaagactgaccaacttccctttgaaaaagcctatgaaaagctccagattctcaaaccagaggctaagtgggttctttttttatagtaataattatgcttttgtgatataattttaagaaaatgaaactttatatttctttatcattacaggatgaatgaggggtttgagtggcaactgaaattataccaggcaatgggatacgaagtggatacctctagtgcaatttataagcaatatcgtttacaaaaggttacagagaagtatccaggtaagtaataattgctagtgtgtaatgggctttctagatgacatttactttagcattgtatgctttaccttacttccagcaatccctgagaaactattgtttctttttgaaactgatttagccagaaataacctattcaaaatcacatggtttataaatggcagggtcaggatttgaattcaggcagcccgtgcccagaacctaagcacttaaatcactgtcctctcctaccttagcctgatttctcaacactggaatttgatttttttttttttttaatttttgaggttagcacttgttgcctcaatttgacattaactgaatttatctgaaaatgcagagttgattttgacaaataaatacattttaattatgtcatatagaattgcagaatttacctcaagaactctttgctgttgacccaactaccgtttcacaaggattgaaagatgaggttctctacaagtgtagaaagtgcaggtaaactattttatatcctttggatattttatcttgtctcagtagctgaaaagtacttaatgttttattttcttaaatttctgtaggaagattttgtttaattgaaatttttagttcagatctgttttcagaaagaatataaattcttaaaaagagaaataatcagattgtaagggttattgaaaatttaagtagtgtaatcaatgttacattattttgttctctaagcaatattgcacattttgctgggcgcagtggctcacgcctgtaaccccagcactttgggaggccgaggcaggcagatcacctgagattgggaatttgagaccagcctggccaacatggtgaaaccccgtctctattaaaaatacaaaaattagttgggcatggtggctggtgcctgtaatcccagctactcaggaggctgaggcaggagaattggttgaacccaggaggcggaggttgcagtgagccatgatcacgccactgcactctagcatgggcgacagagtgagactctgtctcaaaaaaaaaaaaagaaataccgcacatttcatccatgttttcatccttttggaagtcattaatgcttttgtttgtttgggggttgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacaggtgagaacacattttattttctacaattttattttatgatctatattttattccttcttgcattttaagctctattttaactagtgttttgctccatttcttaatttctttatttctgaagattatatctttctagtgtagataagactatcaaaaataaaatatttttcaaaaaccagctgatccaacatagtgaactacttctggttgagagccctggtctaagttaataaatttcctttaaggctatttatatttttttcaaatataagactaacatttatttttaaactaattagaatatattggctgggcactcttgcctcattagctcatgcctgtaatctgagcactttgggaggctgaggcgggaggatcacttgagcccagggtttcgagaccagcttgggcaatatagtgagacctcatctctataaaagaaagtaaaaaatttttaataagaaaaaaagaaaagaaaaaatgtattaaacaaaatttgaactttgtaacaagatagggtaaatcagggattttaaaattaggttaaaaattctgtctttctttttctctgttggcttcctgtatgtgtctttctcttttttcttatcttttaggagagtgaaatttagtttgttttgctatgagattctttttcatttccagttaaataatgcagctcatcctattgctcctgtaaccagtgggtagggaaataaaaaaagaatgcagttcatgtgacattttacataaaaaagtgtttaacttggttggagtgtgccatgacagccacatttctcctttaggtttacttgatattaatgtgaaggtattctataataatcatcttaataatgattttgaaagtttgtatggtttgtataaaagtttgtatagtggctagtttatgaaaccctttcactgtattataccatttgaagaatgccatagctttataaaataggtagagcagttatattcacgtgttgtgcatgaggaaactgtttatgagtagtgtcttgcctagaaagtggtaccatataatcaaactcacattttcggataatgctgctttttttaaaaaaaacagccttattatagtataattcacataacatgcaatttacctatttaaggtgtatagttcagtggcttttaaagtgtattcacagtggtttttgcaaccatcgtgtattagtctattttcacactgccataaagatagtacgtgagactgggtaatttataaaggaaggaggtttaattgactcatggttctgcatggttggggaggcctcaggaaacttattatcatggcagaagggaaagcaggccacttcttcacaaggcggcaggagagagaagcatatgtgaaggaggaactgtcaaacacttataaaaccatcagatcttatgagtgctcattcactatcacgagaacagcatgggggtatctgcctccatgatccaatcacctctcttcttccacacttggggattacaatttgagatgagatttggatggggacacagaaccaaaccgtatcacatcacaattcacattcccactcttcccattctttttttttgagacggagtttcactcttgttgcccaggctggagtacaatggcacaatcttggctcaccacaacctctgcctcccgggttcaagtgattctcctgcttcagcctcctgagtagctgggattacagggatgcgccaccacgcctggctaattttgtatttttagtagagacggggtttttccatgttggtcaggctggtctcgaactcctgacctcaggtaatccacctgcctcagcctcccaaagtgctgggattacaggcgtgagccaccatgcccagctgcaattcccattcttgatggtattatttgtagcagttagagattttaattttgatggtatctaatttatcagtttttcttttttgtggcttgtgattctggctttctaattttacttaacctgggaaacacacacacacactccagccaagttaaatacatttttatgtaagattctaaatcctgtgcatacttatttgtatacatatttgatttttttctgtagaatatgtacctagaagtggaattcctggctcgaagaatgtattttaaatattagtgatattccaggctgatattcaaaatgcccatacaaatttggttttcagtaactgaatgcatgtacccgttactccatatccttgacataatagatactataaaactggtaacattttgtcagtctgtggggtaaaaaatgttaatcctaaaatgtttaattggaattttatgaaaatagtcatcaaccaccatctttatatatttaccagccatttactgttttcttttctataaattgctttcatattcctaggcccatttgcctatgggttttgtctctttcttactcatttgtaggacctctatatattctagatgttaatagttcatctaatatattgcaactattttcttcagtctattgcttatcagattttttatgttttgtcatattaaaatgaaggatatttacataataaaatttgttagtttttttatttatggcttctgaatttcttttttttgagacggagtcttgctctgttgcccaggctggagtgcagtggtgtgatcttggctcactgcaacctccgccttctgggttcaaatattctcctgcttcagcctcccaggtagctgtgattacaggcatccgccaccatgcccaactaatttttgtgtttttagtagagacggggtttcaccatgttgaccaggctggtctcaaactcctgacctcaggtgatctgcccgccttggcctcccaaagtgctgggaattacaggtatgagccaccacactcagcctgcttctgagttttatgtctagttttctatagctcaagattaaaaataaaaactcttaccttataccatgcataaatcaaagagctaaacataaaaattaatgctataactaactacattagaagaaaatgcagttgccttattaggcttttttgatttacctattttcctggaatatcagtttgtctttaaatagctaagaatctgacttatatgctgtcaatacacacagttagtaatacagcatgaaaatcctaacatgcttttctatactttagccgtgatcattttcatttgaagtcctaaattacaaactgatttaaaagctatatatatatatatatatatatatatatatatatatgccacatccatgaaaccttccttaatcaaatctcaagcttcacttttctcccttcaagctccctgaatacaacattcttcctatgagataattgtagtctactatctattacagtaaatttccaatgcattttatctcactgattagattataaactcaacgtggggatcgtgtcttgtttttatatcctatattgattgccaaagataatgatttgttttgtataaaagtgaatgaataaagtaacacatttgctttatttcagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagatactgtctgtgtttcatatatttttaaaagttttgattgttggaatgttatatgatcttaaggtctgtatagacaaaattatgtacaaaaatttgaaactattatatttaaatgggtattcttttatttccagacacataaagcagatttgtttggacatattttggaattatttcactttctttcttttaagggacattagtaaacccatacatgtctggatttttttcttggaaatggaaaggccattagtaaaacgctgattaaaaggcaattttcctattactgttcagtaatcccaattatctatatttttagaaaagtgtttgagatcccttttgaagtgatctacataaagaaatacataaatgttagatgtgtttctaatgatgaagaaaacaaatgtagagttactatatatcaagtcattttgtagcccaatatgtgagtattggaaaaggtaatacgtccagattagttttttaacctgatgtatagaaactagaattattttactcattattaataattacaattggacctaattagatatttgaacatttacaagaatcagaattaactaataaaggccaggtgcagtggcttatgcctatgatcccagcactttgggaggccaaggcaggcagatcatttaaggtcaggagttcaagaccagcctggccaacatggtgaaaccctgtctctactaaaaataaaaaaatcagccaggcatggtggcacacgcctgtagtcccagctgcttgggaggctactccaaaaaagaacaagaattaataaagaaaaatattctttatttttgttgtaaattaagttgtaaattcactagtcatgctccccaccatttgcagggttccaacaatagtacacattgaggcttatatacataaacaccgtagtgggagtaatttttaaatgcaaaaatatgttgtgaataatgatcctcttaataaatgcctagctcagttttttaaaggtataggagtgttatggaaaattcttgagaaaaatcttaacattggacctgaagactttggcagtttccatgtaataatttttctttctattttttttttttttttttgagatggagttttgttgttgcccaggctggagtgcaatggcatgatctcggttcactgcaacctccactgcccaggttcaagcgattctcctgcctcagcctcccaagtagccaccacatctcgctaattttgcatttttagtagagatggggtttccatatgttggccaggctggtctcaaactcctgacctcaagtgatccacccacttcggcctcccaaagtgctgggactacaggcgtgagccaccgctctctgccataattttttcttttgagaaaaaattactccatttgttttagctttcataaaatctacttttttgcttcatactattattctctattcatatattattctctagaaagttttaacaaacaggttgaggagctcaggtgtggtggctcatgcctgtcccagcactttggaagacaaaggagggtggatcatttgaggccaggagttcaagaccagcctggccaatatgtgaaaaccccgtctctatttaaaaaaataataacagtttgcggcacatgaagttaccccttttgtaggtaaaaagtagttacatagctgcagtttaatatgactcaatgcctatccatcatacactgttgatcagattataaaatcaaatagtatggatcaaatgcaatgttaattaagttgtaaattcactagtcatgctccccaccatttgcagggttccaacaatagtacacatcgaggcctatatactatttgtcttaactttgtttttgtttttgtttttgttttttttgagacggaatcttgctctgtcgcccaggctggagtgcagtggcgcaatctcgactcactgcaagctccgcctcccgggttcacgccattctcctgcctctgcctcctgagtagctgggacta

SEQ ID NO: 17173 - DNA, 29637 bp, Human
gcaagctgagggagctggctccggccttggccagcccagaaaggggctcccacagtgcagcggtgggctgaagagctcctcaagtgccaccaaagtgggggcccaggcagaggaggcgccgagagcgagcgagggctgagtactgccagcatgctgtcacctctcagaagctttgttttttgcaataaatcttgctgctgctcactgcctttatgagctgtaacactcaccgcgaaggtctgcagcttcactcctaaagccaccgagactatgaacccaccaggaggaatggacaccttaacagctgtaacactcactgcgatggtctagtagcttcactcctgagccagtgagaccatgaacccaccagaaggaagaaactcggaacacatccgaacatgatgaaggaacaaactctggactttaagaactgtaacactcagcacgagggtctgcggtttcagtcttaaagtcagtgagaccaagaaccctattccagacacagctctgacatagagtggcaacactggtagcgtgcacaggagcagaggcagcagcaaagtgagaggaggccctccacttatgctgggcgccctagtagcagcagcaacacagcagcggtgccactggtggcctggcagagtggaatttggttgattcagcccagcaccatcaggctgtgactttagcagactgtaggtagtggtggcagtgggtccaagctgcatttacagcccccaggacaaggagacctgaagcggaaacaatgcaggagtagaacagcaaatgtcctaggtcagtagtgtatggaatctggaaccagatagccttgttcaaatcttgcatctgccgtttgctagcgttttgaagctttgagtaaattactaacctctctgggtctgttttctcctcagtaaataatatccagctcatagagaggtttagaaaattaaatgaaaaagcacagctctaaggaggtgattgacaatagtaagcatatgatttatttcctcatctttatgacatctcactctggtccagaccaagattacttaatattcagattaatttcatgaactgctatattactccagcaactcaaatccaaaatagatgaaaaggaaactaaagaaaactggacagccattgctgcacctattgtatagttacaaatgctgactacataccaaaacactgtttaggtgacttataattctggaatgtcacatacgaatttaagaattgctggccaggcgcagtggctcacacctgtaatcccagcactttgagagacccaggcgggtggatcacctgaggtcaggagtttgagattagtctggccaacatggtgaaacccccgtctccagtaaaaatacaaaaattagccgggcgtagtggtgcgcgcctgtagtcccagctgcttaggaggctgaggcgggagaatcgcttgaacccgggaggcggaggttgcggtgaacagagatggtgccactgaactctggcctgggcgacagagcaagacttcgtctcaaaaataataatttaagaattgtcattacttaaccatgggagagggtgtgggcagacaggggacaaagattttccactgtgtattttcatggtttttcctttgaacaatgtcctctcttccaacaaaattttttgcttttaagtgccacataaaggcagctcatgttccttacatcgccgttatcaagaggatcgtcattcaaataaagtaaccactgacaatgctaattaattggaagtaaagaactgggcggaaagaacggctaaccgcaagctgccgggtcgcaactgcggcggaaggcggactctcgcgggagccacaaagaggcagcagccggccacgtgacttcccggtggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggtgaggctgggggagtgtgcggaggggatggccaggaaggagatgccagtgatggcaagtttgaagttggaggcggtggccgctccgggtcctggggtccgcgtccaccccgctggcctctctccgccctctccccaagcctaggctcgtagcagcaggggtccccgcgggcgctggagaccccgctgcggcctgccccttgcacgcggagcgcggggccgtgcccgggcgaccttgcttcgtggccggccgagggctgggcttgctcctcttgccctggaccctcgcctgcaggagcggccagaactggagggtcctcggctgcaggaggaggcgctggacacggctgcgctccgagcgcgccgcagccgggctgtttcttttggccacctccggctccgctccacccccagcccctcgcgctcagggctgacgtgtctttagcttccacgccgggagtccgtcttcattcatttgccaaaacccttgttttctacacatctaagccatcagagtgtcttgttcaatggtcatctgccttgttcacgccctgcttgacccgtatgtgttactaggaggcttgatttcagaaaaactaccccatcgtcacccccgttatccgcccctgctgccaagcagactgaagaatccctgtgggatgtctcccttctgccttcttcctcttcttgtctttccatggaacaattttttgtttgtggaaacatcgtattgtgctgaaaaaatgtggcctacttcgagtgtttttaatacatagatttattctttcaacaattaacccagcaattaagtgtgaaaataacttagcagaatataaaaatatggcaacttgacttcctgcacaggttttgtcgtgaacttcgactttctaatttgtaaagtgaaataattagtctgactaagcatccctttcattctgtaagtttaagcaagctgtgtgtcttaacggtagtgacaggtattcacgagttgttttgcgatgaaaagtgaagtgactggcttctgtttaatggctagaaaaccaagtgggagaattaaacaactgttaatgagttaatctgcaggtttaacaagattttttactttaggagtcgtttgctggtactctttaagctttttaaaagaaaacttgacaaatgtagttttagttttagaactatttataactattttcaagttataaaaactttcaagaagcatgaattcattatctaaactgaattaatatcttgtaaacattttttgtgagaaacggtttttgtgtttggtttttccagttgaatgaagactgttagacttcatggggacaaaattgttattggttaacattaaaataataaaattgtttaatatttatgaaaggcctttatattccaaagtgctcaaatttaaccacgactttaaattactatatcagacatggtatttttcttactggtttttgaaaaggacttgtaagttatgaatgcactattttaggctttgttcagcaggcagtgaaatctctttagttcataatgcatggttcagtgttctttaatattttgcaataaatcttagcagccagtgagaacttaaagacatggaaaagactgcaaatgcatggtccttaactgtttctcctgggtgaaaacacgcttcccttcccatgttttttatccacagaattgccacatcatcattttttctgagagatgttggaagacactagaactttgaaattctttttatggtcttgcctgaaatagatataatgtgacttacttagagtactattgtctataaaactgtgattcaccttttttttgcattatacctgtactttgtaacactaagtttgagaaaaaatatcttaaaacatgtttgaagccacatgcaaaaataattggattctttctttgctatcaaacctgaagctaccaatacagtttttactaaacaatgtttttcatgcaagccagtttttaccatggatatgattacagatatttgttccttggcttacaaactatccagttctaagagtttcagctgtagtcacctctgataacagtgtttcctacatagaacattagaacttaagaatgctttatttttttatttttatttttttgagacggtgtcttgctgtgtcgcccaggctggagtgcagtggtacaatcttggctcactgcaacttctgcctcctgggttcaagcgattctcctgcctcagcctctggagtagctggaaccacaggtgtgtgccaccacacccagctaatttttgcattttcagtagaggcggggtttctctgtattggccaggctggtcttgaactcctggcctcaagtaattcaccctcctcagccttctaaagtgctgggattacaggcgtgagccaccgcgccggccaagaatgctgttttcttttaaacgtgggggttgtttagtttgctttgtatggttaatgacagggattacatttagaagtttcttatctttgcaaaaaattattttccttaatttgcttaacaaagttgcttgaagttctttgtgcttcaaggcatctttagtttgtgccattcatttttccatctgttgggcactttttgaagttaaaccacatttcccattaaaaataacatggaaggcagggaacagtggttcacgcctctagtcctagctacccaggaagctgaggtggaaggatcacttgggcccaggagtttgaggctgcagtgagctatgactgcacaactgtactcccaacctaggcatcagagcaagaccctgactcttaaaaaaaaaaaaaaaaaattgatatgcagttgttaagactactagtaaactaaaatataaatattcttcggtgcattgtaattggcatcattcaggtgaactgggagattctgttagtccaagggaagttttttttgcctatacctgatgttaaaaaaagaaattagtatttcagagtaaagggtaactgctttttctgtattttatcattaggcttgttagcagtggcacaagatcttacagaggatgaagaaacagtagaagattccataattgaggatgaagatgatgaagccgaggtagaagaagatgaacccacagatttggttagtgttacatactatttaatatatgtaaaatgtatgtaattgtattcatctgttctcatgctgctaataaagacatacccaagactgggtaatttataaaggaaaaaggtttcattgacccacagttcagcatgactggggaggcctcaggaaacttaccatcatggcagaaattgaagcaaacatgtccttcttcacaaggtgacagcaaggagaagtgcagagcaaagggtggggaaagccccttataaaaaccatcagatcttgtgagaactcactttcacgagaacagcatggaggtaaccgtccccgtgattcatttacctcccaccaggttcctcccacgatgtgcagattatgggaactacacttcaagatgagatttggttggggacacagcaaaaccgttatcaatagtacatctagaatttatccttacttatttatttttagagacagagacttgctctgttccccaggctggagtgcagtggcacgagcatagctcactgcagcctcgaactcctgggctcaagtgatcctcttgcctcagcctcctgagtagctaggactaccgtcatgccccaacaagcccggctaatttttgtaatttttttttgtagagacagggtcttgctatgttgcccaggctagtctaaaacttctgggctcaagtgatgatcctcatgcctcggactctgaaggcactgggattatgggcatgagccaccacacctggcctagagcttatccttatacaaaaatttaaaatcccaacttttagaggtttgttaatgtgatcaaagtgaattgaagttgggagaataggcaccagtcattgagaacagagcataagtattttctggaacagggaaggagacatgaaatagttaacaattcaggatcgtggtgacatgagtctagaagggtaacaacatagtagaaatagcactggacctcatggtttcatagatttggaatacctgctgcttccttttctgacttatctctgtgggtctcagtttctttttcgcttgcttgcttttactctgtttttattctttttgcttgcttgttgtatttctgaatccttatgtgccaggcactgttcttggtgctgggtgggcaaaccagatattttctctgctctttcagacttttttttggggcagttatatgtgttttaatggcagggggtgagaagcagacaacaaacagtatgtaaaatatatctggtgaagaataagggggttagagaagatctcttaaaagttgttcagctctgaaatgtttactatgtaatacaacagtaagaatattgggctggaattgggatcattgcagcatgcatctagttaattttatttcctctctggaacgactataatccatcctacacagctttttttctttctattttcgtgtcatacttgaacctggaacctctcatgattccagattttgtcatttccttcaaaattaaaccactagttccctattttcttatttcagtatcaaaatatttattcttatatatagatttctgcttcttttttgacttactttcatttttatggaatatgtcttccaactaagcaaatctgttgctattttattggtgtttttgagttatcatttttatgcttctgcacctactgttttatctggataggatgtccctagtaatttgtgaactctcctaatttccccctctttaggaactccttactgattatctgtgagtcaagcctttcatatgtatgtatacacatacctttagggtttatgttaagactccacgtcttcaacccagcctgcattaagtgaatagctttaactagattaatacatttctgctgcattgttgttaataaatatttgactagttgtggtaagataacttagagtgatggttggaagggaatccatctaggaatttaggattaaagatggtatttggggcactgaaatttgggcatgtactgaaatttattgatgaattatatcgttgttaccaattatatgaaattacttgtgctctctggcactagaatgtacttattgtggaggaagagggtagaagagagatgctgaacgccatgaggcacgcctgtaatcccagcactttgggaggccaggacaggaggatcacttgagtccaggagtttgagaccgcctggccaaaatagtgtgacaccatctctactaaaaaaattagctgagtctggtggcttgcgcctgtaatcctaactgttgaggcaggaggatcacttgagcccagaagttcagtgttacagtgagctatgagtgtgtcactgcactccagcctgggtgatagagtcagaccctgtctctaaaaaaaattaaataaataagtagagggtagggagtagagaagggaactgttagatccttgatagccttgtgtcgttgaccagaacttttccatatcttaatttctcctgtcttgagaaccattagaggaaaaagaacaactctgattatccactttctaccctggccaattagtacagaagtgttagtaccctctgctttgttacttatctcaaatcagaaaataattaaggtagattgaaatagaaaggcaggaaaagtattaccttccattgtactagaccacaccagcaggggtaggcttgtgtgtagactgtctaagaaagatgggccctcaaaggcaaggctgctacagaagtcacctccagaactgaatgagctagaaagttcacctactgctgctgttcccaagatttatcaccctatactcagctgccaaggcatcaagggattgggagatatggaaggatcctttgccactgggccagtgtcctggagtcaagtgaaggaaaagggggtttttcataagatctaagatatcaacagctggtttagacacaggttattggtttagaacttttgaggacaaaccttttttttttttttttaagtcaccttgggctttcccccacccccccaccacccagacagagtctcgctctgtcgcccaggctggagtgcagtggcgtggatctccgctcactgcaagctccacctcccgggttcacgccagtctcctgcctcagtctcccgagtagctgggattataggcgcccgccaccacacccggctaattttttgtatttttagtagagacggggtttcaccatgttagccaggatggtctcgatctcctgacctcgtgatccgcccgcctcggcctcccgaagtgctgggattacaggcatgagccactgcacctggcctagtcaccttgggcttttctaacccattgattattcttttactctataaaactgggtcgcaatggaacttgccatcattcctgaaaggtttttttgtcctccccatagaaatgagagaggtttttgttttaatttttattaaaacaagagctgtagtagtaataacactaactaacttaaaaaaaattatttagccaggtgcagtggctcacgcctgtactcccagcactttgggaggctgaggcgggtggatcacgaggtcaggagatcaagaccatcctggctaacatggtgaaaccctgtctctactaaaaatacaaaaaaatctgccgggtgtggtggtgggcacctgtagtcccagctgcttgggaggctgaggcaggagaatggcgtgaacctgggaggcagagcttacagtgagctgagatcgtgcctgggcactatactccactacactccagcctgggcaacagagcgagactccgtctcaaaaaaaaaatagttatttaaaatagatgatatattcaaatggctcagaacttacaaggtacagaatatatgatgaaaagtttcccttgtgtgccttccagccatgaagtcatctccctgtaggcaagcagtaccaccagtttctatactctcctctggagattgtttgcaatagctgaaatattctggagttttaccgggtagcagatactaagcgttatacatcttacatgctgaatagctgtaagataaatgagttacttagttttccacaatcagtgttccaaacatttgccatgtttaaatccctaaatgagttttcagtcttggcagcaacattgccttcagtgtcagaaagtgaagaaggccatcaagcatgaactctatcagattttgtattttctacttccaaatatattattcacccatcgttctgcattttcttcttaataatgagttgtccttgttctcttctaaggctaacccttccacctgtgttcatctcttcctgcggaattttgttacattattctttccttttgtaacgtcaggcattaatcctcctcagtgatttgattctgttaagccacacatctgcttatactgttcatccacatttgctgcacctacttatctttaccaagaccggtggcttcttgaaagagaaacagggacagcttttctcttctgctcacttcacatttattctctatcatggtctggtcccatatatctagtaaaactagtattgctaaggtcaccagcaacctaattgcctaattccttgttttccgttgttatcctgttgtagctcttttccagctcttcacaggatagtttcatctgaatgctccataagtacttcacattttatatgtccaaatcttttgccatgtgtcctactccataaactctttattgttttgatatggctccagtgattcaagctgttgtcttgttacttcttccgtttgtttttattccaaaacccattaatcagatatcagggatttctcttgctgaaatataccctgttcctgtctatccctgtcatttatggtttcagcctctctgtctctgttctcttttcctacttatgggtctcttttctcagaatagaaacttactcttactaaatgaatgaaatcattaaggatacttaaaatataacttacaacacagtttcacagtcattgaacaagtgtgtttgagtgcactctctcttaagtgcatgagctggatggtggaggattttaaaattatgagataatctttgctcttgacaagttttatctattggaggaaggagtattttatgtaagtgaaaagttaaatgccaataaacaatggcatcctgaagcatctcaatttattaagagtctggatacttcaaaggtgtgactgtctctaatccatattgatgcctggagaaatgatgctgcactgtgtttaaagttttaaataaaatttgttcacattttaaaaaaatttgttgagatacagtttatgtatcataaaattcatctgttttaaacatacacttagtaaatttaccaagttctgcaacataaattcagttttaggacgtttctatcaacccaggaagatctctggtcacactcttttttttttccttcaaaattatgtgactgatcctcacaggaaaattttgttaattagaatggaaatctctgtaggctgttaacaaggtacttgagagcagaggtgggcataatgtggttgcaagccacatctagcgatccccattcatttacgtattgtctgaggctgctttcacacagtagccccagagttgagttgaatagttgcaagagaggctttatggtctgcaaggccatatctgctatttggccatttacagaaaaagtttaccaagctctgttctagaaccttggagttcacaatatggtctgaataccagcagctttggcattttctgggtgcttgttagaaagagaatgataggctttgccctagacctgaattagatctgcaacatccccaaagaattggtaggcacattactgttcaagaggcactgctccaaaagttctgttttaattaatgaggtatgatgaaattcttattgctaatcccagcaaagctgtagagaagcaatatttcttcctaacataaagtgaagtctttatttcttttttttgagtcggagtcttgcattggggcattctcagctcatacaacctctacctcccggattcaagcgattctcctgccttagccttccgagtagctgggattacaggcatgtgccaccacacctggctaatttttgtatttttagtagagaacggggtttcgccatgttggccaggctggtctcgagctcctgacttcaggtgatctgcctgcctcggccaagtgctgagattataagtgtgagccaccgtgcccggccaaatctttatttttaaataatgatttttttttctcccatagtaatctcctcttaattgttctttttcttaggtagaagataaagaggaagaagatgtgtctggtgaacctgaagcttcaccgagtgcagatacaactatactgtttgtaaaaggagaaggtaatacagaagtattagttttaattcagatgtaggcattttaaaacgatgagcttgttcatatatatctgaatacccatatctgtaaagtaatattgttggcatttaaagggaatacgtaggtgatatagacacaataaaaaataaaccaaggggaaaaaataaaataaatactacctagtttaactagaaattgactgtccttttcaaagattttgtttttgagacagggtctggctctgtcacccaggctggagagcagtggccccctctcgactcactgcaaccttcacctcccaggtttaatcgattttcctgcctcagcctcctgagaaagatgatgttttaaaacttctttaaactgccacagcaaagtaactttgtcttttttttttttttttttttttttttaagatgtagtctcgctctgtcacccaggctggagtgcagtggtatgatctcggctcactgcaacctccgaggcctcccggtttcaagcgattctcctgcctcagcctccctagtggctgggattacaggcacgtgccaccacgcctggctaattttttgtatttttaatagacagggtttcaccatgttggtcgggctggtctcgaactcctgacctcgtgatctgtccgtctcggtcttccaaagtgctggaattacaggcatgagccaccgcgtctggccctttgtcacattttgagtgttaaccattaatgagatacttaatttttccaatatggtctaggttagagcctaggattttttgtttgtttgttttttgagatggagtcttgctctgttgccaggctgcagtgcagtggtgtgatctcggctcactgcaacctctgcctcccaggttcaagtgattctcctgactcagcctcctgagtagccaagactacaggcacgctccatcacgcccagctaatttttgtatttttagtagggatggggtttcaccatgttggccaggatggtctcaatctccacctcatgatccgcccgcctctgcctcctgaagtactgggattacaggtgtgagccaccacacccggccagtgcctaggttttattaaaagaaaataattatggctgataatttattgagggctatattctcaatacttggcatgtattatttagttctgacaaacccactgagcgtagtcattgtcgaactgaagtttggagaagaaactggtcagggctcccagttcataaatagattggagaacacaggatccagacctagatctgttggccccatagcctgtgctgtactcagtgaaactcagctttgtagactactgtataattattgaagacttaatattgaaagttatgaattttcttggtcttcttacattttctgttttattctcatgtgcttttgaactttatgcctgtaggaagtataattttattatgctttttttcttccatttttgtagctacatccttgggtcttaaccttcaaatttgcattttgattaattgcttaacgtggattgggattgcctgattaatttttacgttctaacagatgctagttttcagatgaaactcttggactttatcttttcttcattcttctatttacctgcacagataacactaagctggaggtgaaggtgacttcaccaacacacgtaaccctgctgcttgattatttcactgccaaaaatacgcaactcttttttaccacatgatttggatgtgatctggtctgaaattgagacgcttattgaatgcttatgtgggagtgctagcgtacagacaaaagggtttcagcctatacagcaacttgaaccaatttctcgttagtaggtgactggagtgctctattggaagggattctgacaccaaagtccacaggaaagggtgccagaatccattagtaatgcctttttaaatattttgtgctctttccatgtgttctaatttttttgtctctattttgtttctcagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacgtaagatcctctaaaccttctttttgtttaagttagagatggatgggggcggtgacgttgtttaatagaatatatctgttcattcagttgcctgttttgtggttgaacctgtgatagccaccagggaagcaaagataaattgcacgtttcttcttcaagtctaatccagtgggggaggcatatgaaaacaggcactagaacatgctgataagtgatgcatactagagataaggggaataaggtgctattgtgtgggagtggaagtgaaaatggagatgtaagtaaagctatgagccggatcttaatgggaaaaggagcagtaagacacacaatggagtctacagcttattcagatgttaagatctgttgctgggtacagtggctcacacctgtaatctcagcactttgggaagctgaggtgggtggatcacctgaggtcgggagttcgagaccagcctggccaacctggtgaaaccctgtctctactaaaaatacaaaaattagctgggcatggtggcagtcgcctgtaatcccagctactcgggaggctgaggcaggagaatcacttgaacctgggaggcggaggttgcagtgagctgagatcgcaccattgtactccagcctgggccacagagtgagactccatctcaaaaaaagaataaaagatctgtcaaataatttgttttgtacctccttttgttgcttgcattttgcccattttactacttctgtttgtaaatttaaagactgtctataattgttttcccatcattttatgtactcatagataaaatagaaccatatattttcaatgtagtttcagcagcaaggtttatcatttactttttgatttaggagaaccaaatgtcctaatataagctctgatgccttatgatttttaataatgtatactatatatcagtcatcaatgactgaatgagagaaccctagtagaaataggtcctctaaatgagagcacatctaaaccattcctctgtcaaaaagttttcagacgaggaaattttattttctcttggaagctaattcaaccttttcattaccctggtgttaacatgtttaccttgtgtctgagttaaatttctagtgctgcaatcaagttttcttttttctgattacttagtagagaaaaggaagtattttcatcctgtcctcaaaataataacttacagttattacttaactctatagttaagtagcttaaagaattactgattttagcttgtttttgagtagaataaaatttaatccaacaggtatatatgaagttttagttccttcttttaaattcacctgtaccactttttttttaatctgtgtattattcctgaaattatcaatagaggaatgcaaattgaaggatcttgaagtaaaacttacataattacagtttagcaataagtgacagttttgacaatgtactacctttgtgaagaatagctgtgtattgccccagtgagtctaatgcatttgaaaactgaaattgtgaactgataaaattatttcaagaccacaacataaaaatattttcatacctaaagtgaccatcccatttattatgaagaaattggtttccagcccactgtctttttttttttttttgaggtgggagtttcgctcttgttgctcaggctggagtgatctcggctcatcacaacctctgccttctgggcacaagtgattctcctgcctcagccacctgagtagctgtgattacaggcatgcgcaaccatacccggctaattttgtatttttagtagagagggggtttctccatgttggccaggctggtcttgaactcctgatctcaggtgatctgcctcggttggcctgccaaagtgctgagattacaggtgtgagccaccgcacccggcaccactgtcattttagaacatgaatttaacttttgttccgatctagttcttaaaatgacctgcttctgcagctgccgctgtactcttccttccttgttttgaaggattgcaaacaacagaaggtaaagcttgttggcgtaagaatgctgtgagctttgtttctttctgcacgttttatctcatttttattttactctctgggtcctcacaccaccacccctaccccagaagaaaattcaggggacaactttggcaaagtcggtgactttttttaaaggggtgtggatctcgctatgtttgctaggctggactcacaagtcctgggttcaagcagtcctcctgcctcagcccccgagtacctgggaccacaggcatacgccatctcacctggcccagagactttatttcatgtgagaaaataacaatgttgagtccctgccacagaatattgcagttacatatgaatttgttgagtcttctaagtgatgggaaggctatattcaatctgttagagtaactgttttaagtaatgttacatgttttacttcctttattgcatttagatttttctgattattttattttcttaaacagggcaatgtattccaagatgcagtcttcaatcaaacagttacagttattgaaagagaggatgggttagatggagaaacgtaagtgaaagttgtagtatgtagatcttgattttgctcgtaaagtaagactggaaagcttgctctgtttcagcattgttttagatgttgacgatggaatgaactgtatagatttggtgaaatccttacgatattcattcatacttcagatgattcttataactataaaagtcaaattaggaaagatagttgaaactgatggaagaatctctttaaaagttagtattggctttctgtccttcctctcatctaaattttctacctcatgcttataaactgttcaccagcctaaactaagtctcgtgcctctgaaattactattgaaaacataagttagaagattttatcttgaaaaatgtaagtgttctttctgaatgatgaatctttttttactctaaacttatatataattcacttaaggtaatttttaaattggattgtgcaaaataatgtaatattccagggagatgaaagctaatgcaattattttataaaccaagcttttgaatagagcataaattgtaattctattttcaatcatagagttttttttaattgactaattgctcttaaaggtaatttataaaacttaactacctggatttaagttgaatacaaagcattttattccttttcgccacaagttatttggaaagcttctattatgtgttataattatagttgtaattagacgtggtatttcctctgaattaaagacagttcatattttctccttttgtaccagaatctttatgtatatgttccttgctggtcttgggcttctggttattgttggccttcatcaactcctagaatctagaaaggtaattatggatgaacacctcttacagccgtgtttcaaaagttgttaagtactaagttaagcagtctagttcttcggcctcatactgtcactgtgggtttgtatacgtagaactttgttgtacctttttaaaataaaacctgaagccttagatatgtaaattgattcatttaaacttactttctttttttttctggagacagagtcttactttgtcacccaaggctggagtgtgcagtggtgtgatcttagctcattgtggcctcaacctcctgggctcaagtgatcctctcaactcagcctcccggttagctgggaccataggtgtatgccaccacaccccgctaattttaaaattttttgtagaggcagggttttgccatatgcccaggctggtctcaaactcctgaactcgagcaatctgcccaccttggcctcccaaagtgttgggattacaggtgtgagccactgcacctggcctcatttagactttcatacacacatacaattatttattgtcctttgtgccctccagagtgatatttacctttggattggtattgtagctctaaatgctagaatttttattccctaaactcagattttattgttctgtttactttactttttaatgggtatgctattttatctgcaagtaacctagcttttatattttctttaatattcttttttttttttttttttttgagacagtctggctctttcatccaggatggagtgcagtggcacaatcttgcttactgcaacctccgccttcggggctcaagtcatcctcccacctcagcttcctgagtagtcgaactacaggtgcacgccaccacacccagctaatttttgtatgttttgtagagacagggtttcgccatgttgcccaggctggtctcgaactcctgggctcaagctgtcctctcatgttggtttcccaaagtgttggaattgtaggcatgagccaccacactcagcctgcgttaatactcttaattatagaaacaatccttaattaataaacaagtcctttcattggaaaaagaactaatacattttgttctctcagtcaaaattctgtttttgtggttagagtaataaaatggtaacacctagggtctgccacgatcatggttctcactctggattcattccctaccacatccttatttccctcctcttccccattccctcactcaccctcctcctttccttccctcactcaccctcctcctttccttccctcactcaccctcctcctttccttccctccagcctacaaaaacaaaacctatactatttctctcagtgggaaaatataaacaattttatcaaatatgttaatataattcattagaccctaaacagttgctaatcattttggcgattatttattaagcctttagtcaggcagtcaaatctatattaaaattaacaatgaatgttattaataagctctttctctttaaaagagaaatactttgtgtttaaatgttaatttctaaaactcgctttgcctcattgtcataatggttggaatttttgctgtaaatttgtatattaggtataactgcatctccatttttcttctatttaaatgaaactatttttaagttatctctccatgtacttaggttctaacttacggattatataattaatactgtttcttatgtagataaactgaggtttgttggtttcttgggtttttttttaaagcaaggctaaatgagtcatttttactttctagcagttttgctgtaaatactctagggagaaagtttgaagttcttaaattgaggtggttagcttaatgagattttatggtttcgttttgttttgtctgtgccaactgtttaattgtatttagcttacgatgcagaaactgcctgcatgtaacatatcagcagttatcctgaattttgttgaatatagaaataaatttattctttgattacaatttgattcctaaagggaaataaagtcattgtataaatagatactcttatgtggtccaccagtggtacataacatgaacctttatagcaaggggaaaggtctttaaagcctgaaaataaatgtgatgaagatttattctttatcatcagtactagacatgattttctccttccctttaataaagtatttgagtagaagtatgttctaggaagactagaagagaatataacttgtttaccaagatatttaaattaagtaatttgataggtgttttaaaaattagagtaaacagctggtcatgatagtatgtgcctatagtcccagctacttgggaggctcaggcaggaggattgcttgagcccaggagttccaggcagcctgggcaacatagcaagacctcaactcttttttaaaaaatattaagtaaatggtgtaacggaactcctttaaaatatgtctttatgttcttttagcgtaagagacccatacagaaagtagaaatgggtacatcaagtcagaatgatgttgacatgagttggattcctcaggaaacattgaatcaaatcagtaagtagtcttacagacttggctgggaagtttttctcttaagtggaaattaaataccttagatttagtttaaaaaaaaaactttttcagtactatttaacattcatcttttccattacttgtgtagaatctagtatagtgattaattaagaccttaaaggtttattcagtgtgtagtcttcttatgctttaatttggaaattcttccagatctgcagcttatttatgaatgtgtgaattttctgtgttcctaatccatttcctgtctcttttctttctgttgcttcagtgcagagtagaagaggtgaggcatttaatttttttaatggtttttgctagagaattgggggctctcaaatagcacgtaaatattttacgtcaagtttaatgagtaatggaacaatttttcttactacattttattagaaaaactacccagtataacttgaaagaataaacctaaaatattacccgacaatttattttacagatacatttcagttttattacatattcagttaaaatactaacctttataaaagaatatagaaatgtttcttcaattgtaggacattttaaaaatgtttattataaaaccaatgcagcctcattataaaaaattaaatagtacagaagtgaaaaaaataagtcaattcctgacttcattaatcctatttatttatttatttatttatttatttgagatggaatcttgctctgtcgcccaggctggagtgcagtggcatggtcttggctcactgctacctccgcctcctgggttcgagtgattctcctgcctcagcttcccaagtagctgggattacaggcacgtgccaccacgcccggctaattttttttgtatttttagtagagacagggtttcaccatgttggcctggctggcttcgacctcctgacctcaagtgatccgctagcctcggcctcccaaagtcctgggattacaggcgtgagccaccacgcccggccctatttttcataaatggtattatgtttatattttccattaatttctatatatctataagcatatacgcctattgtttttatgtgagtatttagttcagattgcatcatgctgtctacaacttcagttttcataccttggatgtctctttgtagtaactacataaatatttactaaactgtttttttacaactagacaatattattttatatatatatgtatgtcatgatagattaaacctgttctgtattggaaggatattggttacttttattttttcactcctacagatgatactgtaatgaatattcttatatataaatttataggataacttcttaaaggtagagtaactaggtctaagattaaatacactgaatttttatggaagggaccccatttccctcctaaaaggggaaaaaaaggtagtgccaatttatgttctcaaccatgcacaatattgcctatttaatctgtcggtatgatataaaatgagtgtcttactgtttcatttgcatttctttaagaatgaggttcagctcctttatacatattcatagttgacccttgaaagacacaggtttgaactgcttgggtttcactttatatacagattttttcaatataattgaccctcggtatattggtgggttccacatctgcaaccaaaagcagataaaaaatacaatatttggccaggcgtggtggttcacacctgtaatcccagcactttgggaggctgaggcaggaggatcgcctgagcccaggagtttgagactagccttggcaacatagtgagaccccatctctacaaagaatgaaaaaaaaatacatgtgttgacgtgcgcctaggctgaggtgggaggattgcttgagcctggtaggtccgtgattgctccatgatggtgccactgcactccagcctgggtgacagtgagactctgtctcaaaagaaaaggtgggggtggggaggaaaggaaatcattgaggagctaagctctgaggacgcagaggcataagaatgatataatggacttttgggactcggggaagggtaggaggggggtgagggataaaagactacacatgggttatcgtatacacagcttgggtgatggatgcgccagagtctcagaagtcaccactaaagaacttacccatgtagccaaacaccatctgtccctcaaaactagtgaaataatagtaaaataaaatctattaaaaaaaaaaaaaggaaatcacagtttttgcaggataccaaacctaagtacagggaaggctttttgtatccaccggttcctcagtgctgacagcggaacttcagtatgcctggatttgggtggggttgccgtgggggagtagtcctggaactaatttcctgcagataatagagatgactgtattggctagggtttcttttcctgtgaattggctgttcaggtccttttccatttttaaattgttttctctactgctttctgtgagctagctgtctctttctgtgagctagctgtcatattgcagtatagcagttgctttatgaaaggtgggttcaaagtaacaagagcacaggaggaggtcagcactagacccgagtcttgaaaggttgggtgagaaggagtctttaaggttttatgagctatgctaacaacttttgactcctaggtcaaagagccactttaaaggagaggaattacaattgtgttttaaaaattatggtaagctgggcatggtggtgtgcacatgtagtctcagctactggaaatgttaaggcaggaggatcgcttgagcccagaagttcgaatccagcctcggccacatagcaagtctcccatctctaagagaaaaaaaagaaaagaaaggaaaaattaggatcactttgtggaggactgcaaaggagctgctggaagcagggttaccagttccgcgatttcagtaaagcacagaagtcactggggcctaagcagaggcagtggtgataggagtaaaagggagtagaaggatgtttcacaggtggagtagatggggttttttatgactggatgtgttagtgagggaggaatgaaagagcattctgaacttaggcaactgggtgaaagctgatcccattaatgtcccataatctaggaaagagaagcatggaaggatgaggagagatgtgtttggattagctatgctgagtgtgaaaaacctttgggactcccagataaggatgtccaggaaacatttgaaagttctgtttcagagcacaagtgaatcaagatttggaaacattgggacatatagcatcagtggtagctcaagtcatgggagctacacatctgtttttttttcttttgagacaggatctcactctgtcacccaggctggagtgcagttacgtgatcatggctcactgcatcctcgacctcctgggctcaatccgcccacctcagcctcccaaataactgggactacagacgcacaccaccatgcccagctgaatttttatatttgttgtagggagggggtttcaccatgttgcccaggctggtcttgaacttacgggctcaagtgatctgtctacctcagccgcccaaagtgctgggattataggtgtgagccaccatgcccagctcacatctgcatataacagtgatgctcacacagatggctgttaaatcctagagtactttttgaatcctcaaaagactatgttcagcatactgcttatttgaaaaagttttatttagagattggttgtctgtaagggcagtagttcctagtctaacctttttgaaaatctgataaaagttgtagactttcttcatcagaaacatttgtctgtactcacagctcagttttaggtaagttgaagagcccctgaaaccatctattagtaacctacttaatgaagtagtgagagcagttttctgggtttttttcacacttgaaaagtgagggcagttttcctgtgatatgtaggctctgtcttaatattttagcccttaactttttttatttttctgagacacggagtcttgctctgttgcccaggctgcagtgcagtggtgtgatctcggctcactgcaacctccggcccctcggttcaagtgattctcctgcctcagccttccaagtagctgagatcacaggcgtgtactgccacacctggctaatttttatagtttagtagagatgggatttcatcatgttggccaggctgggctggtcttgaactcctgacctcaaatgatctgcctgcctcagcctcccaaagtgctgggattacaggcatgagccactgtgcctggccttagcccttaatcttaaggagatttctttgaaaaatgtgtagtctttaaatattcttggctgggccaggtgtgatagtgtgtgcctgtaatcccagctacttgggaggctgaggcacgaaaatcgcttaaacccaggaggtggagagcggagatcgtggcactgcactccagcctgggcgacagagtgagactctgtctcaaaaaaaataaatattcttgataaacatttactcattttctaggcatggtgatctcataatttggggggtgagagatcttttgaacagattttttttttccattttatgaaatgcttacagataagccccatgctttggtgaaaatcactttctagcccttcactttttttaactggaaaaaatgatttttatttctaacttattctacagtatacaaacataccaaaaaaaaacaatacgaaatcaatgaatgcaaaatcaatcaaaatcaatacaaaaacaattatacaagtaatttctaacttattctaaaatcttcctaatatgtaaagtaccccccagaaagtaagacaagacaataatagagggaaggtacatacatccagcctttcactggttgaggaaacttataaatgacacctcttaccaaatggaagtagaaaaacccaccacaaatgtattttctgttaaatagaccctactgagaatctaacaaacatatgggagatacagcttgtgtgcatagaattgttttagcattgaaatactgatttcctttattctgctgcttattccaggtaaatttatgaaattgaaaaattatgcaaactgcatgactgcatttgtaaatacaaaatcagcagtttttaagcgtttacttatgcatgtataaacttggttaagttatagaattgaagattttgcatggtgtcttcagcagtacaataaccaagtttaaatctcttacccaccctaattgcaaaacactttcattttaattggggttacctcttgaaggattatgttaaagattgtttttaaaacctagagctagataggaggcattcattattagatggtgttcacccatgtgtgtgtgtaacttagtggtaaagttgaaggtaaatactttttaacatgtcttttgaattcaatatacttataataggcaagcttaaaactttctcttttcttccagataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatgacctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatggaagaactactgccttaaaagtgcatttgtagcacatcagcctagaactgtatcatggctgtgctggggagaagtaaatggtggtaatgtaacattgccacctttacttaatgatgtgttattttcgaggtacagtagatcaatatagtaataggcgagcctcatatatagcattcatcttgtacaatgatatccatacccttgatatgaaggaaaattgacttggtttgtgcatttgaatactgaaataattttttaaaactcagtgacacataccatctcttgccaagactagaccctgtattttagttcctaaattagatgtttaaatttaaaaacattttcagatgtacttaagtacttccatagtacttttttttttttttttttttttgccccctgagacggagtctctgtgtcacccaggctggagtgcagtggtgcgatctcggctcactgcaacttctgcctcttgggttcaagcagttctccctgtctcagcctcctgagtagcttggattacaggcgcccgtcaccgcacctgcctaatttttgcatttttagtagagacggggtttcgtcatttggccaggctggtcttgaactcctgaccacaggtgatacgcctgccttggcctcccaaagtgtgctgggattacaggcgtgagccactgtgcccggcccactgttcactttttgaatggcatcattttatagctgtagaactaaaatcaatgtttgccccaattttcttaagtaaaactctactttgagctcttacctccaacttagtaaaaagcagcttcacacacaaacaagattcttactggtggaatgttaggtttcgttgttaagttaatctgtctataagctcatccttagaggatatttgaggaggaagaacaccttgcagctgacttgcaaacatctaaataatttatttcgggtgcttatgaatgttactaatggattttgtatgaatttttatcccttttcatttatacaaaaacctgggcttttatgttaattatatcatctgaggttctaaggttttttttttagattttgaaatttagggataatagctcttaggtttgggtaccactttgctgcagtttaagaaagggggaagggaactcatttattaaacatcaatcacgtgctgtgttctgtttgttttctagtcatcatatcacacacctttacgacagctcactgaaggaaggtgatactgttcccattttgtagatggaatagacaaaacctgaatttaagtagcttgctcaaggttccatattgaatatggaaagttcaaatcatctcagtaatgaatataccatatatacttgctgtattgtatctatgataattcagttacccacaatacccttttaaatttctgttaatgacatacctttaaatgtctccttgatgaacagaatcatggtctttaaaaacattttcatgggttgattgcattttcaagctctaaaggattgaaagataaatcttcacgttaaaggtaagagtgaagtatctgctcttgggttacagaaccagatagtactagaactaagattacagggtaaagctgcttttatcttttttctttttctttttctttttttttttgacatggggtctcactgtattgcccaggctggaatgcagtggcatgatctcagctcacggcagcctctgcctcttgggctcaagcgattctcctgcttcagctttccaa

SEQ ID NO: 17174 - DNA, 19167 bp, Human
gaccctgtctctaaaaaaaaaaaaaaaaaaaaaaattagctgggcatggtgacgtgcacctgtactcccagctgctactcgggaggctaaggtgggaggatcatttgaggctgggaggttgaggctgcagtgaaccatgatcatgtcactgccttccagcctgggtaagagagcaagaccctgtctcaaagaaaaaaagaaaaaaaaaatcaccctggacaagtggattggaggaacagagccactatcaactcttccttagtctactacattaacttcctggtctcctgggttccaatcaacccatcctgggcctagtgtcagagcactgtctaaaatgatgtgagcatgtaactctcctgttgtaacttcagcagcttctcaaagctcccaaatcttccagaaggcttacagcaccctcatgatgtggccctctgcctacctttcccacctgatatgccctccaccccaccatcccaggctctggtcttttagttccttgagtgtgcggaagctgcctcctcctctctctggctccttttccttcagaattcagcttaaatgtcacctcaggaaggtcttaaccccctgctccatataaaatagatggtcccattatttcctaccactatgtcaacctgtaatttatatattagtgggtttagtccaagatgttactctaaactgcaccattttgtaagctccctgctattctgcagaccttggtcaaagtgaaacatttcacaggggtttgggctgtgagaaacatcctgcctaaccacccgaccacaaggcagacaaaggcccaactaaagaaacatccctctcatatcttcctgggcaaaggtccaagggacaccatgatgacatcccactggaacaagggccaaaccgcctcatcatgagaacatctttatatcaatatcctgctaggcagcaacccatactgcccagacccctaccgcccatacctataaattgcccagtctgtaagcagtggtgggcactggcattaggctggttccccacttctgtaggttattatgctggacataaagcctgcgtttgctgtcgagccgccctctttctgtgtgtgtgtgtgtgtgtgtgtgtgtctttctttaacccttgccttcttttcaaaacctaacacgagtagacaaacgttctttctgaagagccagattgtaaatattattgtaggctttgcaggctatagctcttctgcccttgtagtaggaaagcagccacagtcatacttaaaggaatgagcgtggctgtgtccccataaagctttctttacggacactgaaattttaatttcacataattttcatgtgctaagaaaatatacatatatattttgtgagatggtgtttcgctctcgtcaccctggctggagtgcaacggcgcgatctctgctcactgcaacctccgctacctgggttcaagcgattctccagcctcagcctcctgagtagctgcgattacaggcgcccgctaccacgcctggctaatttttgcatttttagtagagacggggtttcaccatgttggccaggctgctctcgaactcctgacctcaggtgatccgcccgcctcagcctcccaaagtgctggggctacaggcatgagccaccacgcccggccaagaaaatatagtttttttattttttccaactatttcaaaaggtaaaattcattcttagctcccaggttgtccaaaaacagacgcgcaggatggccaagcaccagagtttatcgtttgcccataataatcgggttgattcggccaaggtttccctcccccaacacggtgcgcactgggaagcgcgaggaccacgtcccttggtttaccactgcgcacctcacaaggcgcccagtgcatccgggtagcgggatgccggttggaccaacgcgagggtgggcggggtctaagagctaagcgttgggggcggggcgggacagtggggaagaggacgggtcgagtgctggcttccggcggaaaagcgcgcgagcaagatggccaccaccaagcgcgtcttgtacgtgggtgagcaggaggggttgctaggcggagtctgagtgaacgcgacccccaagggtcggggcgtggggtgggacgcatctctgaaccaggaggacggcgagctgctgtcaaggccgggtctctggcggtagtgctggcgatagctctggctgtgcttaaactccttccaaggtttcccactgtcctcaggaaaaagtgcagacttcttagcagtacgcacttctccagcttctttgctttgcttcccgattcgctgggtctcccgaaaaatgacccacttgcccccaaggttcaggttatttcacacctttgggcctctgcttttgcgactcccttgcagtgaacagccttgccacacacctcaggtgcgtgaacccgagacggaatgattattctgacttcctagcccgctgagctccagcgggccccgaggagcggtaaaggagtattatggcccttcggatcctctcgttcatttgttttacaaacattcagtgcagcgacggctcagccccagcccctgccataaaggaaggagttcccagactagccagaaaaaaagtggaattacctcagtagcacacttttgataagcgctgtagtgaggatggatcatgataatatgggcctggctgcgggacaaatgacccatccatctggagaagcgagggcaaattctggatgcggcgatgccagagctgatgagcaggagttagctacgtaaccgaagcagaggcaaggccgttcactgcaagggagtcgcaaaggtgtgaaatagcctgacacttgggggcaagtgggtcattattcgggagacccaggaaattaggaagcaaagcaaaaaagctggagaggtgggtactgctaaggagtttgcactttatcctgaggacagtgggaagcctttgaaggagtgtaagcgaaaagttacgggttcaaatttgcattttcctaagatcattctagttggctttgtggagttgatggaatggaggcagggaggtcagttgtgaagctattgcagtaatcccaggactagatgagagtctgaaagaagggcgaagagaggaatatttttcataagtatgggtgggcagagatgagagggggatgtttgtttacccaaagaactgaatggaagggtcctgtcccctggctagcatgctaactgggctgcaaggacttctgcaagagtatggagatcagtggctcagaaggcccttggcttatttgcaggtggactggcagaggaagtggacgacaaagttcttcatgctgcgttcattccttttggagacatcacagatattcagattcctctggattatgaaacaggtgagttagtgtctctcacgttcagaatcctcttactaggaaaataccttaaaaaattaaagtcacatcacaattctaaatatgcattctaaatatggttagtatacactacaggtaagttcaggaaggtgtctggtgacagtgatctcgatggagaaggaatgttctgaggccatgtggttgtgaactctgaatactttccagagtcttcagctgttgggttgagataagacagatttttcaatagaccagtagggagataggtttgaactacattgagatttgaatgttgttttaatctacctgatgggtaccccatcccacctgcaccttcttgcagctgtgctattaaatgaggcagcgggaaagcctagccccataatgggggtgggtgagggcgggggttcttggcctctgcacccctgggtgggtttcccatcgattggtatcacaaccacagttcagttttctgtttacctttgttgtcatttttaagattatagttttaggcctagttttatcatcaaccttgcatatgattgttagcaaagtctttaaactctctgggcctggggaatctttatttgcaaaatgataaggttatgttggctttctaagggccttctagtctctgagttctatgataaacattattgtgcttggtctttctagttagttcagcattttcctgaagataaagactgagcatctttatcaggttttaggattcatgctttatgcacagttgatgcgcaaaatatatatttagatagataattgataggtcaaatgactttatttttctaattgctttgcatgcaatggttaaggttttaagtttggctttcgtagaataattgaatacttatcaattaaaaatacagtttactattcagctatgtccattaaaaaaacaaagtttattattgcttaaaatattgtataagaagaatcaagaatgagattccttcttcctaaatagtgattggatagaacttctggtgtttggatacgacatgtaactgacttcactttgtgaccatcctgtttcttcccactaccccacatagtaattacttgtttttgtttttccattttgtagaaaagcaccgaggatttgcttttgttgaatttgagttggcagaggtgagagtctgtgttactagtgtctagtccttggtttgtgatgttgttactgattacaaaggaagcttttcaccatttggttaggtttttgggccttaggctgatgcttccagagagatcagaagtaagtgctgttctaaggaaagcgtctctcacataatcagactggactgtgaataacatgtcagacctgccaggccctcccattcttgccctgcagaggagctagctcatgcacccctgttcattgagcattcttgcctggaagtagtgattatttcttgtgccttcaactagatggcaaattgttgcaccaccagctctaaaatcagccaggaagtgctctttgttagaaacacacaaaacctaggcaagaaatacagaggtggcatttttctggatttttgctactgagcatgtgtttagacaccataagaagcatttggctgcaagcctaaacttgtacctttgtctttccttggcaggatgctgcagcagctatcgacaacatggtatggctgggaatcttaattctaactaaagttgctttttggtggtacagaggctccttattcatatatcagtgttctggacttccaaagttacaaggttgcatggggaggtaaaaattctcacatgaaaatattcactgtgaattgatcacttataaaattagttcttactcagactccttcgccatttcagaataatgtaagtcctcatcatccttgttgaccagtctctcactggctctcccatgtttaggataatttgcagacacagtgcaaattgattgcacggtgtaactgcatattttgcaaaatagcaggatttcatgaagtgttagaccaatttacaattgagaagagaaatttaattatggcaggtgcaaatcactgatacaaatgatttggatattctggaaaggtccttgggaaaaatgatgatgctctttagtatttgtgccttccttgagatccttttagttttcatgtctgataagaagtgcaaagataccatactgttgatagaattttgttggaaaaataatacttcagtgcctgttacttttctttctttcttttttttttttttttttttttttaacaatcttgaactcatgagttcaagacttctcagcttctcaagtagctggaattacaggctcaagccaacagggctacctgggctacctgttacatttctttctaccaagttacatttctttctaccgattagtgcatagttagtcctgaatattaatggtaagaaacttgtttttattatttttagtttcatcacagtaatttcccagtcagccttttaaaatttttcaattttaccacgaaatcttcatcaccacttcaagtggagtcaccttaaatgacctttcctggtaccgattatctttggataatgagatgttgttttatttgttgttctgttatccattcaccaaacatattcatcagctgtcagagatcatttttctttcatttcaaagcttatcttgacttttgaaggtgaactcaaatactgggaaactgcatttatttttgtaattttggagtgttctgaacccagagttacttttggtaatacaggtctttgtgtgctgctatgaaagaaaggggtgtgagttccctgaaacccacaggtggctttggggtggctgcatagcttactggtagaggcccagggattaagggaggacaaatcatgagtgtgtctcagaagtatatggaaagctggctggccctcttttaacctaagagagtttaagcagctggattttcaatcttttcagaatgaatctgagctttttggacgtacaattcgtgtcaatttggccaaaccaatgagaattaaggaaggctcttccaggccaggtgagtaggagcaacttccagattccctgtgatgttctgcagtttggccttagttgcattttttgtctctatttacttggaagtagatgctaaatgctgcttcctggtagataggagtagatgatggttcacattgggaagggcatgcaccacctttttagagaaacaagtgagtttgagcttctcagcaaagccaaagtgattgtttctgttatgagagaaattcctgcctgagctcatctttcccagttttcttgatattccattcctggggtctccatcaagggctgaaatcagcaaaggctacacctttgctttcggcatagctattttccttagccctactgagagctggacttcagggcctacattctggatgggaactttccttacccctgggagttctcagtggggaattgtctggcatacaggccacatagcatcttccactttgctgaccaaagcagctacttttcagttcaagctgacagcttgaatgaacatttgtttgattctttcctttcagtttggtcagatgatgactggttgaagaagttttctgggaagacgcttgaagagaataaagaggaagaagggtcagagcctcccaaagcagagacccaggaggtgagaatgaagctcctgcttccagagcacaggccggcgctgtccacaggagacttttttttttaagttttaatggaaatttgccaatatgtatatcaaagtggagggaatgaataatgaattcttagtactttggtaaagtcaatattgagttcttagtactttggtaaagtcaatatcgagtgaattcaagggcgaaactttgggtctcttgtccatgttgtgttctatgtgatgagtgtctcagctctgctcaggtatggatttgtgattatcaactgacagggaggaagctgaggtgcccctcttcacccctcctgatcagtccccctccttcactgaagagtttgccacaagggtcgtggtcttcctattcctgtgctaatggaggggagacagaatagggtagtgtcccttccttcaacctgtacatgggttcagggttctccagtcctacgagaacctgctggggcacttccccctgattctcagcatagtctctgacagttgcttcctgggcgtcccctcctctgagtactttgtgaatgttgtcattcttctgtatttctttcttggctcatggtttctctctcttctctcagctgaaacagtagcagtctatctctagttttatgcagcctctgttatgctgttgatcttcatggtctctttctagtcctgagcttcagatatttctgcctgcaagtctcatgggcagcttaagtttgcctaaaatggattctcccgcttctctaatcctgtcttcctgtgttctcaatcttggctaatttgccaccattcatccacacattgacccacgccagaaatttgaatgcaaatcagaactcataaagtggccatcacagtcagtggagtccccctggatcatcctgtatcctctgcttagtcttacctacttggagcacaatgcaaggcccaacatcttccactgtcttctgagcacttaggcctgagcaagagggctgcccccttgcttccatgtagttagccagtgtatatgcagggccaggcacagagggacgaggtggtacatggatgggtctgcctaactagaggacagtgggtgggctggaactggcatttgaagatactgagagttgtggatcatggaccagaaaagtgctgttctgtgactgtgaagcaagaggaggaagcagatgcatctgagggcaagcatgatgagataacacccccgtgtgtgaggctcaggttagccagtgctgagacctcctgtcgctgggcatccagctgggtgctacggccatggctcctgcctcctgcagccctatcagggcccaaggccttccccgtcagcacttgctccagcctacgcactggagttgtgttctgggtgggtgtgtagaatactcgcactcctacttagggcgtcagggagctctctctaactagcaatttcttctgcacctagggagagcccattgctaaaaaggcccgctcaaatcctcaggtgtacatggacatcaagattgggaacaagccggctggccgcatccagatgctcctgcgttctgatgtcgtgcccatgacagcaggtgagcaggacgctgtggtcagaacggcgggacgctggtggctgagcagtgagcctttcccaggttcttactgcttcacttcttgtgtccttgatattgcttctgacctaagttgatttgaggcatctcagatcctgggatctagtaacagataagtcagagcaggtgtttttgaagctttataagtgctggcttactgttttttaatcgttttttaaaaatacaagtaaataatgtattcttttttttaaagaatagcatatacatatattccaataatatttaagacaataaattgaaaattcattttcccctctctacatccagtcctcaattctagaagtaactagtgcttttattgagtattctttgtaatttattaaatattgacttctattctctttttaatctaaattttattatctagacatataaagagtcaattcagtttcacaaagcttgttttgaaaaaacagtcgtcccctggtgctgtccctgtgccctgctgccaacaccatttgctgctcctcagaggagcggatttcaactcttaggtgttttggtttttatttccatgttgataacagttttatatttctacttcctgttttccattttaaacattatcttctgattttctacttcagagaacaaagaattagttttttaaaatccccttccctgccccctcatcttccctgtataggtaccataattttggttaggtcctaagttattttaacaatgtaagcatcatgtgataacctcctttcatgcacagcattttgttttgcctggaattgataattgccttgtttttgcatagttttctgtgtaatcattcctgattttctcccagaccatcctgctgggggttttgcatccaggtgtctgcatcttgttaaggggagatgagggcaaggctgaattcctcaacattcagtatataaactttcacataatctccatttgtcattatggtacctcagccctcactatgcgtaggatgtcctagtccagagaccctctgctttaacctaccaaagactagacccccagctggctaccaggttggggaggggtggcccccagctgcagagtcagggaaaggatcccaaagattaaccactttcttaaatgggctttcagccaaacttactgtctccaggattacctgcaccctttcctctgagcttttggagtgcaaattgagttgcttcttggcttttaccagcttaagattcagctttctcgggtctgctatatcatttaggactcatctattttgttttctaacttcagaaattttgttgctgttgtctcttcctccctgctttttaagtttattttttggctattttagccactttaaagtgtttgttagcagtaattactctgttcgaaatttttgaatcatcctaaacaaaaccacttattaaaggtacctattaaataataactccccattttctcctccccttagcttctgataacctctaatctttgtgtctatgaattggcctatcctagatttttcatgtaagtggaatcatacaatagctgtccttttccacgccttgttgattttgcatagcataatgctttcaaggttcatccttgtaccatgtatcagtgcctcattcctttttgtggctgaataatattccgttgtatttggataaatatcttgttcattcatttgttgatgggcacttgcacattgttttcaccttttgactattgtaaatgcctgtgtgaatatccacatgtaagtatatgtttaaattcctgttttcaattcttttggatatatatgcctaggaatggaaatgcttagtcatatggtaactctgtatttaactttttgaggaaatgccaaactattttccacagtggctggaccattttacatttctaccagcaatgtatgagtgtttcagtttttccacatcttctctttttttttttttttttttttttttgagacagagtctcgcactgttgcccgggctggagtacagtggcgtgatattggctcactgcaacctccgcctcccaggttcaagtgattcttgtgcctcagcctcccgagtagctgggattacaggcgtctgccaccatgcccagccaattttttgtatttttagtagagacgaggtttcaccatgttggttggccaggctggtctcaaactcctgacctcatgattcgcctgcctcggcctcccatagtgctgggattacaggcgtgagccaccatgcctggcccacatcttctcttaacaggtgtgacatggcatctcattgtggtttttatttttattccctactgactaatgatgttgaacatcttttcatgtgcttgttgaccatttgtatatcttctttggagaaacatcttttcaaatctttggcttatttattaactggattgtttgttttgttttttttaagagacagggtcttgctctgactcccaggctggagtgcagtggtgagaacatggcttactgtagctttgaacccttgacctccagtgatcctcctgccttgacctcccaaagcactgggattacaccgtgcctggccattttgttgttgaattataggagttcattatatattctggatattaaacccatgttaaatatgatttgcaaataagcattctcctgttctgtgggttgctttgccctctattggtacggttctttgatgcacgtcttaaattttgataaaatctaattatttttttctttcacctctgcttttggtgtgacatttaagaaaccatcaccaaatccagagtcatgaagatttgcccctatgttttcttctaagatcctttggtttttcttttaaaaaatcagtttcctaccaatttagtgtggttttaaaagggaacagagctcgaacatgtatattcaatcccccttcaacagaatctcctatagtcctggccaggtgtggtggtttacacctgtaatcccagcactttgggaggccaaggtgggcggatcatctgaggtaggagttctagaccagcttggccaacatagtgaaaccccatctctactaaaaatacaaaattagccaggtgtatggtacatgcctgtagtcccagctactcaagaggctgaggcaggggaatgacttgaacccaagaggtggaagttgcagtgaactgagattgtgccattgcactgcagcatgggcaacaagagtgaaactccgtctcaaggaaaaagaatcccttatagtccttacaaggttagtatcacaaaggtttataatgagtatctcttattttaaaacaaaaatatgaacactaaaccaaagttttttcgaggttttttattttgtcctattttttaaccccagcgctttttcctttctcaattccagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtaggagccagttggcatgtggtgacgagggaggctgggcaagggtgggatggccaggcaggatggaaggacaggttgtagttctggctggcggacactaagagtctggaggagacccagccaccagacataggagaaccatgcagccttgctagggtggagttggcttgttgacattcaggtactgttcatcccccaaccgtgtccacaattcctattagccccgcttggattctgtggtctgctgttgcaggctcttatgctctcaaccccactgctctccctgccctcaccatcagatttactcagtaaaatctcggtggttagtcccccagcaactagagaaaaaacacagaattgtactgaacaatcccacttgaaatttataactatagttcttaaggggacccttgccaacctgaccagatttccctacttgatgctcagtcccaaccggagatgatgtgtccatgcccgtcttcacttctgaagccctcatatcatcaccttcccacctcatctaatgcttcacctcctgcatctctccactcgtgcatgctctttcttccaattacaggggatgagctgtctctcctaggccagcctctccacctgtggactggatcctgtccctctcctctacttaggaacatggcttctaaagttgtccccttcttgtaatccatttcccctgctctgctagatcagtccattagcatgaaagcatgcagttatcaacctttaaaaaaaatcttcatccggttgccgggtgcagtggcttagtcctgtaatcccagcattttgggaggcagaggcaggcggatcacctgaggtcaggagttggaggccagcctaactaacatggagaaaccccatctctactaaaaatataaaattagccgggcgtggtggcgcgtgcctgtaatcctagctgctcggaaggctgaggcaggagaatcacttgaacctgggaggcggaggttgtgatgagccaagatcgcaccattgcactccagcctgggcaacaagagcgaaactccgtctcggaaaaaaaaaaacaaacttcatccttgtactcttgttccctctccagctatcacccatgcccctggtcccccatcttttttcaagaagtaaaagcataacttcttgaaaacatggtacagacttgctgccttcgcgttttctctaatcccttctaggcagacttctagtcccatctcgccattgaaaccactcttgccaaaaatacgagtagccagttcttggcgatcatcttatcccacctcccagatgttatcccacctcccaggagcatttcatactacaggttgagtgtccctttcctgaaatgcttgggaccagaagtattttgtattttggaatatttgcattatacttaccagttgagcatcccaaatctgaatatctcaaatctgaaatgctcgagtgagcagttcctttgagtatcatatcagtgctcgtgaagtttcagattttggggcattttggattttggattttcacatttgggatgctcagcctgtactaactctgttctccttgactccttcttcacttggctggcaggactcctgcctcttcttgtctccttttacctagatggctgctttttctgtctttgctgtctccttcttttcctgacccttaaacactgaagtggctcagagcccattctttggttctccagaagcctgttaccctgtgctccgtttttctaactggtggtttgtagggcccctctttactatactgaactgacatgtgtaggtgatatagcccactgacccacatcgttattttaaaaatcagtattcatctgtaactataatagggaagaacatcagaggaaataaacgaatttgtataatactcgaatatgtttccagatgtacatgcttaagcacagctgtgtcagaacacaaagtgaattattcaggcgtctgcccctgtactcaaacgcagcagttagaaatgcagacgggagtgtcaactggataccactaggagtgatgctattggtgatacggctttgtgaaatggtagataaagttgattagagtccaaagtaaagaataatctgtttatttacatagtagttacattcctagaagattccatggaaaatcaaaagcactccaaaactttgggcttatatgtataatggaattatgttttaggtgcagataactgtaaacacattttttacctataccaatatctggcaggatatttgttgttttgttgttgtttggtttttgtttttttgagacagggtctctttctgttgctcaggctggagtgcagtggtgcaagacggctcactgcagcctcaacctctccagctcaagcagtcctgcctcagcctcccaaatagctgggattataggtgcacgccatccataatgccaggctaatttttaagttttttgtagagacagggtttcattatattgctcaggctagtctggaactcttagcttcaagtgatcctcccacttcagcctcccagagtgctgggattacaagcattagccactgcgcccagcctctagcaggatgtttgtaagggccaagaggatatgagacaattcattgtgccagacattgcagaacatctagcattccaggcccccacctgctaaatgccagtagcacccccacaatatttcagacagtcaaaaacactttcaggccaggcacggcggctcatgcctgtaatcccaacactttgggagtctgaagtggcagcccaaagccagaggatcacgtgagttcaggagttcgagaccagcctgggcaacatagtgagaccctatatctactgaaaaaagaataaaaaaattatccaggtgtggtggtgcacgcctgtagtctcagccgcttgggagttgaggtgagaggattgcttgtgccccagagattgaggctacagtgagctgtgatgcactcctgtactcagcctgggtgacagagtgatccccatctcaaaaaaagtaaattcagatttccaaaggtttcctagggacaggacaccaaccccactgagaagcagtgccctaagcagtcacacccggtcccagggctttcagcggtatctctgagttaagtttgtgcagactggcatctgcatgctgatggctccctgagctccagactcctgtccaactgcctgcctgttgtcttcactggatatcccacgagcatctcacactttacatgtctaaaacagctcttggccttctcccctaaactcttcctcctcctcttccctgtttcaataaatgactccaccatccacttagccgcttgatcagaaacttaggagtcattgtggacacacacacacatacatacatgtacacatacacacacagacacacacatatacatgtacattctcttacgtgacaaatgtccatgttaccaggcctcactgtgtcatagctgtcattttgaatggctcttttccactgattgtgagctccaccagagcttggactatgttctgctcatcagtgttcccagggcttaacagggacctggttgtcaagtagacacttaattgttaaataaatgaattaatgaaagaacagaccagtataaagtgattgaaacacctcacttaccatttcactgactattaactgaatccaagataaggtggccgcatttgcatgtgatctgtgcatccccgagtctgagcctgactggctgaagggctgtcaacagcctgcacagacgtcctttaagggctggtagccagggttcggggagctgatggttgttctctccctcaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggtatgtggccaggaatgggcctcctccttacccaggccctaggagcacagccctgtgtgagggctggagagtctctgtggcctgagagagatggccaggggctgtgtccagcgggaggggctgctgctgcccaggttccggggtggaagtgggcaaatgggcaggcaggggttggtatccctaaaccactgttagtctccggccttactccctcacttctattctgccacaaaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttatattgctcttcctgctagttcttgggagttgtcagagattgtgtctgtggctaagctggacctctgaggcaggctggtgagtggggagagcagagcatctttttcacagctttcatttcctcccttgggccgatccccttagatgtcaggtgatgtatcttcacaccaggcatcgatgtcagggcaacggaaattaaagactggaaagctccggtcttctgctgcctctgctcctaaacccagctgccggccttacagccagcaagtgtactctcagtggttcatttgtttatttgttcactttcaccctacagattttaaaaaatgaaatttttataactcaaagtgccttctctgtgccaagtactatgcctatttgtcaggagacaggaagccaacaaactacatgtgcctaatccagcccactgcctgtttttatgaatcaggttttattggaacacagccacgtccatttatttacatattgtccatggtggtttcttactgcagtggcagaggtgcgtaaggggctatagacacaatacaggctatggtccctgtattagggttttctagagaagcagaaccaatagggtgtgtatatatgtagaaagagatttattttaaggaactggctcaagcagtggtaggagctggcaagtctgcaatctgcacaacagaccagcaggctggagactcaggaaaaaaactgatgttgcagttcagctctgaggcagtttggaagcagaattcttcctccagtgatctcagtcttttttctcttaagaatttcaactgattggatgaggcctacccacattatggagggtaatctgctttactctctactgacttaaatattaatccatctaaaaaataggccaggcatggtggctcatgcctataattccaccactattgggaggctgaggcaggaggatcacttgagcccaggagttcaagaccagcctgggcaatgtagagacccccatctctagggggagaaaaaaaagccaggtatggtagtgcacacctatagtcccagctactcagaaggctgaggtgggaggatcgcttgaacctgggaggttgaggctgcagtcagccatggtcatgccactgtactccagcctgggtgacaagagggagaccctgtcttgaaaaaaagaaaccatcatcacagcaacatctagactagtgtttgactaaaaactggataccatggcctagccaaattgacacacaaaatagaccatcacagtcccaaggcctaaaatacttactatctgagcctttacaaaacaggattgccagccactgaagagaacaaatggtcccaccccctgctgagctcacagtctggctctcctgtgtgcagccacttcttggagctggcttctctccactccccctccagatgctggtcagccaggcggttataaagaatctcatctgctgaaggcttttagcagggactgagtcctgtagctgttggacacctcctgtgggttgggtcactcagaccattcagaatccactgagctgagcttttgcatcttggattgagatctggatgagccaggaggcaggagaggctaggtggtcctcatgaccctaggatagctcttgctgagggatggtggcattctgccctacctctggctcccatgtgccgactggactttgtgagctccagctgctacagttgactgagttcaggctccatgtagctgggatatactacatggttacccctcacccctatggagcttccaaaagagaccctccctcaaagcacagccccttctctgagtgcaaataatggccatcagaggtcagtcacaggtgttaggcaggcatctatgaagctggggatgatagcactgacttcagtgcttggacgagaaccaggagagagtgtgtagaaaaagcacagccagcctcccataaaaggacagactcctgtgacaaccttgtcactctgttcctccctgatactctggggaggtggaggccagtgggcagttctgaaagctcagcaggtttggagccattgggtgtggactcctctcccagtgttcctcctgggtgtccacagatgttattgaatgcacactggaaccctgcacaggtaaactgaggctttattggcgtgactgccaaaggtcacacagggtggtttggcagagctgggattagaagcccagcctgtctctcttcagtagtaatggagtcctgggaggtttactaggctttagcctcaatctgtggcggcagggtccacagccctggggagtgacacagtcatggtccccatgattggccaggacctgtgtggagagaca

SEQ ID NO: 17175 - DNA, 227750 bp, Human
aaagaagcaaaatcattggtatcttttcattaaacacgtgtctcatataacaatttgtggtttactttttctgttctataaacaaaaacacacattaaaaagccggaagaagtaaaaaacagcctatttccatgatggccagccatggcacagcacttcctggcccctgctgatcccttctcaattctgaaaatatttagggggaacatacacacgttcacctgttttgttccacagtcctaccctgtgtaggactgtcaactgagttcacattttactacaaatgtggagaggtttttttttttccaatcaaggcaccatattaacatttcttaggttacatctttgtaatcttcaattatagtaagataaaaaccagtagcaaagcatatcacccaacttaaaattcagaacaatacttagacatatgcagcttgcacacacattaacctgtttctcccaacaaaatatttgtaatttccaaaatcctatcagctttttcacacaatatggtccctccaatttgaggggtagtaacatagtctccttactaaagagattagtctaaaaaaagtaaaatcgccaaaagaatgtaagaatatcagtggctataggctagagcaatatcatcttttaaagcctaatatgttcatgaaatctcactttaagaaggtgatatctaaacataaaatttattgacaaaaaacaattagtattgataaaccaccacaaaatgattttaaatgaaagtagaagacattattaaagctcaagatttttgcgtgtactgatttcatgcctcaggttatttccatatcaaatttaaagagatactggaaaatagaaaacaaaatccatcaactgtaatccatttcccttactcttttgtgaaatcatcacaaggtgtgaaggattgtttctgtttcctctatctttaacaagcctgtaacctctcaagtgaaagaacatgcacctgtcaagctcatagtgcgggatgtacacacagatgtgtttaataaatatctgcccacagggagattagaggtttgctttgagaatcagggaacaggctagctcatgtgttgacgctttggcatctatcatacaatccgccacctcgttcccttaccaaaatatcctcaaaggaaatcctctttgagtctttcagaagagttatgagtttgaggacccaaaacgttgaggaaagatccaccccagggaagggggagtggctgcagagaacaaacataagtaggatttaggtggctcagtgacgtcaggaggaagcagcgatggaagggatggggtgcaaactcacctggagaagcagaagctgcacacatgtcaaaggtcaaagggcatagcctcagggactccccaaacgcaggaaaagtgaaacgcccactcctgggctctcgccgtcaggggtacatctaagggctcagctgttcctacctttgacgccagggacaaaccctaccaggcacagttgggattggcagtaaggcaaggaaagcctgccccagatttcagagccagcgctggggaatctccctgtcctctccgccaccccctcccgcgcccgagacctgagacaccttctctctcacacccaccctctccaggccctctcgcgctgaacagcatcggtctctatggcgacctgaaaccgcagctcccattggcctgttcaatatgagggccgggccaatggggagggccagccctctccttcccgccaatggggtggcgggagctggcccggggacggcggcgtgctgacgttcccgggagcccggggctggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagtaagtgtgtgggctcgcgggagggcgcggagactcctgcccacgagaccctcggccctcgccccgaacacgcgccagggccaggacctgcgcgccgggggccgggggcctccctcccgctgccgcgtccccagcgcctcgcggccgccgcggctttcctgccccgcctcgtgttcctgcccgcactcgcctgctgctcccctccccccggcaggcgcacaagtttcaccctccatttgcttttcccggcgattcctctccccggtctcccgtacgcgcagcgcacgacctctgcccacgctgggctgttcggattcagagctcccagccccgaacttgagcgccgcgctgagccctgctggacgccctcgcggcggcttccccgctgcctgccgccgcgcgccccaagtcgccctcgacaccactgggcgcccgccctcctcagcactcggggccggctgtctgtccttctagccccagatcctgcaccttggtcccctccccgtcttcccacgcccctgctgcccgcgcggtcttgcgtttgtccccgaagtcctgtactccttgccggtcctgcccactcctctgcctagtgcgcccctctctaccggccgcggatcctcacgctccacccctcccggctccccagcgccgagcctcgccgctgccctcctgcgccgccgcttcctcctctccctgccaggagttgaagcggagctgcggcacctccctggcggatctggtatccccgcccgctgccgaggctgccggccctctcccctggaccgctacccggagagcgagcggcggggccgggatttggctgcgtgttggctgagtgcgacacaccgcgagcgcgggcagtggaggtgccgcggcggccgtggccgctcggggcgcagcggtagtcaggtgtgtgtgtacagcgggggacgcgcgctgccggctcctgggctggcgacagattgtgcaggaatgcgaggaatgcaccaggggcagagtccacacagcccgccgcggctgccctagcgccttccctccccagctctcgccgcgcagccagaggtcaccggagcatcttcggagctggtgagcctcattccactcctctcctcccatagcttccctccatgcggcagaggggaagcgcggtaattctttggggctccagctagcctttcgtctgggtttttgctgcattggtcttcaggaccgtgaatttggggccgatgactgtgtagccaaggttattgatcattgcacagggctgtttgcaagtttggtgtgcaaggtttggatagtgcctggttttcactagggttttctgaaaaccagcagaaacagggggcctgaaggttgttagagtaatgagcttgcagccaacatattttagctctatcaaaaaatgcctgttagtgctcacgggcatgtactgcgagagagatcttgaatgcatcactttggtatcctaagaagtgtaatttttttccctcgtcatactgggctgtgtttagacctcgtataatacataatgaatagaaacagagaagcactgttcggtcagcgatgggacagatagaactgtctggtacagttaaattcgggacgtgtcagttaccattgaaagtaacacggggacaccacaatcatgtatatttcaagatgtaatttattagtggaggtctcagttttttctctttgttactgagtttgactgaaaaaaaaaaataaatgctgccctacaagttttaaagaacggtaattatttacgtgtaaaatcaatgatggctagtatgcatttttggtcaaattttgttttccttaatacgggagagcaaaattttgacagaaaatggttcgctagaattgagcttagattctttttatttttaaagagaaactagaagaatgcttctcttcttgaatgcagtatattgctgtaggagtatcttcgttttggtgcctgtgaaacagttatggaaaatggcaacatgaaaacgagaacaactaatgtctgaaataagtgtttctggatgttgaaaagcatcatatgtgtgtttttatttgacacaatttgctttgcaggttgcatttatgataaacctctttgcacctggttattttatgtcagattcagtaaaataataagtcagttgtctgaccaatcagctttcttccaacacctactttgtgtagatcatggacattgaaaactattaaataggagcctttagttaaggactcaacagaaaggaaaaaaaatagaaaaaaatattttgcactcagaaacgtttatgttttggttgctacgttgtttttcagctatgtgcataatcagtgaatcttctaatttagaggtttaatttgtgtccagtaacactgtggaggatattgggaggtgtttgtaaatgccaacaggaaacttttattatgtaacagtatcatattacagcagtgtttaacccatgcttaacccgtgcttttttgacttgatgtcaagattgggaagtaaaagcaaatttagtttccctgccgcattagaaattgaaaaccctgttcagatgtatggatcacacacacacacacacacacacacgacacacacacacacgattggctgtgcagatagttttgcctgcttcaggtaaaggtaacctttcagttagaaatgctttctatttgttacagatattcaaagagtggaagtttttcaactagtgatcctacacaattgaaaataaccgaaattgtattttgaccaaagtgcattccctccccaccccctactattatgtaaggagagggtgctgcatctggtgtcttatgtattatactgaagagtctaagttgggaaggctaaatatccaattattttaatttttacctgtattgtttttggagggagataagggagcagagtattgatggaaaacaagggaagaagaaactaggggcagctagtattcagccagaaagtaaaattatatacattattgcagcagtaatgcatttataagctgaataaatcaaatctaattttgtgactagttctgacatgatatgaatttaaagaaactactaccaaattcagtttaataaaaattttagcatttctatgaccttgagtatttggattaggtttaaattagaatcgcagttttcttccttttcttgtaaataggcaaagtaaatttaatgtaaaaatttgaaactcgctttaatttttgaaaatgcaattattggcaatttttgaccttagtaatttccatgctgttacccagggatcaatttaaataatattcataccctggatgatgccaaccatcaggtaagtctagtctcttacctgactcttttgaaatattaaggtattttgagaatgctctgtaatctaatgtgtttttctttctgtttcaattgagcagtaattccctaccttgcttaattctaaaatggacatcatatcttcattcttaaatggaaggtaaaatagaggttactatagggttattttagggcataaatgcctatggtattgtatgtcagtttgggaagtttgccttcacgccttcaagtgtacagggagatagttactccttcaatgtgtgaaatgattctgtagtgcccttcctgcactgaagggggaagaagaatctgaaacataacaccagaggactaggtatgtttggagaattaaataactatttcacagccagacaacactacagacagctgcaaatagagaaaagaaggaaaacttttaagatacgtggatgtaagctttcattcttacatcaatggaagtgatgatagcagtcagcaggtcagttcgatgctcagtgataagaaataacagggttatttcaaggtaaggtaatcaggctctaagttgccaagaacagtaattcatgtacttgctggtttcagttcagaagttgcataacattcaaatatttcttaccttgtcacttgaataattcagtggaattatcttaatttagtgtgctatgttaccattactaaattggggatgttacatgatggtgatcttcaattaaacttaggaatgttgcagacattttcttcatcattgacctgttgtttttccttttcataattcagatttatttgatataccaataaatgttggctatatcactgatcattttattattcatagtcttgataacattatagtttattatgactcatatataatgattcattgcagctgataaaatgttgttagggattgtattgtgagattttattactaccaaatatataaattaaaatgtggaagtgtctgagttattgtaagtcatgtgattgcaaagcatttttcctgaatggaataatgcctggtgactgggtgggtgccaatccaggtagctagatatagaataatacagtcttcacaaaatccagaactcacaatatagggtagggagggagggggccaggggaagcacctttctttgacatctgaggcatgtttgacttctatagtttcctctccactaaatataaattgggtgagttgcaaatatttaatggtgttagtactgctcttccttcatctgtgcccctacactgcccccaccaccctgccacaacacacacacactatgccatcaccacatctgtgagcttggcaaggcagaggaagctccttatggcctgagaccatgtacataaaatgtagacattggtgtcctgtattccaggttgaatttaaaacaggtatggggtttgacacaaaaatgatactgtatatgaaggttaggtaaaatatgtatttgaagtgaggctatcagggtactatgcaggcttttggggcctggcccgaaacttggaatgcagtttttcatagaaacccacaatcagtttacaaatagacttttgaaacactggctaggtggtatctgaagttttggcccattgcaagctgtgtctgaattgcaagcatgagggaagtaaaaagcatcccaaatcagaaattaggagatctgccattaaaccttattaccttgacaaaccatttaatgtttggatgatagcttcctccttttaaaaatacaatttggattatattgatctaagttatattttagctcaagattcctgaagttcacagtggtttttaaaaatttttcttaagaaaaaaaaaaagaacaaaaaacttttccaagcttgaatatacataatcagccctgtttccccttgtacctcaaatcatggcaacaaggaagttgaatttctcttttgagacttttgaaccttcttcacattcatttttaattgttttgttttaaaacaatatcattttgggaagtgaggggaagggatgaagcacatgttttcaaagtcttgctgtctgcctctaccctagtctgagattacatatggtagttttggccagggaaagtgcttgggatttcaccttcatactcagtgaggctcatgaagtgtcattaaggtagtgaggtgtcatgattagcagccttactgtcagggtccaattctggcactgcaacttgctggctgtgtaacctggcagattgtataatctctgtggtcctcgttttgctcatctgtaggatggagtgataaaagtacccacttcatatggttgttggggagattaaatgaattaatacatgtaaagtgcttacaacaggaactggttcagagccagcgcttaatacattgaaataattatttttacattgtggtgcttttatgatggtttctgcagcatttaccaaatgccagggaaattattggcttgctttctgtgtgggttttgtcaaaatgattatggatttcaacaggatatttcagagaagaaataaactgctgaacagaaaccattgtgagcttgatagtttgcaggacattgtagaaaagagaatccagcacagtaattaagggcctttttaagtagggaagttgtagcttcttgcggtaggcaatacttagagaggcattaaccaccgctagccaacaagtataggagaatgtatacaattattgcgtttgtaatcccaggtagtagtcattttataaaatgtctttgctagtcagtacatgaataaagcgttagaaagtgttcatcatttaacaccatttgcccaaatgcagcttgtaaattaactctttaagctggcttttctgtctgaaagtgatcacagttgaaaaaaaaaaaaaaaaggatatttgaaatcagcaggagactcccaaatcaagaaaggctagaaaagaggaagggggtttggaatatacatgatataaatcaacagacagtggttaaatagatatcaagaggctctagttctagtcctggctttgccactatgcaggtgtgtgtcccatgagcacatcatgtaactctcgtgggctttagttttcttgtctataaaatgagggagttggtctagatgctctctagagtccctctagtacttacatttcgcaactcttagaacatcaagccattacattttttcctcagcaagaatatgctgtcttcccaaggatttatgacaatttaccctctgggataaggagggaaaattgaagttgtatacttgaaattctcagctcctgaaaatatgtgtcgcagccagacaaacctgtgacccctctgtggctgagtcagtggctccgtgtcttgtgcggtagtggtgaagtgctccaggagtgaggatccctggggcccctcggggcaggagctgagcagtgagcctttatggagctgcacatctgcagtttgtcacagccctgacttctgggacttacttgtctacaaccagtcccctgtgcacattggaggcttcacctctgattgagactacatttttcagaagttggatagaaacaagaaaggggatttagcatggtggttagaagggactagtcttgttacagtgagaaagatccacttcttacttgctcagatggtttgatttgtcctcagagaagttaaacaactgacagagttgctcctctgaaaacattttgtatgaatactttaggttcatagggaactcgtcaatccatatctcatagaatagagggacttttcattcaagtctaatttttacatatagacaatctaccagtgttcagaaattgtggcagatttcatgaggagaattttttacttggatttgtgctcttctataaaaagtaatttaaaaattcagtgatgaaagtttctcttagaccctgttctcttcctttgtggagaaaaaaaatccgtatagaactctagtatgtatttatctataaaacaattgtttaaaaatattgaggttagctcttcccctttgctaatgcaataaggacattatttgcaaagggaagcattaattatactactattgtatgcagtattaaatgaattgtcaatgtcacgatcaaaataaacccttgaagaactggctgttgttcccataccttcatgagaattgtaaacactcatgtaaaatagaaaccattatttaccactttgcagtgaaatggatcatgtgttctgacacctgtaccctgagttgagtgggaaacagggactgtttgatgaattaaaggtaactttattcctgtataccactaggggtgcaagtgaggggactgtagacaattagtactttagatatttgttggagtcctgctgtgtgtgcagtattgtgtttcattttgcatacttatttaaaacgatactacttatttgaaatgattcattttagttcattttaaccaacattttttagtcccctactccatatcagactgataggccttatggccaaaaagatgacttcctccagggatacttactgtctgtgttagattcagtaatgggagtctcggtctttaaggaatccatgatacatttttcagtctggttgggaaagataagacacatgaggtagagaagattgtcctagaaatgttggtatataaataagcatgtaacattgtttcataagtattaaggatgagctataaaataactaggttgtagctcatacttctacttgcttaattgtgtattacatgataaattacccgattctagagatatgcactaaccactctcattagctttctttgggaaaagtctgcaccaaagataaatagtgatttcaaaataagttttaatcatgaacttgattattttggctgtatctcttgaaacactttaccatatagcctatgtgaaataattaatcataatgacaatacatgatttatgagaaaccataatttatgctgtaagacctgccattttattacattcttatttttatttttcatgcagcagtattttcgtttattgtgttttgtgcttttcttttattctctatgtaatttgtgtgcctttataagcccaaacttgctgttgaaaatattccctcccattgttatgaataaacagaatgtttcaaaatctctcgtgatgtatgctagaataaatggtctcattgaatcttactttgaatctcagaatgatgcactgatgggaatttttcacttactgtcattttgtcgacaactacataagcagtaagtctgtttaaaaaaggcactgactaaggaatcacaaaatccaactggacttcacaagaactattaatactattagtctgagacctgtgataaacaactcagatgttaaaggtctaattcagactgtcaacagatgaaaaataagtgtcagtctgaaatcttcggatagtatatcggcaagtgtcagtcttccaaaatattatttagaactgtgaatataatttttcacagaagcaacattaatccataaatctcccgtcctgtagtgtaactatagtatatcagttccatgggaaaatagtcctgctctaagctactcaacagcagggactttatctttctacaggacttaaatcttgacctccagtggttctacataccttaagtgaatgaatgagtttgaattctagttttgaacaccttcacctgctactcttggataatcgtgtctgtttgtgcctagtacctatcctctgtccttttgtaaactggtctgagaccctgataccatttatcctgcatgtttcaaaggaaaaaactatttagactttaaaaaaatgcttttctaatacaacttgctagataaataattcattataccaaattccttagtaaagaaattaacggctgggtgcagtggctcacacctgtaatcccagcactttgggaggctgaggcaggtggatcacttgagattaggagttcaagaccagcctggacaacatggtgaaaccccatctctactaaaaatacaaaaaaaaaaaaattagccaggcgtggtggcgggcgcctgtagtcccagctacttgggaggctgaggtgagagaatcacgtgaacccgtgaggcagaggttgcagtgggcagagattgcaccactgcactccagcctgggtgacagagcgaaactccatttcaaaaagaaattaattagaagattttaaacagattggttcatattcattttaaacttaattgcctggattataaccatagtgagatgagttttcataatgctctttatcatactactaataggcaccaatcaagcaccaagactaagctaagctttgaaagtgtgatattgagcaaactttctgtatctgtaccttttgtgaatcagtaatatctttgtatactcagttgaagagttaagacagaagtagatataatttaaagcacatgaagtttttcaaaggggaaatgttacaaaaatgctaagggttattggtactataaaattacataaatgttaagagtaacgaaacaaaatttcatagcttgttttgacctagttggtatagtaagtaaacctttgtttggtcttaatatagtagatagaaatattcttatacattttggttgtccctttcccaacctcacataatcactgtaataaaatttacagaaggaaagatcctgtgtaccctttatattgttttccccagtggtaacatcttgaaaactatattacaatgtcacaaccaggatattaacattgatgtaatcaagatacacaacatttccatcaccacaacgctcatctctcctactctcatcgcctcctaaatctctggcaaccattcatttttcattacaactatagttttgtcattttaagaatgctagtggcctacacctgtagttacagctactgaggaagctgaggtgggaggatgacttgagcctgggagggcaagactgcagtgagccatgatctcaccactgcactctatcctgggtgagagagtgagaccttgtcaaaaaaaaaaaaaaaaatgtgggcacggtggctcgctcctgtaatctaagcactgtcagaggctaagatatgaagattacttgaggccaagagttcaagaccagcctgagcaacatagccagacgctgtctctaaaaaaaattttaaaaattagctgcgtgcgatggcatgtgcctgtagtctcaggtaattgggaagctgaggtagaaggattgcttgagcccaggaggttgaggctacagtgagttatgatagtgccactgcactccaacctgggcaatagagtgaaactctatctccaaaaataaaaaaataaaaaaagaatattatataaatagatttataaagtatgtgatttgggatattttttcccattttgcataattctttggagattattccaggttgctgcgtgtatcgatagtctgttctgttttatagccaagtaatattccataatatggatgtaccatagtttgcttaaccattcacctgttgtttccaacttatagctattacaaatagagttgctatgaatatgtatgtacagtttagcataagtatacttttctctgggggaaatgcccaggaatacaattgctgcattgaatcataatttttaaaactttctttctacattatgcactgaattatctgagacctcagtaatccagccatctttatcaatgtgttggtgaattaaaataaagaattttgtaaggtagatttatagctttggtaaattacaaaaacttgtctataaaatcaagtcttttatcttttgttactgttttacaaatagtacttcccataagtttaccttattttttaggaaaaccccattgattttaagtagaattcatgaagttgctttgtagcttggcttcaggatttgtttggttttgttatatttttttctttagatagcaggcacatttaattttctataacaatattatattttaaaatgtaatcatgaatgttggctctttcagaatttcacttatatatgatcataggtaatattcttgcaaaaaaatgttgatagtgcaccatgttaacaggcaaggtgaggatgtaagatgaagacagtattctcctatgtgattggaattaatccagtcgttaggttgaagccagtaagcatacctgatactttaaaaggtgaggattgtttcattcctagaagaaaagaaattagacattttcttttcttcttcttctttttttttttttttttttgagacagggtctcactctgtcacccaggctggagtgcagtggcggtactattataactcactgcagcctcaaattcctgagctcaagggacccactcgcatcagcctcctgagtacctgggactacaggcacatgctaccatgcccgactaatttttttgtttttgttttttgtaggggcgatctggccatgttgcctagactggtctcgaactcctggccacaagcaatcctcctgcctcagcatcccaaagtgctgggattacaggcatgaaccaccatacctagccagaaaatacttttttgttgttttttttttgagatggagtcttgctctattgcccaggctggagggcagtggggtgatctcagctcactgcaacctctgcctcctgggttcaagctattctcctgtctcagccccccgagtagctgggattacaggtgcacaccaccatgcccagctaatttttgtgtttttagtagagatgaggttttgccatgttggtcaggctggtctcgaactcctgacctcaggtgatctgcctgctttggcctcccaaagtgctgagattacaggcgtgaaccaccacacccggccagaaaagacattttctaaagtgattttcttatcccctccttcccaccgtgctttttgtgtgactgttgtacatacctctgccagagaaatatgttgaaattgcatctggctaaatgaagtcttcgtgattgatactttggttagtttttattaatgtcttttctaccttgaaggtcaaatctttattttcatagtttaaaataccatcagattacttaacaagctttatactttgttcagtattacttttatgttcattctaatatttttattatcaatacttcagtcttccagaatcctagctgagaaggtaagtgttgactgtacaatcagtcctaaaatatagctatacagtaacattcatttttaatatggtgcttttaaggatttgatccattttctgtatttgaatgatataacctcagcactatttactttcacagaaatatgatcctcccaataagttgtgtatttcctgaaggtttttctgtgattacctgttatgtccttctctgcctggtgagcccttgtttttcttcttcagggtctaactcaatgacccctctttaatgaagccttccctggcccttcgctctgcccaactccagatttcaaccttcccacctgtgcttgtcatcactttgcacataactctgctttgaacacttgtcacattgtgaatagtttctgtgtctgtttcctggctatttgagctctcagcaggttagaactgtgtcatagccatcactgtaattctctcatgtagcagtattcctaacatatagtaagcaacgatgctttctttgagtgaatgaatacttaaatactttgtttacaaccttagttatccccttctcttctaaccttcagtggctctccattgtttaccctgctggatcatattcacattccccagcgacctaccatataaggcccgttacagtcaaaccttaattactctccttcctgaaccctccacatcagcaagtctagtttctactcattgttctctgtctccctccactctaggttcacatcttcaaagtccttcaagacctagttcaaatagatactgtaatagtatctaacttttttgtggtagaaagaaagaaagcgcagagatcctactctgatgacaacaagaacaaaaaacacaacacaatctaattcattattttcttcaacccatcagagagttgaaatatcataaacaactaacctgaaatctaaggaaggaaaggcatctccaaggttggacttgcttacctgggacagatgatgctggacactagtaagaagaactgagttaaaaatgtttagcaaattgctaagtgttgaatgtgggcaggcaagagaatacagaaccccacaaggcatcagtcaggtggtgaattcataccccttgagggctcttctacatggacctcccctgatgctaattttaaaaagattggccagagtcctgagaaggcctcccactgagtgcggggctggggaggggagcagcaacccgaggatggaaaggcagaaaaccccagtcttccttagggcactggtgaaaaccattgagaatgaaaatttctgagagtattgttaagccatcccaatttaaaaacagcatgcttgctacaaacacagcttcaatgccccttcaccccagccaccaaactagctcctcagcaaacactctgcacccaccatgagcagaggaatctctcagagccttggaggtgaaggagagagaatgatggcccaaaacaaggttttggttgaaaaagttttaagatagagtggacttaagcatggtaatggatggagtgaggaaagccaaagaatagaattaaaagaaatcagggagtaaggaggataggttgtaaatcacatagcatgaattttcttccagaatgtttcatcagtgtagatgcttaggcgtgcaagtttaatttttgtttaaaatgggggaaaaaccctacatgaatagattcctggattaaatttagtatcagatttaatttttacagtcaagaacaattggattgtctgctcgtattttctggatcatgagatctattcacactgaaatgtctaacattttgctcattgtcaaaaaaagccttcaagtgctgacatgaagaattgtgctttatttcaaattgtgcacatcactgcagtagcagaggctcatcacacatgagagaagacatactggaagtaagattcatctcttctagttgatttgacataagcagtatcatccaactaaatatcagtgaatgcctgttttaatatttctccaatcttattcatagttacaaaatcaggacaatttatttcttctattaaatgccgtttattgaactaagcattatttcaaagaaaaaagaactagtcattgaaaagtaattccttttttagatacctcattaaacttaacaatggcatttaaacacttctgattattgaaaaattaaacatgcctaaattatttggtctcattctactcatagccaaaatttaaatatagcttatcaagtggtttctgaaaggtatagagtaaaaatgcattcttcctcagctctttttctgtaccaaaaagcgctatctaggaagcttagcacagaactgaaagtgaatcaataggaagatgttggttaaagaatatataattagttagattgaaagaatgagatcaaggaatctattgcacagcatggtgaatatcgttaatgataatatatttttgaaatatgctgagagtggatgttaggggttctcaccacaaaaatgacagctatgttaagtaatgcatttgttaataagctggatttaacattccacatgtatgtatacttcaacatcgtgctgtacacaataaatacatacaattttatcttttagtttctaaaaaatttaaaatcaaaatgaattttaaaaagtagaattaggccgggcgtggtggctcacgcctgtaatcccaacactttgggaggccgaggcgggcagatcatgaggtcaggagatcgagaccatcctggctaacacggtgaaaccctgtctctactaaaaaaatacaaaaaaaattggcctagggcagtggcaggcgcctataatcccagctactcgggaggctgaggcaggagaatggtgggaacctgggaggtggagcttgcagtgagcagagatcaagccactgcactccagcctgggacacagagcgaggctccatctcaaaaaaaaaaaaaaaaaaaaaagaattaaaaactatcttcaggctgaccatatcagtttttatgtcttttcaaccaaattgggtcagatagagaaaaggaaaagatctgcatactcattgcaacctatgcttttcctgtgaagaagccagtcatctaattttttaaaagcagtgaaaaaaaggctacagactatagcatagatttatgttaaatgttacaagcatgaaatgttaaaatatatccatttacaacagagtaaacagacaacgtacagaatgggagaaaatatttgcaaactatgaatctgacaaaggtctaatatccagcatctataaggaacttaaatttacaagagaaaaacaaccctatttaaaagtgggcaaaggacatgaacagacacttttcaaaaaaggacatccatgtggtcaacaagcacgtaaaaaaaagctcagtatcactgatcattagacaaatgcaaatcaaaaccacaatgagataccatttcacaccagtcagaatgactgttagtaaaaagtcagtaaataacagatgctggtgaggttgcagaaaaaagagaacacttatatacggttggtgagagtgtatgttagttcaaccattgtggaaagcagtatggtgattcctcaaagagctgaaagcagaactaccattcgacccagcaatcccactactgggtatatacccagaggaatataaatcattctgctataaagacacatgcacacagatgttcattgcagcactattcatagtaacaaagatatggaatcaacctaaatgcccatcagtggcagattggataaagaaaatgtggtacatatacaccgtggaatactatgcagccataaaaataacaagatccggtcttttgcaagaacatggatggagctggaggctattatcctcaggaaactaactcaggaacagaaaccaaataccatatattctcacttataagtgggagctaaatgatgagaagtcacagacacaaagaaggaaacaacccttgggtctacttgagggtagagggtgggaggagagagggggcggaaaaggtaactctggggtattggacttaattcctgggtgatgaaataatatgtacaacataccccagcgatataagtttacctacataaccttcacatgtacccctgaacctaaaagtttaaaatacatatatatccatttaaagcaattcagattgtatcttagcttattttttgctttgaagctagcttatgaaattttaaaatcaggtaaaatttgtgtggcttgcaaggtcagcattaaaaaacctaaggaaaggggaggactctgatttttcactggttatgaagcaaggtgatactaaatgaattatatttattatatgcattacagaataaaatttctgtgtttactgggtattttttcattttaattcccaaagtaaaactacaactcaaagatgaccagaacaattgttttacttctttcatcctcatagtcattaacaagttttaacagaagctactcgacgacagatattctgcgttttacacgtttgctgcccctagaggtctgagcaaagacagagggaagctccgaaagtacaagactctggctgacttgaagctgccacataggtgaaaacaatcgtgtctttctgtaatcagtaatgacattttgggatccctgaggctcacttgctgttaacgatatcacttctaagacattataataccaaagctattagaaccaaaagatctaggctgtgttgattactgaacccctgcccactcctagcattgggcctcagaaatcagttattgatgagaattcacagaattacatcggaagtgtcaaagttaagcccaataaaaaatttttaaaaaaaccatgagattttaagtgaaggcaagaataatttgacaactgcttgtgcataaaatgttttccgtaattcattttggaaatgaaaatttactgcctgtttcccatttgcaatggtttttcaccagtgccctaaggaagacgggttttttgcctttccctcagcagtgtaaggctgttccatagtagagataggagaggaggatccaggcaggatttcttgcctctcccacactagctgctgctcccctccccagccccgcactcagtgggaggccttctcaggactctggccaatctttttaaaattagcatcaggggaggtccatgtagaagagccctcaagaggtatgaattcaccacctgactgatgccttgtggggttctgtattctcttgcctgcccacattcaacatttagcaatttgctaaacatttttaactcagttctttttactagtgtccagcatcatctgtcccaggtaagcaagtccaaccttggagatgcctttccttccttagatttcaggctagttagttatactgagatatcagctctctgatgggttaaagaaaatcatgaattagcgattgtgttgtgttttttgttcttgttgtcaccagggtaagatctctgctctttctactagaagaaaagttagatacttttatagctgtcttaaggaagttcacctttccatttgaaacgccaaggacccctggtgccactttttaaatctttttattagagttttattattttttgataacatatctatatgctgtttcctcactagattgtggactttaaaagtcatgaaactgattcattctttttttttgtcttcagcacccagcacagtacctggcatagagtaggtgcccagtgttttagacacagaggtttgcattttaatctcagtaagggcatttttactttcttattgttctcagtaggtaggaacaacctggcagcagattctgtctgtgctctgtccacatcctgtggcacttgaaatgacctgacaactttctactgcaatattctagaatttttagccagaagacttctctgccacctacctgtgttggggcaggtaagaagtgccagtgggttatccctgcaggagcaaccctcagtcagtagctcagcatcttcaccccttagttgggatatctttgaggtgtgttctttgtagtctggcagaagtgcccagtggaagtaagacccatttgttcactgtgaaaactgactcagtgcaccccttatggacttccctgccctatctcccatatccacctaccagataaactacatgcactgaagttcttgtcttggggtctgattctggaagaatcacaacccaatacagactgttatgattcacataaattttcagatatttagaatagttttctctaatagggacagtccacaaaatcaaggagccttttgagggcaattatagctttcatcagattttcaaatagttcttgtctctcccttcctctcatagaattcgttttcattgcaataaagacaaagaaacatccttatctttttaacttagaatattaaagcagctattttcctttcagaggaccagtacactgaatctttttagatgcaatcaggaaatcattggggtgtgttgtaggtacacatgcgattgtatcttagtaactgaatttcaaaaataggattttacttttatattcatgttattggttttcatccacatgtacagcgaaaaatgtgctgggatgtcatatgattcctttcctgcacttttgaattgggggctcatcctctgatgatttttaagttttattttatttttttagagaccagtctcactcttgccgagcccggagtgcagtggtgtgagtatagctcactgcaaccttgacctcctgggttcaagtgatcatctcgtctcagcctcccaagtagctgggactacaggcatacaccaccctgcctggctaattttttatttttttttagagacagaatttggctgtgttgccaaggttagtcttgaacttctgacctcaagtgatcctcccacctctgcctcccaaagtgttgagattataggtgtgagccactgtactcagcccctgaagattttatttgaaataaaatagtctcagattagagacctgctgtttcaagtttaggcgatctcacttttaaaatagttttttttttttctgattgtaaatgaaatccatgcatttgcagaaaactctttgaatacagagcagcacaaaagaagaaagtaaaacccgagtatagtttagctgcattcacaggtgaccactgatgtcattttgttttatatgcttccaggaggtttttattttctaagcctctgcatgtacatatctaaaagaattggaattaataatcatcatattcttactctattaaatgctcttctaacacaaatatttaaaacatttacaaagaattatattctttgttctgtgaacacctgtataatagaattctttgtaaatgttaattcatcccttaaaattggacaattttttttttgcttttataaataatgaaattccacttctagtttatgactgccttgaagttaagccacagatatgaccacatttatttgaagatgacactgaggttagtgcttgtagaatcgcaagcttttagaccaaggaaagatgttagagatcaccatatgcagttctttccttttacaggggaagagcctgagatctggagacatggtccctgaggtcaacatgcatacctgtatcagaaggcctgggctaggtaccttgtttcccatcagcttatctagccggaaatatcagactttgcttctcctctcccctactaattgaaaaaacaggaaatgatctagccaactcagctggaggtgtgcttttgacaaataagaaattagaaggaaaccatgccaaaatgaatgaactacttaactgaagcaaaagtatcagctcctgtaccgttgagttagtaattatggcctgatacctcaggaagtcaagcatcaggggatagaccccgtaaagaagaaagaagtatcagtcttaaagtaaggtttcctgaaattctgctgtcatattgatcaactgggattaggctgaagtccaatttcctggcaacaatatcctggtttaaaaaatggttaaattggggcatgatggcacatgcctgtaatcaacgctacttgggaggctgaggcaggaatattacttgaactcaggagatcgaggctgcagtacactgtgatcctacctgtgaatagctactgcactgcagcctgagtaacatagcaagacactcatctctcaaaaaaaaccaaaagtccaaagcctcatgctaactgagctatagaccagcttctgaggtatgccaataaataaattgatgactgtactaatgtttcatatatataactgataagccagggacaaggtttattccctcagttcttatgttctaagagaaatttctagttctggctaaaaaatgttttcagtgtcctaaaatagactggcaaaggttagagatcttaaatttgcagttttgttttgaaagggtgtggtttgaagcttaatgttaacctcatgttagctataagatgtaaggctgttgaataggagcttatagctttatcccagattttaaagacattattatttagattttttttttgattagggaagcattcagaaaaattacttctgaaccttaaaagtaattgtattaagttgtatgttttgtttctcccattcagtgagttagaatgttgtaaaatggggttttcacaagcagatgacgtgctgtggttttgattttcatagtaaatcctttagactatgccgatagtagtgttttttacattcttgtgtttaaagacattaacatgttttagaagagtcgtactaagtgctgtcctaatcaagataaatggaatcatcagcaagcctgtagtctgcccaccgctctctgccttggcaatagctcatcgttttttgttaagtagttttctaaatatttggatagatcgcctaagttatcagtgatggcttaaaccttaattcattgtgataaagcacaagcaaaatgtgaattatccacatagtattttggtaactgttaaaaaacataatttgaacttttattgtaaatgaaactgatgaacactaatgataattaaactttttgcttagggtttgtatggcacattttaaatatgggacagtacagagaataatgtatggagtgcccatgaaactattattcatatttttaaaatcttgtttgccaagtttgcttaaggattctgaagttggtgtttatcctcttcattatgtttttatttttactacatatctgtatctccataaacatgggcttttagatgtggaaaatctttgttacagttatgatttcctgtcacattttccccagtattggaattagtaaatcccacccactaagtacttccatggagagacttgtttctattcctttctaggctaggctgccaagccagcattctcgaggaggtttctattctttttatttttccattagtaggagttacctaagtagtattgttttttaaacctttttaattctcaaacaatttagatattaaacattagctaacttttaaattcagcatttaatttttaaatttattttattattattatttattttttgtctttttttgatacagggtctccctcaggttggagtgcagtggcacaatcttggcccactgcagcctccacctcccgggattaagcgatgcttccacctaagcctctcgagtagctggaacaacaggcatatgccaccatgcccggttaatttttgtatgttttgtagagacggggttttgccatgttgcccaggctggtcttgaaatcctggactcaagcgatccgcccgccttagcctcccaaagtgctgggattacaggcgtgaaccactgcccagcccagtttttaaaattaattttttattttgtaatttaacattttttaattttatttttccttaatatagtcttattaagcttctataggcagactgtcacttttgtacttaaaatgagaatcatggtgatgtctttatcaatttggaaaggagttcaactaatagcaactgtattaaggaaaaaaaagctttatattctgtcattgatggcaggtgaataaaaagcattaataactcttgatttattctttagtctctggtttactgtatgacccagacaagcaatcctttttccaagtcatgacatggaaatgtgtatctaaagcatttatgattcctctgtttacttgacttaatattgaaatctagggcttgcccataaactggttccacagttttgcttctgccctagctacaaccggggctgctcatgtggcttaaatgtttgtatccttcgtcagctgaggaggatatcagaaaggggagattcatcttcttagacgttgattctgaactgctactgctttacaaagagcaccaaattgcagatctgtcccatatccctaggtcaggagtacacgcctgtgtttttctacccataagtcagtgccaactcacaggttttaaagatttctgttaaatagttccttttgtcttaattttaagtatctagcaactcaaaatttgcctcctatatggaatttatttatttagttatttttattttattttgttgagacagagtcttaccttgtagcccaggctggagtgcaatagtgcgatctcggctcactgcaacctctgcctcctgggttcaagtgattctcctgccatagcctcccaagtagctgggattacaggcacccaccaccacgcccagctaatttttgtatttttagtagagacaaggtttcaccatgtttgccaggctggtcttaaactactgacctcaagtgattcacctaccttggcctcccaaagtagctggattacaggtgtgagccaccgcgcctggcctctgggattcttttttttttttccagttgtttctacttacagaaaaatgatttattaaaatggccagcatttctttaagaggaataaaaaccacacccgagatatttaatgaaaaattatataaataagaaattaatagaattttaaaactaagaattgaagtgcatattacaattgagatgtattctcataccataaattcactcctataaaggatacagttcagtgatttttagtacattcacaaagttggacaatcaccatccctatctaattccagaacatttttatcacaccaaaaataaaccccatactcattaagcagtcatttaccatttctctctcccctcagcacctgggaaccactaatctttctgtctttatggattcgcctcttctggacatttcatgatttcatgtaaatagaatcatgtagtacatgtccttttgtgtctcactttttttacttagcatgttttcaagattcatctatgttgtagcataaatcagtgtttctttttaaattaatttctttttaaaagtgatattatactttttgtttttaaatattgaaatgaggtctcactatgttgcctagtctggtctcgaactcctgagctcaagcaatcctcccacctcagccttccaaagtgctgtgattacaggtgtgagccaccacacctggcctcatttctttttatgtgtgaataatattccatcacatggttataccacatttgtttatccattcatcagctatgggcatttggattgtttccatgtttttggctgttatgaatcatgatactataaacatttgtgtacatttttgtgtgaacatatgtttttagttcttctaggtatatacctaggagaggagttgctgggtcatatggaagctctatgtttaactttttgagaaactcccaaactgtttccaaagcagctgcacagtttttactttcccactagcagagtatgagggttccactcctccacattctcaccaacgcatgttattgtctgtcttcaattatagctttcctagtgggtgttaagtgatacctcatagtagttttgatttacatttccctaatgactagatacatttgagtatcttttcatgtgcttcttgaccatttgtatgtcttctttggagaaatatttatttaaatcctttgccctttttaaaattgacgtatttcaagtgctattataagtactatgattacttttagggagagaattttgtagaattgactgataatatataagtaaaatgtacgtggagagttgactgccacataagacataaaaataagcaaaactggtttatacaggtgaacagtattcacctacttgtattattgaaatggtgccaaattattttataactttagtgtctgattttaaaaactgttgtaatgttagtgatattttactgtattctacttggaataatgttggtaaagtttatagagttttcagttgtgatcgctcatgccataattacgtacctgtgctgtctaaaatatatccactagtcacatgtagctatttacatttaaattaattaaaataaagagttcagttacttggtcatactggccacatttcaagtgttcagtagccacgtatagctagtgcctactatgcaggacactgcaaatatacatttccacatcatcacaggaagttcagtcaagtagtgctaagctagatgtgctatatcctgaaattctctctttaccttcttcctccctgcctccattctttcccttccttccttcctttccaagacatggtcttgctatgttgcccaggctggactcaaactcctggacccaagtgatcctcctgcttcagcctccattgtagttggaattataggcacataccaccgcacctggtttattatgaagtttcttactctaaggaaaatgtcagtgaaagttttatttcatttatgttttaacccacgttatcttaaaaccttaccatttgaaattgaacatataggccaagtacggtggtcatgcctataatcccagcacttttggaggccaaggtgggagaatcgcttgaacccaggaatttaacaccagtctgggcaacacagggagaccctatctctacaaaaaataagaaaattaactgggtgtggtggcttttgcctgtagttccagctatgcaggaggctgaggtggtaggattgcttgggcctgggaggttgaggctgcagtgagtcatgatcatgccacttctctccagaaagagcaagaccttgcttcaaaaaaaaaaaaagaggggggaagggaggaaggaatttagagaacatgcaggtcattgcacagaatggaagtatacctgtatgtattattaaagtttgtgatacagtgtttgttagcctacacacaggccaattggttattttttaagtagcttttatccatccagtgtggaaatactgaatatttatggctaggtcctgaaatttagacctcaagagtagtcattggttcatctctaagtcatgagcagttagctgtctgttcattagtgtgtccttaaaaaaatcagtgttttgagttggggaagttgtatcttttagaaaattgagataaggattaggaagctgtgattggttttctttttcttttttgtttatccatttctcatggtggaatttttttcctcaattatttgttctattcattgttaatgcattttattcaaagactccccaatttctaatgcttttctgggaatgtttgatctttctgtaatttttcttttctgtgtataaacagattgctcttcattgctatgtgttttttttttttaatcattttgtcttctcattctctgcttttattattgaggtttggatctccaacttgctgtttctaaactttgatgatcttatataagtttcatgagtcatgaattgacagctggtcattaattaactctagctacatattaatgataaaatatgtaatacagcatcatagagaccatcagtgtggcaggttggaaagcaggtagctttttgtgtattaaatggtgtttggggggatctactatctggaaaagtcattgtagtgatttttttttaatgccattttgaaactttttaaagcccctaacattaagaaaaatactaagggacataattttcactaaagtttactcttgaatttattattaacatcttattagaaccaattgaatttggaattatgttctgcttaaggaaatgtgtagataaaattaggagattaacagataattaacaaataatttgaaaggtattgtttttcatcatcgttctaccaaagtattgttaaaactgccagcagaaaccacggtcagctgagttgattttccttttttcatctattgccagcctgactaatgaatttctttgtgtgtgtgtatacattaaaagtgagcataacaagaacgtgcacagttgcacattttttctttttctttttttttttttttttttgagacggagtctcgctctgtcgcccaggccggactgcggactgcagtggcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccaccttggcctcccaaagtgctgggattacaggcgtgagccaccgcgcccggcctgcacattttttcaaagcctcttgaatccgtgctaactcagcgtcatttccacttgtccttgagaactgaagcattgaggctctgctgttgcaagtgtccgttgctgtcctgatttggtgaatgtgttagagatgtttatggttccaggttatatgcatgttgttgtctattcttaggaagtatttctcctttgtttgcatactctgaacttttaataactaaaatgcctggttcctgttgaatatacacgtagatgactttctcaaagagggccttacctaagaggcctctggcatattttctgtgataaagatgatgacaatcagcctttataccaagtggcgattttatagagttgcagtaagtggattatcttcgcttataaatgggttgttagccatgaaactattcttttaagatgtggtaacacagtgtggtaaatagaagattgcatggttctgtaaatgctgaaaactgctcataagtggggtgcaagcacagccccatatggacttgttagaagggagtacttccagtaggaaaagctttgcaggtgacaatcagaataaatggtacaggattttgttactgtaagccatccaacctagtatactcatatctcacctcagtatacctcactcagttctccccaagtgccagatctttaaaaagaaaaagaaaaccatttgatgaggtcactttcctacctgaatgacttaactgttgctctgtgatagactgaaagcctcaccgtggtctacaaggccttttgtggcccacccttctctataattagaatgtcccaagtgacagcctggcctgtatacaaggccagatttgcagctactcttaaaacaatagtcattgtttattaagcacttactgtatggcaggcactattccacacattttatgtgaattaactggtttaatcacaacaactctacaagccaattattattagccctgttttacagacgaaaacacggaaacacgtaacagttaagtcattcagaagtacgtaggaaatggcagtgctggaatctcatccaacccacttaaccctagacccacgttactatctgagatgagattggctctccatgtaacctataacaccactgttcataatttcatatttgtcgaattatttgaagcctccccaagactctaagctgcatgaaccgtgcatgtttagagcccattacaagcacctgaagtgtactgggtggtcagtgtgtatttgttgaatgaatgaaaatgatttgatgtgatgaatcactgagcttaaacatgagaatagggtctcttttataaacaaaacatttaaccctttagttcattgtcatttgtaaaatgggagaatgatactgaaatttctgtatgcctactggattctaatacaaaaaaaagtgtaacttcataatggctgaagatttgtttttgttttgtttttatctcaagtataagaatagacattaattagtttatgttcagtaacacccatccttaatgtcaataattaaaatacattggcatatgtaatctaattaaggttatgtttacagtaaattgttattttgttgaaaaccttttaaatagcagttgttaccaaacaaaaatacacattctaattttggccacattaaattttttttatttctaattaaatctatgtaattattaatagtggagttcaaagtaaaagaattacaaaaatgaaatttgataaggaaaattggaatttataacattaaatttgtaatcatagcattattattttgaagatacttggcagctcaacttttttaaattcttacttttatgataggctataattaaactagttgtttcctatgtgaatatatgtggatatgatataaggagaaaattgtattatattgtatgaggtatagagacaatattaattgtatcttgcaaagtagaattgttttcctttgagattgttactagagtaataaatcatgttgaagtgaagaaatttacacagcatatgactgaatattttccactgtatcaaatttaatgggttttgggaaaacgtatagtttggtagcagtatagaactgagtttttggtaaaactgagtatttaaaggacgaaactttgaaggactttgagacccataagacctacagatattattcagctttctgagcagtattctagtttactaagaatgtggaaggtaatgtgtggtggtgaggcaaggggtgttgagaacacagtgacctacattccaaatacaactcttctaaactataaggcagagaatagactaagtaaggcataataagttaggacctgccacatggcaaactgattttgggaagcagtctagaaagatgcttgaaaaatgtactgatgtgtaatgccagcagcaggccattgtcatggtatggaataatggtgactgaaagtcattctcccttgcttgggatgatctgtcttaagcatgagcagcttgaggctgaattgtagacaataaaacgtgagtccaatgacagtctttgtaggttgagtaagagtatttgtgtactagccattttagttgtaatgcattcacagaatgattacagtcagaattacagtaacattttaaatacaaaggagactatcttccatgtcagcttcatagttctgtacctattcccagccctgtgatatattccatatgaaacgttacatcagcatccttatataaagcatacctataaactggggtgggacagagaagtagtggccagagaatggagtttgtcacgctatgattcagcccgtgggagtgattttcacactgcctgtcagcttcgtgcgatagttaaaaacaatttgcaagtgacatagtagagccttaaggccataaataggaatttttaactggcacaaagcctttttttaaaaaaaagcacatttgtataaaccagtgtttctatatagtttctcatttactggttgtcttcaccataatctttggaagtgcataatcttataatcattatgtgtgttttacacatgagaaaacagtaaaagaaatccatgatttgccctaggatcctgcaacttgtgagtaattcagtcagaatccaaactttaattttctgatgtataaagaaaaggcctctggttggatcatactgttgctatgagttaatatgggaggtgtcatatgcataaagtacccatgagtttaaagttttggtttgttcaagtaaaatgtttatataattattcaagttaaatttaaataaacacatgctgaaagaacttgaaggtaaaaatagtttctgcaaatactattccacactttttctttataccactttgaatgctgagtaaggacattgtactggaccattgcccagcatagttctggcttatagagacttgatggtgaaagaaagactgagagagagagagagagagaagagagagaagggggagggagggaggaaggaagggaggaaggaaaaagatttgacaagggaatgtgttttttaagagaagctctttggggaataaatatagtcttgaaatacaccatgtaaaataagtttagtagaaaactatggagatatgcctaaatcataaatgaaaatattgattcgtttcttcagttgtggaattattcatttctgatttctttgcacaggatcaagctatattctaggtagaccctttatgtttttcaatctgttccacctatatccacaaatttattactgccacctactaaattatttataaccattgtatgatctgatttttgtatacatgtgttgctaagtaagtttcacattgtcatgaaaccaaattataaaaaaaattggaggcaaggggtgaaagatctaggtagtgtatgaaagtttaacaagtatttgttgagcctactatgtgctggggcatcctctttaacacttcctaggcgccataccctgactaaagttccttcagcttctcatcaacacttttccgcatttccttctgagatgactcttcatctgtttttattctgactgttgaagcttttccagaaatggtgccttgctaaattcccatatataccatgtgctctttttttatgtttattatgccccttgtattgtcccactacctctaaataatgtggggaagcagtcacagagaagagagatcattgccaaccctgttttgattctgtttgacactcactgtctcacttacatgcagatatcctttcaccagtaggtttatggtaggcagctttaagatagcctccagtgatcccacctcctggaatccatgccttagtgtaatctctgtcccttgagcatgcctgaatttattattcatttctaatgaatagactatttatttgggtgattgtatatcacttccaataatagcagtgttaacaatatctcagtgttaccaaggattatcagtgattgttgatagtgttcaggaaaaagagcttagaattcactcctgagtcagggaaagaatgaagtctatgggtgtttaaaagagagctgtccaaggagtggctggaatcagataggaacaggtgtgcaaggcagtgtgtcttcaaaagatgtgtcttcatttgcatcaactattttaacaaccttggggaaggcattacatctttcagagccgttatttcgtcatctgtacaatggagttgaacttgatgatgattgttttgataaatcttttcaattcacattctctacatccagaaatccaatattttacattttgataagattttatttaaaacaaagttcatccacatacagtagagtcatttttttttccttcagaaatcattattgtaggtgtgaaatttatataacatctaaaatcttttgatattatttctctgggtgttagcatatctgggcttctcttttttgaactgctatttatagtaactttctagggttttgctttttatagttatggagttttaatgtggccacactatcttaatcatttcaagtttgtgtccctgacaaatgaaagagatttctgacgctaaaacctatcaataacccttctcagaattccttgctagaagaaaatgattggctgcttgtcttttgttcctccagtggagttggtatgtcatccctgaaatcatcttctgtacctaaaatgttccagctacccatcgcagcactcagaatgctgatttggggcttccctgactcctctgccccctgcagctgccttagctggatgcagggtttttgctgaggctcttcccacgctgggctaaagatttattaaccctttcttttcagtgttacagtatcagaaatgaaattctactcacttgctgcatttaaaccttatgttattcatgtcatttacaaaatgttctttccttttggaatcatttgcaaatcaatttaagctgtgttaagcaagacaaaagtatacattttaaaaaacataattatgtccagcgaaactctcacagtctatagtaggaaaaccttaaggtgagaggagtctggattcctcaagtgtggccctagtgctaatgagcttcaaaacccaggcacagccagttacttcacccccttcccccgtgagcaaaacaacaaaacaactaacagtgtgaatcatttttcttcagctcttggtcattattaagacaacaattaggggaagtgttattctcagattgtctttttaaaatagacacattaatgatactatataaaaccgtgagatttatttaaaatattttcaatttaaggggtgtgcaaatcattaacaccagatggcatctacctaggattttttaaaaggtggatttgggatacttgtagccaaaatgtagaaatttagcttataaacagttactgtgccaacagattggtcagtgcaaattgaacgtgtcgatgcaagaggatttagagcttttgttgtccatctttcctgctaagctctggtacctccctgataacagacctggtcaccaaattgatttaaaaaaaaaaaaaaaagacggcaaacaaatgtgatatttacaagaaaaaaaatactagaatattttagggggttaaaagatgcataagtaaagtcgatgaatttttcttagattttcaaaaagcttgtaacaaatttccacttgttatttttaaaagaatgctgttgagttgtaaatggtaagaatagctaatttgtcatagaggattgaagtttagaaaggggaaatagcaagttgggataagcaggcatttttctggaggaagaagtacaaataggattcctcaggagtcaatgtggacaataattttaaacattgatttaatctgtcttaaggagggcatgagtctctgtaggtttacagtagcaaatcccctggaagactgatctgaccacctcctgtttattctccttggctctggattctctcttttgtgttcacattgctggtctttattttggagaaattctttagttggatgttagggagggttgagctgttcatgtatctccattgatggcatttgtcaggaccaggtcagtgttttatttctttatccccatcttctacatctacctcccacggccgtaggcatttctaatgtgtttagtgtttttgtttgtgtgtactcttgtataatatgtatgttgcattatgtaaatcattacataaatgttgttattctcattcagttaatatttttcacttagtttattttaaagatatgtgtccctgggtggtgtctgtgttagcttgttgattctgactgcagttgagtatttcatgatatatatccatccagttttatctctcccctccttctgtgatggttatttagattgcattcacctcctcaccatcgtaaaaaggggtgcgtgatcccttgggacctgtgtgacagtttctgtgggaaatatgcctagcaccagaattgctgcatcatagactatcagtactcttactttgcctgagctgtgcggtgctgatactctctagaatggctgcatccatctatatgtctccacaacccaacacttagcgtggttcagtctgccaggtgtaaatcaactcattttcagtttgtatttctctgactacttatgaacttgataatgtcttcatctgcttgttatctttttttgggtatcctcttctgtaaattttttgtccataccttttgcccagttttctactgggggttctaatcttatgttgatttgagggacatcattatattctggatatatatcccttattatggcgttacaaaagtctttaatatcccacttgtctgtaaactttattgaacagaaatcattaaatgtgctatcaaaatcatcgtttgttctcccttcaccccccaccccagccatatagcttgaaggttttgttcaaatccttctctagccctagttctcaaggtattcttcgtgctttcttttttatttttaatttttatttttgagacaggttctcactctgtcacccaggctggagtacagtgaagcaagtatggctcactgcagcttcgacctcccaggctcaagcaacccctcatgtcagccaccctagtagctagaggtgaagtagatggagcacaggtgcgcatcaccatgctggagtaatttttaaatgttttgtagagatgatgtctcgctatcttggcagggctggtctcaaacctctaggctgaaatagtcctcctatcacagtctcccaaagtgctgggattacaggcttgacccactgcaccgggcccctttttttaactttatagttttactttatacaatttggctctcttgcacctggagtctacgttgtgtcactgccctgattgaaaaaaaaaatctaatggcctcagttgcccacagagtgaaacaaggcatcacagggaataggaaactcctcagaatctatctcacaccttccccctgttcagatattcccatattcttataaaaataagaaaccgaaaaagcaagttatgcgaagttaattttttttagctgaggaatcatctttgtcttaatctcagttgcttcctctccactggttgcttctccttaagtatcttctgtctcctcagattttaacaacagccagcaacctgccttcacttccagagagctgtactggcaccccctctcccccacaccaaccccaaccccgtttccctttggcttccgccaccctgcttcccctcctgccaccctgcccgggctttgctcctgaggatactcttcatctgtcttgcccatcaacacttgacaacccactccatgggaaaattgctttccttctttgcctgttacaatagtatttttttctgtctccttttgtctttctgactcttactacttaagttctgtttccagctgaccattttcctcctgcgtaccttttaacattactattttcttcttcttacagaagtgttatacgtgtttacagtagaaaatgcagactaaccaaaagatggactacccataatttcatcatttagaacagctttttggttttgtttctttaagaaaaggggattatgcttcataggcatagtctttatacataacctttatttcctccctacctaataatatttattttctaaactgtttatttttaatgtttgttttagttttttattttaaattaaaatattgaaagccttataacaaattataacagtcctttgacccccttgtctcattctttttgccagaagtatatactttcagttactttgtctatttcttctgatactcatctccttatttctaaataacatattattttttaaatcattaattttagatattatctattattgttaatacatagatgagaatctctgccttatacccctttgctgtcttcccgttttcctaataatgacagatcataattttttattaaattactatttattgtttccattattttgactatatatatcattcaccagtgagccaaatagtttctcatcgttttttaaatccaagtgttttttccaccagtggaaatacctgcctcatttttccatttccttaacttcgttttgatctacagccaaatcttctcacaccctcctttagcctcttagtgccattttccatgtggttaccctagcagctcatcagtgaatcccatttaaccctcacatttgggaccagccacctgtcctccttttccaggctggactggttgctctctaggcctgctgcacagtgtcattaatgcctgagtagccctcttccaaaactgaagtcagtgacacagtgacgttagcaaattgagagatttgagaaggtctcaagaggcttctagtccctgtaggtgtctagcactgctgcatgagggcattgagcagcatttggcctgggcttctgttttgtgagtgctgctcacttggcaacatgctttcctccttgaggtttcaggactggtgagcttttcctgctaatctaggtcttactgttgcctttctctcctcttccctcactctccccctttccccacccttgtggaccccttttttcagtcttctttcattctccagtgtgattattgattgcactactaatatttcttggtctttggggaagaaatgaatggagtccaggggtgcaaaattcatttaaaatgaagctgacattttcatttcagtcttatcaggagggaggcagattcttgccataataaaagttggatcttttttaatacagtttaggaactttaaaaggtaaacactgatgagaagggaaaagctatttgtacttagcatactgcttattcgacttcaactaagaagctcatccattacaccaatttaggcatctcactatgtttctactactctaggacagcagagtatatatttatattatgtacttttttttttttacttatggaggggaaaatgggttctgtataaaacaagaaacagccctaaaaaatgtgacctttatatagtcttacttgaagttagttgaaatatcaattgtgccaaataatatacttgtaaactacagcgttatttgcaatgatatgaataaataaaatgtgttagttatttgaaagtagatgagcgaattatgaacctgatatgtctgaagtgatgattaataccattaaggatgatttgttttgtaataacatatttaaactaggtaatcatggatagtaaagcactttaaaatatggtagtagattactttcattattcagttatttaggtttttaatatgaaattttctagaccagttgcaaagactttttcaaagtactaaatatccccattataaataaagtgcacttaatggttcttttaatttgtaagcaaacagcaaatgattttttataaccaaatagagattttagttttgctatttgcttgctctttaactttgggcagatatttaaactgttttgagcctatgtcctaatcagtgaagtgagaatcgtgcctacctctagaggttttgcaaaaactttaatgagatgaaataaatgatcattgctctatttttttttttaaagttgtgcatttttagtagtcaggaaaactattaaatcaatgaggtggccgggcgcggtggctcacatctgtaatctcagcacttcaggaggccgaggcaggcggatcatgaggtcaggagttcgagagcagcctggccaacatagtgaaaccccatctctactaaaaatacaaaaaattagccgggcacggtggcgggcatctgtaatcctacctactcgggaggctgaggcaggagaatcacttgaacccaggaggcggaggttgcagtgagccgagattgcaccattgcattgcagcccaggtgacagtgcaagactccgtctcaaaaaaaataataaaaatgaagtaccatttttttcacagattaggctgacaaacactggaaagaatgataaaacctcatgtggatgagcgttggcaagttggactcacattgctacaattcttctggagagttaaaaaaaaaaaaaacaacaaagcccagaaagttcacttggctcatcacttctaatgtgctatataaggaaataatcagacaagtggacaaaaactgttttctgctgagtcgcttatactctcaaaaattctaaatattagtacatcagacaatgaatttttttgtagccattagtaataactatgtttaaaaaaaaaggagtgtccgggtgccgtggctcccacctgtaatcccagcactttgggaggccaaggaggtcctgacttgaggtcaggagttcaagaccagcctggccaacatggtgaaacctcgactctactgaaaatacaaaaattagctgggcgtggtagtgggtgcctgtaatcccaactactcaggaggctgaggcagggtaattgtgtgaacccaggaggcggaggttgcagtgagctgagattgcacctctgcactccagcctgggcgacagagcaagactctgtctctaaataaataaataaataaataaataaataaataaataaataaataagaggggtatatatgtatatatttttaacctttcattatggtaaatcaatatcagttttaacatatattttcttttttgtatacatttttacttgaaaatattttattttattttatttgagatggagtctcactctgtcacccaggctggaatgtagtggcgcaatctcagctgactgcaagctccacctcctgggttcacacagttctcccacctcagcctcctgagtagctgggactacaggcacgtgccaccacgcccagctaattttttgtatttttagtagagacagggtttcgccatgttggtcaggctggtctggaactcctggcttcaagtgatccacctgctccagcctcccaaaatgctgggattacaggcttgagccactgcgcctggccctaaaatattttaaatagaaatttaaataaacatttgatagtttacctaataaatgccatgttatattttcttttttagcagtgtatattcatttaaattgaaggccttggctgtaaggattgaatttatcgattctgtgaatttgttggtgcacccctcttgtgagtgtactaaaaatcaaaagtggtggtagatcagtctcctgtaaacattctttttcctcatggtccacatccatctgtcctctggtctgaaatatctatctcctttttcattttcacctgtgcaagttcagaagtttttaatttcttgcttttaaccagaatcttgtcttttgtctctccagaattcagccttcacatgtttacctgtgtccccaaaatgttcttatttcagaacaaagcaagctgactgagaaatttgagagtctcagtcagtgtctctctttcgctctcactctctctcgccttctctctccgtgtgtgtgtgtgtgtgtgtgtgtgtgtgtgtgtgtctgtgtgtctcactctctctgtctctgtctcttctttatcctcctgggtaggtggttcttgatgaaggaaactctcaaataacctattatgaattcttcctgtaaaaagacatttaggttcctgcactcttgataagttgcctttttcattatatcttgaaaaaaattaatggtctgaagtcccactaacagatttttttctatgcatttttagtgatatgttgatttccttaaaagaataatttggtattatacaggtgtgccacgattcttcagctctaggaacttgaagcaattcagcttggttaaagatgaatcaggttctttaggctatccattggacagtgcctcacctagagatgaaaagatccacagggccaggtgtcagggaaggggaacagagcttccaccctgcaggaacctccatgcattcaactatcgggaagctcctatgtatttttaaatgactagagtgatattctaacaatactttcagtgttacgcagtatttgcatttgtatttgcattttgagtggcctgccttttccttttggttctttgcctggtttttatcttcaaggtaccttccctctttcctgctttttctctttagttcacttgcttctgcttgcccaatgctagataagaatcacacagagaaaatagatactgatttaggagttatattctcttaaattgttttcttttaattctctaaaatctggctttaaaaaacagtctgtcagttattctggaaactcacagagtggtggtgaacagcttaggaatcaggtagacccaggcttgaatttaaactgtgtcactagctgattaaccttaggcaagttatttcacttctctggctctgtgtactcagttgtgaaacagcgataatgtgtaactcagttttgccttaaagattaaatgatataatgttttaaagtgcttagcactgtatgagtcatagtattcaataggtggttgctgatgttgctattatagcattaacttttcagagatgaaggtagaggccagacatcttatttcaaatatcattgtaactttaaaaatcccagtaaatgttgcctgttcggtatacagtcaaaatctcccaaaacaaatccacaaaacagaagtgtagggtgggacacaggtgcatctggtgtttcgtaagtatgagcttagatatggagtgtggtagaaaaagaatgaagagaggataatggaggaagggaaaaactcaagtcttgtttctgactaaatttttttagaaaaaggagattggatgcctgcactgaggcaatgtgaggatgggcagattttaaattgtgcagcttttgacacatttttattttttgttatttttatttttatttttttgagatggggtcttactatgttgcccaggctttgaattcctgagctcaagggatcctcccacctcagcctgccaagtagctgggaatacaggcatgtgctaccaggcccagcttttccacacattttttagtcaatgtaaatatcaaattacaattgttaggtgattgagaatggggaaaatcaaaacctatccagataaaaagcattttatagtccactacattctcatgatggattctgtactttgcttcagattttttgttgtgagatgctttaaaaatgttaacattttatcatgttatcagttttacatagttttccaaaaaggttaactgtgttgtgaaatgtaattttgtttcttgggcttcagttttctcttcagcattccttttgtagtagtgatgactgggaatctcatgcactctgctgatgttggccttatagccatcttccccaggatatttcttctaaatgtctgtggatgctgcagtgttaaacagtggagataggttgatagggcaaacagtcttggcctgttctagaaccttgactcctctgtgctctgctctgataaactcctgctcagtttgttcatataatactgttgacccagtgcctgcattaggtgggttgtgagtgtttttttttttttttttccttcaggggtgagagatttttggtgatcattcaattctgcctctgctaaccaggcacagctttctgcagcacagctgatggtggtgacagcacagcctgtggccacagaagagaacagaactcctgtgctcacctaaggattaagcccacggggctggtgcattagctcagtgctcctggattcaaaacagttgtagaatatgttcaggaagaacggtaaaataccctccaatgagagagcctgcggtaggggtgccttcagtggtccaaaatggcagttacttcagattctccacaatctgagcagtttattatactatggtggtaaggggaaaggcttggtgaagattaatgttaaatacataagataaaatgacccactgattttttttaattaaaaaatgggcccctttcatatcaaaactgaagatggatacattacctgagggtgcacatcagccaacaaaagtgggttcagcatccccccaaccctgaacccagagcagtcccaacagcctgccccatgtagtacctgttagtgaagtaccacctttgacccaccttgctcagtttcctcacttgttcttaagagaaattagttccttgtgacccagttgtgtttccagctatagagaaactgtaacaccactgggttttagctggataacatttttaacacatgtctgcatttgagttagaatagcagagatcagagtactgataatcctgaaggataattgggcctgtgtccactggcctggaggaacacatatttgtgtgagtggccaagcagagcaccactgacccctcctgccattggaaagcacagtggccttgcttcaatggcagcgtgttctaagtcatgccattttacttagtcttcattcactcggttagaaatgaggtcaattattcctgaaaaaaaaattggtaatacttggactaaataaaaaactgcacctgcccatagatttgtcttagacttcttgaataaaatgaatgatgttgggacatacagaatatagacagagtttagagaacaggatgcatgaattaaacaaagtctcacctctccagacttgtatttgcaacttctgattctgttatgcacaacagcatgtatcagaaagtgagataatttcccagaaatgttagaaagttttaattagtgtactgatgctagagaaagcagccatgaaagtcatcctcaatacaaagttgctggcacttttatggacagtatataaggtaatttagtgtattttacattcatgaataatcaaggcaggttaatcttgcatatttgtttctaattactctatttttactactcccatcatttctctttctcctgcaagaagttggaatgtcctaaccacagtgcatcacatacacccacagaacagtagcaaatgagggccccagtgtttctgtagagaaagcagtcaccctgataactgccggtaatgacaaccttgttgactgtaccagtcaaggtttattattaagtgtgcagaaattttcatttttgactcacaaatacatttttgttctttcataaacatgtataatagcaaaaaataaagataacccatcctcattaaacctaagttccataaagaaaagacacaaagcctgctctgtttatagatattttgtttccctgagcaacagaaaatgcagtgcttatttaacttagcagcaatgccttgtaaaaatataagcctgcagatggcaatggcctctatttttcttccacaagtttcttccaattcagagcccgtgccttccttcagccacagagcgcacaacagcatggatgagattgagtcagccctcttacattgttggcctacagctatggagctacctttgcagagttgtccactttggggtttgagcatgggaagtaaattcagagatgcaagtatgtgggagagggcatgaactcgtgagaaagtcctcatattctgagctcctatgacagttttgcctttagaagctatctcgtctcttagcagctttgttttgggcagaatgaatagcagaggggcaggaaagacccagaatcttgatgcccagcctccctgcttttactctgctgcttgatactgcctctaatgaaggagccgttcttatagagcagttactttgaggcctgagaaacccagaaaaatttatcatgactgctagacctgggcacaggtggattttagattagacttggcagggacaacaggcatcttggaaactccctaaggaagggtccagatcaacaacactgcaaacaccatattcccttcaggcaggcatccctattttgctgtaccaggccttaatactctctgggttgtagcctccagtggtccatttgacttctgagatgtattaacaagaagactaatattaccaatggtaactgctcacttaacaaaaacaaaacaatataccccaacatttattgttgccttgcaactctgcctttttggcctctctggatatccactgacatcatttaaaatgaaccattttatttctaattgctacatgccaggttggtttatatgtgtctgtttctcagcattccacagatgccacattactcaaagctgtgcttttgtgcatcttcacagatttctctctccctaccctgcacagcctccctacctgagtttctcatctagcagctgcctgcatgccctgctgacatccatccacagcacatgcccagccagctgagctcaactgcagtgaatgtggctgtagtgccagtgaactggctgtgctccaggactttgcctcccctgccatgccatctgatgttaagtgttttgttgaagagggaggtgtaaacgcctcagtgagggcacaccaaatttcacagatctgtgaaaggtgcatgattattatttcagtctctattgtgtgcctattttgattcactcttatactgtcttctgtctgcacatccacagtatcaccatgcagatgtttggctaggtaaggttttcctgtttaaggcaggtggccttgatcttcctacttttcagtccttggtatcattaagttttcaggatcatgtgtaagacctcagcagctttcctgaatgtgtgcctcaggagcatggtggttggcatcaggcagtgtctgaacagtatttataaagtgtgtttgatgatgcttacaacattattgaaggttttctgagggctggaagctcttatctaagtaaaatagagtattatgaaatccagttaattgactttgctttattgcattcatgctgaagagtagatcatccacttggatttttaaaaaatcatgaaatgattttttttcatgatcatgaaatcccaagatgttagtgagaacaaatgagccaatcatattttaggaactgttcttgatgatggttcctggaaataaagcactggacacagaagtgacctctagttccatttgcagcttagggtccataagaattctggttctggtctttctgagattgaagtcttcctagtcgcagtaggggagggatccccaaaaagtttccaaagaagttagagccctcattcccaaattagtgccctgggctggaaattttagcttaaattgtctctcaaatccatttgagctttgaatttcagtgacagaaggcctcaccttgagttctctaacacatacttgtctccaagtgaagtgtcttctcatcacccctcaccttcttcccggtccccttccatgtggatcgctgcagtcacttctagttgaaatctctgctaccacctgacttctttccagtcctgtagcacaactagtctgtaaaacataaattttccaagtcacctttagggaactgcccaattgcaattggtgcagatggacacaaaaggtggttcaaaagttgggttaacccgcatgctgataggagttaatggtgatgcagaatatttgtttacatttagtacaacttttacagtgtgttagagatggtttttgtaagaatagaagtatacattcataaaagcaaagaatagtaagttctctctgttttaaaataaacttttgacacaaatcctcgagactttctgctctgtggtcgtctatttatatattaagaatgctgtgggaattcttgctaagaagtgttaaagactttaggcctgtaatatacctctcttagctttgctatccacatgtgttttgcataattccagctaggaacctccccttggaggaattcttcagcctgattaaaagtttgagccataacacatgtgaaggaattggaaaagctcttggaagcaacatttgtcagatgatgtaagcaatatccaatttgttagctgtacttaactatgcttctgctatttcatagatgcatatcaactcatgtagaagatatgtcaaaaggaattccagtaatgcgttatctttcattcaatccatatttacttggtggctggctctaacgcttcagtgcagagtcccttgactctccttttgcctctaatttcctccctcacctaagattaaaaaatattttgataatttataaacaaatacttccatggctaaggaaacttgctactcaaagcaagtctcatgaataagagggcaaataatatttttgtaaaatgaagttatattctcatatataaactcatattttatcaaatcctgttttaaagtggagatacacttgtaatttttaattgtgctttcaaaacttaagatctttcatttctcattgaaattttatgttaaaattttggacattccaagtattttaaacaacttcttttttattggaaattttagcagctgagcaaagtttgtatcattcatatacttagaattattttaaccccaccacccaaactgcctttttgtcttttaattgtatacacaattctgaaagcactttgttcagttgtattacctcatgatgtgttactttaggacagtgcttgtcaaccttgaatgtataccacaatcacctggatagattgctaaaaacaggttgctgggctctgtacccagagtttctgattcagtaggtctggagcattgctgatggtgctggaccatactttgagactactgttttaggatttctggtaaattctggcttttttttttttttttttttgagtaatgagtttgagatataagaaaacataggaaacgtttgccatagattttatagttcacaaaatttaaagttcctttttaacttccctttcttgttgttctcataatattgcatttttcttactttgatttaaatgtatttagtgctgacaatgtgacttgtattacttgataaatgaccaatgtacatttgctactttaataatttgagaggtcatgaagggagcattccaatgacttttatactgtcaacattgcgttattaggaagtcaatataaacaagttcctatgaagtacacggcccagggcctgacacatagtggacactgagtaaatgctggaatgaacaaatgaacaattgtcctacttccccgcagtgtaatagttactctttgaaaacttgattgatccaactttgaatatctgagaattatctgatttattgatctttactatttctttgcttctcattcttgtagtcctgaggatggttgtctcactggcaatttagcccttctattaggaagagaggagacaagttaaacataaaactaagttttcacttttctcttgttagtagtacttaattatttactagaataggtagtattaacttaaaagttctttgagggttgattcaggttcatttattcaagctggccttatgatcttctaaatatccttaaaaaaaaaaccaactttattacctaatctggaatataaatgtatcgcaaatcagatactacttttatatccttcttgcaaattcacaggaatttccaatactctgttactgcattctaacaaagtttattatgagagttctgaagatactgaatatgttgaaatatctttagtgcttcattttccaactatttcagtgcaatttcagtgatgttttgtctgtttttgatggctgtcctgtgcttagataatggataagagttacggtagattgccaagccatctgtttgtatcagtcttcacaaagatgcttcttccaaaggagaaaatggacagaagagcttaatagtgttttcaggtggaaattaagagttctattcctgttctggcactgatagcatgctatagaataattctgttctgctcctgcttacttcatgaggatgttgtaagagttgatttaataactattttgagtggcttaaggcactgataggaaaggtactttgttagccacacaggtataggaagagtatgagttctgccataggcatgctgaatatctgggaggaaaccctgttgatgactgggagacatgaaatcaaaactgagctcagggacccagaataaaatttttagtgggtagcctagaagtgatcaccagagtattaagattctacccacctgccaaatgtatgcctatcaggaaagccaaagacaaccactaaggagctcttggagcttaggggaaaatcgggagattgaaccctagtcatttgtccagggcttctccgaggcccaggtttttcctcctgtactgtgctgcctgctgacagctgttgcagttgataaaccagtgaacaaagtctcttctgtactcatgtagctttctccttgagattggggtagggaggattagtaatgtattagggggtggtgataagcattaaggtgagaaaagaagcagggtgggtgataggagaagtgagggttttggagtggcagggaagggggttcatcaggatcagagtcaggtcaagaaaggcttcttaggtgacgtgactcagcagaatgaaggaagagacaaagctgggagagggcatgccagggcctggaactgcaagtgtagaggtagttgcagggagggatagagtgctgctgtccctggaagtaccggtgtggaggaggtggggtctgaaatgtgcccacctttccaccagcagatctggtgaagaagaccataagtacacaggaggcgcatccctcaactgtgagcttcaacagccctgttttgaaaccttaagtaaaagatttgtaaaataataagcctgaactttttccctccaagctatactgtgaaatgtgaattttaaaaagaatggttgtgtaaatatgaagaaagtactttcaaattagatgatcagactgcgtttccttcagaattgtgttgctttgcttgaacatggcaattgaaagatcccagaagcaagactgtggacaagttatgccctggctttgagcctccagtcaccttgctctgcagtgcagtccttgatgttaagtggccttcctccaagctttaggaagcctcagtgcaggttgtggttgaggagatgaagaaggcctaagaggagcagctcctgtttttataattttttgtatcagtgctccctcccaagggtatttaagtaaaggtattaacaaaattaagaatttggcagacagctcagttagacgatcaccaaggtccttctcatttctaaagttatttgaagctgctgttttcattagtccttaagtatatgttgctaccatataatttggccacaaaaatgtttagatatgtgtcaaagacctcagggcttcctgacagaagtgcttcttgactgattgtgtatttggtacaagggcttctttggtgatagtttctactctctttaaatactgttctgttatttttgaaatctgatcaagaattgacacaataaatctctttgatatttatacttatgcctacttttaaccttttaggaaaactttatgaattggaatattctaaaatcctgaaataatttggaatattctaaaattctgaagagaatatgaacggattgttggaatggaacttttacccgattccctcagactagagtgttcatacgacattttgccaagaagttcctatagaggcaatatcacttttaggatggatgggtctaaaaggatcatatttagtttctggttattcatggttgcactcactttagaggatgtgttcctattaggttgctgctactatttgtctctcctaaataacagtatggaattatagaaagaaaggttgggagaatagtcgtgtgattctcctggtcagcataaagcctgttccatccagccactgactattttgttctttcttttgctttgaaggccaagatgacatttccattacttcgatgtttttatgttctatacctctctcttgctccatatattttgcagtggtgcagatatattgatccataaatgactggtattacatactgaatcaaggtacatgcattcaactctagagagaattgtttctcggtgtttttcactatgtgactcaccactgtgaaggtatgaagatgagtttatgccgctaatggggtagctttgttgtgatgtaatttcagtagctgcccatggcagctgttagtcgaaggtaaattcaaagccagatggtttagatatcacagtggtgaagatcaacagagtaccgtgaaaccaggactcggtcatggcaacctgagactgttctagctaactctttctaatgtgtttcatctggcactttcccagttcagtcccttgcttacctttccccatttgaaaaactctgcttttggagggagaatggattacaggtcttgacagaggcttggactcttgacttcttggtttgtttttttaaatttaaaaaagaatttcagttcttttgtgaccatcacattactgaagttaacattgatgtcttgctcaaacttattttttttctctcacacatttcaaaagaaccaagttaatacattgaattgagcagtctgataagaaggtagtgtgggggggtctccgggtccacagaatttccttgagtgtggattgctgtgtaggaaaagctctctaaattttttctgctggctgaatgtagagtaatgtgaccctgttgctctccgtggtgagctttccataattgagatattcctggattcattgccaggagtggacttcctttacctctgccctgccacagggtggctgctgcctttctcctttaataaggtatgttcagtttcccccactcaaagaccatttcatcccttagacattctacccaggacattgaaaatagaaacaaggccaggcacagtggctcacgcctgtaatctcagcactttgggaggccaagatgggcggatcacctgaggtcaggagttcaagaccagcctggccaacatggtgaaaccccgtctctattaaaaaaaaaaaatacaaaaaattagctgggcatggtggcaggcacctgtaatcccagttacttgggaggctgaggcaggagaattgcttgaacctggaggggcagaggatgcagtgagccaagatcacgccattgcactccagcctgggcaacaagagcaaaactccgtctcaaaaaaaaaaaaaaaaaaaaaaaagaagaagatgccagtgaaggaaagttagaaaccactgcgtgtcctaagcagttcctaactcccatggacaattctagcatgagttttgtaatagtttataattgacatataggtagaaaattgataccaagaaacccagctgttcctagagtactagtagtaactcagaaagagtagagaattgtactgtaaaatgagcagattgccttttcactttctttttctactccatcaaagtgccagcttgctccatctttgctaaacgttagattaaatgtcttatttatcatgatacctctgatgttcaaaattacatatgttgctgtaattcttatgaattgtgagcatacattcttctgcgtaaacagatggtactgttgacacaggctttataatcctagtaggctggacatcaaaattttatatttctaccattaccttaattgtagagaggttctggggtgactgtggaaagtcatctaacatgtgttctctttctttgcactgctgggtttctaaatatttattaatcattatttatactctgtaatgccatactttattggtgaatgtaccatctttgggaggtcattagatattctttagtatctaagagaaatatctacctatcagtgaatttcaaattatagtttatggtcttcagattaatgaaaagcaagttcccacccccaccaaaaattaaaatgacacaaaaatgcatcttgggaacatcacaatattttaaactgagaatactaattttttgagatttgattatatcacatatgacttagattctgatagattatgaatttgtaatcagttcaattttgtatactgaaattatctttgcactctgaataaatgaagtatcaagcaaaattttaagagtaacaatattttaagagatataaacacagttaaaatctttgaggtattttaccactcacttttagaattatcaaatgctgctttgatcttttcatcaaatcagaacagatatctatatttttattggcaacaataaaaacagtctgtgaggaaatgaaacaatccagtctttcattttcttgctcatttaatctgaacaggtgatgtttcagtatattgagacataagacaatcaagactttttgagacataagacaatcaagactttgttaacagctttctagattattggtggaattatagctctgatttatagggtcacattaaaagtactcctttgtgtacactaggtctggaggtgatgatatagaaatactagtgtgggccgggcgcggtggctcacgcctgtaatcccagcactttgggaggctgaggcgagtggatcacctgaggtcgggagtttgagaccagcctgaccaacatggagaaaccctgtctctactaaaaatacaaaattagccaggcgtggtggcacatgcctgtaatcccagctactcgggaggctgagggaggagaatcgcttgaacccaggacgtggaggttgcggtgagccgagatcacaccactgcactccagcctgggcaacaagagcaaaactccatctcaaaaaaaaaaaaaaaagaaataccagtgtgaccacattgtaacataggttgtgttatttcctgctaatggaatgtagcttccttgacttgtggttatttcccaaaattcttcctttaagaaattcaaaaccctcacctaaaaggaaagaagttacccaagtaggaagattgaaaatgaaatctgattctttctgacatttttactgccaactaataaacaaaagacttcattaaggaagcagactgttcagtggttctttgtgtctgaatatgactgatctaatatattaaacatttttctgtaaatgtagcagtatagtgccagtttctattttcaactcctcaaatagtagaatcagttctgtcagcaggcattttattaaatgcctcagaacatgtgttagacatcatagaaaatacaaacatagaagacagggatcttggtcttattaaatttaaatctaaaaagatgtgggagcattttaaagagcaaatacaagtgggtgaaaatgagcattgcgtgttgctaagacttgaactagattggttggactagaggagtgagtcatcgaaaaaaggcaatttcagaacacattaatgaatgtcttcttaaggatgaggcacttgcaaagtgcctgtgtgtcaaaggaagaaatgatttggtgattcaagtggtagtggagttgtttgacacttgcttgtgggctttgaaatgataagaagagcagggctggagttccaggagggctgggccagattgggctggtggggtggggtgagtccacttcccctgcccaggcagctgatggaaggcatgagaatagacctattctaaggcagctatgttgaaagggaactgctttcagcaagaatgcccactgtgccccccatttggggacaagcagatgcagagggaccccttccaaatttacacctagattttgcccgagatttctttagtgattgatctctaccactgcatctgctctacttttctgtcaccattcctcattcttcaaagtgcagctcaattcctgttgtgccagaccacagagtggtaggggaaggcctctgtgagcctgagtatggtgaaggaggaaccctggagagagctgggcaggagggagcatgcagagctctgccgaaactcacgtcaggggctgagcgcggtggctcacacctgaaatctcagcactttgggagaccaaggcgagcggatcacctgaggtcaggagctcaagaccagctggccaacatggcaaaaccccatatctactaaaactacaaaaattagctgggcgtggtggcacacacctgtaatcccagctacttgggaggctgaggcaggagaatcacttgaacccaggaggcggaggttgcagtgagccaagattgcgccactgtactccagcctcggggggagagtgaaattctgtctcaaaaaaaaaaagttaagttggtgctctttattttctgtacatagtgtattatgtatcaaaagtgtgattttggttaaacaattttatttgaatcctataatttaccattactacaaaacaaatgttctatcctttggaagaaattagtaaatgggagaattttctttaactttgaaaaatttaatctagtatttaactgatgtactatatttgctcaattaactgtcacctgacttaatttccttctagaaaacagtgacaaattgtatttatcagagagagaaagggagagccctgctaaccaattaggaataaattttcaaaattaaacatttttgatttgcagttttatttttgtacaagctttcatgtagaatatgattatttaccttcctctgactatgaaatggcatttaaattttacacatgaagtagaagcacatgcaaacacaggctagtcatgaaagataccctactctgaatcagcccattgggtgtttaagaaaaaaaaaatgctgagtaaaccattttgtcctcaaaatgggtagtattaaagccagcaagaatggtatggcatgaatcataactcagttttttaaagtgttatggtatatcttgtctagagagtatttctggttgcttagagcatatttgaagataattctattacatatgcatttggatgcagctatgctcttgggatgactggactagaaacacacaaactattattattttaatgaggcaggctttattttaaaatatacaaaattggaataattgcctaagttatttctatatatcatttggaatactaaactcgtatatcttggttcttggatttgaaattgcactttaggtgaaatggaaataaactgccatgaaaacaaaatctgtaaacagattattagacatagacaatatctcagaattaaggcattgttttggaaaaggtgatttaaacccatgaatattgaaagaagagagattaacatgcttgtggtggtgatacagtgcatgagcacagccattgcacagcagtggtagagagttgtggaacggttggcatgtgcaacattctcagccagctctgtcaattagagcagattctgactgacaaactgtggtgtgcccatgtggcatggaacacttactccaacagctgtcccactgtacacttgtgaatcaacatgtaactgttttcatcatgttctaaagtgactaatagatgtatattacccatcatgaccaaccttttgatttgtataggttgatattaaccctttcttaaatttttgaattggaataatcagctagcttattgtctgtggagaacaaccaccagtactgacaagacctccctaaagtcacatcacagaactttgaagtcactgcagtcctgagcctgtcctcagttttacagttctcagaacctggagtaatatataaaccagaacacaaatttattaattcataattatcaaaatgtccatatttgccaagtacacttctcctttctaggatcaggtgactgttgccattgtgaacttagaatcttgtcaaaggtgaagatgtgtttgcaagaagagttcatctcaggaccatctctgtccctgagagcaaagatccttcttgtaatctcacttgtttttacttctctggggagggcaggaatctgggttttccttttctgtgtttcatactaactatcctcttctctaattatgacagcaatcacatgtgataagtcataatcataatctgattttggtctacatgttaagagtctgttccttgatgataggttagagctcttgggggatacttttactgattcttagtttacgtccacccatttccggtcttatcctcattttattgatttttctgattttcttctcttagaagcagccttgtttcctttctcttgaggttttgaggagcagctccctgatgcatctgcctgtgaggatactgaggcgagcaggatggcaatacccgagtacatcttcctagtgtccttaagtagcccacttggacaaggaaggacaaggtttcctaggattcgatttaatgattgtatcccccagggatttggcacatgaaggagagaagaatcattcttttcttttgcagatgttggagatttcttctttttgatgtctttaaagtcttcttttcctcacagttgcttcctagctcctcaccgggctttccagacatttccccagtactcctaagttgacaccatctaacttttactctcctgactccaggtcacattaccaccttcactgggaccagtgacacctcattcagtttgactctttgcctcaactttcaccgtcatcttaggcaaatttaaaggctgtggagacaatccatgtctttatttgcacttactattgttccttcgtcttctcatctccagagttttctttctctttttctcccccaccccgcttccaccccaattttagactgttggcattctctgaacacagcacgctgtggtgttttatgcctctctgtctttgtagtaagtctcatcttccctgacgaccccgctctcccatgcgaagttgagctcccctcacttctgtggtggtagattttatgcttgtttactcttgcatttatcacactatttttactcctttgttcctgctagacagctctttcagcatcataatggccacaaaacctaacaccatctggtgtataaatgtgttttcattgaaaacacagatatgttgtcatatcttccctcagtttgtttcatgctcccattgaacaaacacttttgaatacctactgtgtttcaggcactttctggatctgctgagaatgcagtggcaatccagatgaaaagagtccctgccattactgaaccaagagcgtatggttagattgcagaaaagtaaataagttatcatccagtccattgcgttctccatctgtgatcaacagaactctagaaactttatagtggttgttattttttcttgtactttcttcaaaaagctgtttggagatgttaagtgtgaaaatttgtctccttgaaaacgaaatatagtattaagcacacagattctaaatggaataaaggagactgagagataaccatcattcctctatcctgctgaagaccagacagaaagaaaggatgttatcacaactgagaatctatggtactttttaaaaaatatcttttaaaatcaagaggttttttttcttttactctaaagagctactttaaaaaattgcaaattagcccgggtgtggtggctcacgcctgtaatcccagcactttgggaggtcgaggcgggtggatcacctgaggtcaggagttcaagaccagcctggccaacatggtgaaaccccatctctactataaacacaaaaattagccaggcgtggtgtcatacgtctgtaatcccagctactcaggaggctgaggcaggagaattacttaaacccaggaagcagaggttgcagtgagccaagatcgtgccattgcactccagcctgggtgacagagtgagacgctgtctcaaaaaaaaaaattgcaaattactcaatgcatcattgcttaaatcagcattattcagagactttaaacatgtataaaatcaatttttctgatgttataattcaaaactgttgactttgctttttttgcctgtgctttcagtaaagtaacttataaattaacgtctgtcctaaaatggacatgttttaggctaattgttgtataacccagatgggggaatttatctgtgcaaccaaagtaccagagtgtacagtataccaaggtcatttccatgtgagtgttcatgaaataagcatgaaaaaacagctaaaacttgcacctggcctggagtaggctgggctttttttctggaaaatcatttattcatttactttcaaactaagttgtcaagaaatttaagcctggtatggtgatgtgcatctgtagtcccagcctacttgagagtctgagggctcaaaaattatttgagcccaggagtttgagtccagccttggcaacatagcaagatcctatctcttgaaaaaaaaggaaaagaaaataattggtactcagccttcagcaaaaacagaatttcatgtttttggtggcaggaatctttattgaaaagagctttaatttttctgtaccatttcttaaaagtattaatgtttttccttaatagataaacatcattggaaaagctgaggaaagccaaattgtgaaggatggaacaatgtctctttccatctacatttgctcatgaatgataataattatcatattgtgggatttcccaaagtatgttcctcagaatgttaatagatgatcctcaaaaaaaatgggggttggctgacctggtggtgcacacctgtaatcctaacactttgagagtctgaggtgggaagattgcttgaggccaggagttcaagaccagcctggctaacatactgagaccctgtctgtacagaaaatttaaaaatgggctgggcatgatagtgtgtgcctatagtcctacctattagagaggctgaggtggcaggatcgtgtgacctaggagttcaaggctgtagtgagctatgattgtgccactgtactccagcctgggtgacagagtgagaatccatctttttttttttttttttatacacatgagggtctctggttaataaatgttgagatgtagggttaggtgagattaaacaggttctttttttcatgatttctcggagtctttatgatgctccacaccagtgcttctcaaagctgactgtgtatacaaaacactggggatctgacccacatgtaaagtctgatttctttggtctggggcaggcctgaaattctgcatttcttacaagttccaaagtgcagcctgcacaactggcacacagattacactttaagtaacaagattcttagggattttttaagaggaaccatgttctgccacatttcccagacttgctaaccataggaacctcattttgagatgctggaagttgtccgtggagcacactttgagaattttaaattgaatctttaaaattacacatgaattaatgtataatttaaatagaaatctcatgcagatcttctaggttatgattggccgaacagccccgtgtaaatcccaagacactgaaaaaatcatttagctagttcatgtagaaagaaaaaccagtatgggctaaaaagacaaccactaggtaagatagcaagtacactggattatatacttttcttttttttttttttttttaagacagagttccgctcttgttgcccaggctagagtgcagtggcacagtcttggctcaccacaacctctgccttccgggttcaagcgattctcctgcctcagcctcccgagcagctgggggattacaggcacttgccaccatgcctggctaattttttgtatttttaatagagacgggatttcaccatgttggccaggctggtctcgaacttctgacctcatgatccgcctgcctcagcctcccaaagtgctgagagtacaggcatgagccactgtgcccggcctacttttcttattttttaatagaccttataaatattgttaaatattcaagtctttaagcaattttactttgtttttattgcctctagtaattcacatataaattgccatatttctaaatccccatatgtgctctgctagtgatttcattagtctttaatctttgttaacactagcatttgatatgaaaaactaatgatgaaaacaaatcttttatttaaacagattgagatttgatatggtttaccataccctaattacaaatgacataaaacagcagtctagggaggtttttagaaatctattgaacctaaagcaaattttaaaataaaaaagctgaataaaattaattactatattatagatgggctttttcccacctgggttcttctgccccacctagaatagtgtcttcatttatgcattcctgttgaaactcttttgagcccctgccatctgtgtttcacctcttatttcctcatttatctcacactgcattttattgtagtttgttaatttgtcttgtgccttttagattgtaagttggatgggagttcagggtcttatttatctttgtacttttacacctggtttatagtgtggttggtacgtaagtagatcaataatacattaaataaataatattgttataagataatcctgggtagtagcacattcctgtgctacttgcacatacctgtactcccagcactttgagaggcccaggcgggtagataggttgagtctggggatttgagaccaaccctgggcaacatgatgacaccccgactctacaaaaaaaaaaatgaaaattagctcagtggtgtcgtgccactgtagtcccagctcctcgagaagctgagctgaggattgcctgagcctgagaggtcaaggctgcaatgagctaagatcccaccactgcattccagctggggtgacagagcgagaccctgtctcaaaaaaaaaacaaaagaaaataagataattttgtacatcagatattatactgaaaaaataagtttaaaatttttttctgtatccccgtcatctatcttgatggttatttcaggtagtattgacttattcagtgtgtaacaagccatcctaaatctcagtggctcaaacaacaatgagtttttaagttggcaaggaggttcttctggtctggcctaggctcagtcaggtgcctggagtcagctggtgactaggtcagggcaagactaagaaggcctgtcttacatattctgaggtcttggctcgaatggctgtgattgctgggctgtgtgtccatagcgtcttttaatcccaagttacgtcacagcttagtgatctcagggtttcaaaagaagctgttagtcctcttaagatttagcttcagatgttgcacaagatcacatctgccacattctgtgatcaaagcaagtcacatggccagtcccagattccaggggtggggcagtagatgctccctcctcctgcaattttgagagcagcaaaattgcagtcacctggaattactgtctacatatttcttccccctgagataaatgagaacactagtgtcatttcacttttatcagctcctcactcctctcatgttgagactacacagaaggtatgtaggtttaatcttcagttttcctaaatcatttgctttgcactgtttcttgtgtcctaaaccttcctctgtcatatttgttgttttgctgcagaatttccttttattcagcattatggttgggtgattttggttacagaacttccttttgttgaaacaaattctctgagtcctggtatgtcctaaaataccctttattttgccttcatatttgaatcataatttttggtcagtacttggaagctattgataaatctataattgagaaggtgtctgatgctaatttgattttatttgctttttccactatagtaacatatataattttttctttatccttggaacctagaaatttcaatggcttggtccagatgtagcttgtttcattcattttattcacttattgtctcattttaagtgatttgttttcagctctgggaattttcatttcttcttgtagtatttcttcttttttctcttttccaagaacttggagtaaacagatgtcattcctgcatctaagctctagtcaccaaactgttctttgatctttttgtaaaatctctctctttttttttttaattgttgtttctgagagaattatttaggtcactcttatgaaatactctgtttttaaaaattcattttgctattcatctcacgattaagatttcttttttatcctgtagctttttcttcaaggcttctggctgtttctctttcctacttacagttttcagttttaacactaaggatattagttctacctgttccactttactttcttctgtttggggaatttggtcccccctgggtgtcagtgtctgaggcctgctctgtctgaatctcttctctgccagtgacaaaatgcttgggcacttgcagggtaggcgctgaccacccagctgcactctctctccccttgattatcctgacattggccccaggcctgagagcctcaagtctgggatataccatactctgaacctcgagctctgtcacccaatgctccatcctctaaagccagcctttgcctctttgtgttatggtttcctctggttgccttaccaaaggtctatagcagttatctttctgacattttggcacgctgatgacatttttaaaatttctagactgactaattttcttatcttaaaaatgagaaaatgccttttctattatttcatggagttgtgagttggagaaaagttgaaatttatgctcatcttgcctcttcatccagttcccctccatcagagttttaattacattcttaactctattgattacctccatcctatctttgtatacccttaacattccaggtataactctgaatttgtcatgattttcatttcgtctcctcctagcatctatggtgctataaaggatcctgaatcctcagaaagaaaaaaaaaatgaacccgtagtacttttcaaaaagattttccttttttccttctttcctctatataagaagtaagatattttggggaaatgttgaaaatgcccatgtgtaattcgtgtttatcaagatagaatttccagttttcattaaccattttgcagtgctttccttgtgttataggggcaagtcaatgctgcataaggccagaggagcaccactcacataagacacagtgtgagcagcccagggtgccaacagtgttgactctggtgttatatgttaaccgtgtgttttattttcaaaaatcgttattgaatgttatacagggctgagggtattatattttgcaactttaacctcttattattgaagtggattccttctaggcatttatacatcgtaaaattatatttagtctagttttaaaaccagaagtagtttaattctattaaaagtgaataatctttagtatttaagttactaaatactattctatttatcatcactgaaatattctaaattatttgatttataaacttcgtctaatactgtatcatgtttattccgctatattattctttttccattctgtgagaaaactatgaaagtacataaaatatacatacaattaaaaatattgaaaagcaagcacatctatgtaagtgccgcccatgtcgggctagcactttagaagttcttcatgtgcctctctgagatcacagccccctctctccacagaggtagccactcctctgactttggtggtggtcatttccttgccacctatgcatgcgttcttagtaagcagagttttattttgcctattgttgaagtttacataaatggaatcccactgtttgtgttcttttgcaccttgcttcttttattcagtattacggttgacagtcatccttgttttatagagctttggttcattcatttattgctgaaagtgaaacacattgaatgaatatattacattgtatttatccattcttctgttaatagtcacttgagttgttagcaacctatcgccttcacaaagagtgctgccttgaacatatttctgtaactctccagatgcctatgtacaagagtgtctctacttaatcaggaatggaattacaggactacagagtgtacatgtcatcagctgcactagataatgccaaaatggattccaaggagtggttcccatttacactgtcatcagcagcatgggatagttaccattattccaggtcctcaccaaaatttgatactgttttgccattctggtgcttgtgtattgactactcattgcagtattaatgttcatttttctaattactaataaggttgagaacttcattattggtcatctagattttctcctcttcgtacaaaccttttgcttaattttttttaccagattatcttgcagtgatatttctagtgaaaaataaattcataatcaaaaacatttaactactatgcatagattattctcttgaactactatgctgtttggcacagagctctcttctaaacaaattcttgccaagaaatttgaattattttatgaaccgcctgattagaaggttagtatgcaactacctctaatcctcctaaagagttgcagcttttggttatgtttctatttctaggatattttaaaaatataactgcaaaaagtttatctgatactccttttagaattctagactcgataccatatgctcctgaagatgtttaacttttcaggcaaattcttaatttcctagtacttcattcttctgcaatatctgttccagtttcattataagtaaaacaaagaggaacttatgtttgctatatgatgatactcctagcaattttttctacttattattgttaaaatattttgttcatctaatgcttattttctacacttttatctgacattagtatctttacattttgaatcaaatttaaatattcacactttctttaacctttattttttattaatttgttcttaggcatcattattttgtcatatcagttttgaaattgtgtttctcatcaacatttttctgagtgttcataatgacaactatatgttatattccagacagctaactcaagaaaggaaaaataactggagtccaacttattttactaaaaaggtgaaataaagtgtacttggtatgctttcaccaaaaattattagtaaggcgagtagaagggaattaagtagagaaaaatccagtatttagttgatttgccatctctggaagatttaagacagatgattttgtggactattatcagctctggtaaaagagattacatatatattgaataataggttacacctatatattacatctataatatgccaagaaaaccttcagaagtcatactagagtatatgtggtctgcagccttgagcagaaaaattgcctgttaatcactgatagttgaatataagattaagatacatacatgcatacacaattatactgccagtttcacatatgagcctctttgtgttcaataaagattgtgatgaaaatgcacagctgtccatagtgaaccctcctctaaaacatgttttagaagcctcaaaagaattcagtctaatggtatgattttaaaaaaagagacctggagggggaggagccaagatggccgaataggaacagctccggtctacagctcccagcgtgagcgacgcagaagacgggtgatttctgcatttccatctgaggtaccgggttcatctctctagggagtgccagacagtgggcgcaggccagtgggtgtgcgcaccgtgcgcgagccaaagcagggcgaggcattgcctcacctgggaagcgcaaggggtcagggagttccctttccgagtcaaagaaaggggtgacggacgcacctggaaaatcgggtcactcccacccgaatactgcccttttcagaccggcttaaaaaacggcgcaccaccagactatatcccacacctggctcggagggtcctacgcccacggaatctcgctgattgctagcacagcagtctgagatcaaactgcaaggcagcagcgaggctgggggaggggtgcccgccattgcccaggcttgcttaggtaaacaaagcagcctcaaagctacaactgggtgggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagatggagatctgagaacgggcagactacctcctcaagtgggtccctgacccctgacccccgagcagcctaaccgggaggcacccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcacctctcctcctccaaaggaacgcagttcctcaccagcaacagaacaaagctggatggagaatgactttgacgagctgagagaagaaggtttcagacgatcaaattactctgagctacgggaggacattcaaaccaaaggcaaagaagttaaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagcaacggaagatgaaatgaatgaaatgaagcgagaagggaagtttagagaaaaaagaataaaaagaaatgagcaaagcctccaagaaatatgggactatgtgaaaagaccatatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggccgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggccagccctaaaagagctcctgaaggaagcactaaacatggaaaggaacaaccggtaccagccgctgcaaaatcatgccaaaatgtaaagagcatcgagactaggaagaaactgcatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctgaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatacacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataatgaaaatcagagcagaactgaaggaaatagagacacagaaaacccttcaaaaaatcaatgaatccaggagctggttttttgaaaggatcatcaaaattgatagaccgctagcaagactaataaagaaaaaaagagaggagaatcaaatagacacaataaaaaatgataaaggggatatcaccaccgatcccacagaaatacaaactaccatcagagaatactacaaacacctctacgcaaataaactagaaaatctagaagaaatggataaattcctcgacacgtacactctcccaagactaaaccaggaagaagttgaatctctgaatagaccaataacaggagctgaaattgtggcaataatcaatagtttaccaaccaaaaagagtccaggaccagatggattcacagccgaattctaccagagatacaaggaggaactggtaccattccttctgaaactattccaatgaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagctaatccaccatgatcaagtgggcttcatccctgggatgtaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcgatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatttacaaaaatcacaagcattcttatacgccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcgtgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaaggacaaagctggaagcatcacactacctgacttcaaactatactacaaggctacagtaacccaaacagcatggtactggtaccaaaacagagatatagatcaatggaacagaacagagccctcagaaataacgctgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacagaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagataccatctcacaccagttagaatggcaatcattaaaaagtcaggaaacaacaggtgctggagaggatgtgaagaaataggaacacttttacactgttggtgggactgtaaactagttcaaccattgtggaagtcagtgtggcgattcctcagggatctagaactagaaataccatttgacccagccatcccattactgggtatatacccaaatgactgtaaatcatgctgctataaagacacatgcacacgtatgtttattgcggcattattcacaatagcaaagacttggaaccaatccaaatgtccaacaatgatagactggattaagaaaacgtggcacatatacaccatggaatactatgcagccataaaaaatgatgatttcatgtcctttgtagggacatggatgaaattggaaaccttcattctcagtaaactatcgcaagaacaaaaaaccaaacaccacatattctcagtcataggtgggaattgaacaatgagatcacatggtcacaggaaggggaatatcacactctggggactgtggtggggtggggggagggggaggggtagcattgggagatatacctaatgctagatgacgagttagtgggtgcagcgcaccagcatggcacatgtatacatatgtaactaacctgcacaatgtgcacatgtaccctagaacttaaagtataataaaaaaaaaaaaagaaaagaaacttactaaatgaaaaaaaaaaaaaaaaagagacctgggcaaagaaaacattcattaagtaaaggctgggataaaatgagaacacagatatgcatacccacacatgtaagagttggtcacaggttcatctctgagctttgtatagccaaagagaaaacaagctaatgctacaatttccagtatcatccagcattccctcaggaaaagcccaggtcctggctttcaggtggctgatacagagacagtgttatacagtagacaacattctgaaaactcctgaggaacattcacatctgtttacaatgtagaacttgtttaatcttagtgttggcctcaagatttagagtttcctgtctctgccacacacagtgcagcatctcttctacactatccctcctgcaatcatcatcgagactctgattaaagatctctcatcatgggagtgtgctaccttcagaggcaatcagttctggaaattttaagcattttaccattagctccaaaaggaaaggcctccgttattgctccaacctttaattttgattccaaatataaagacagtaataatacaggttaatacacatttgttacaaaaccattagcttttagtctggctcttgggattatagcctaaaaagcctccttcagaggcttataggcatctgcctgtcaacattggatttctcttcttcaggtcaaactttcttttcttgttccattaactaccactctcatgtctcccagtgagctttgagctcataaaaaacaggagctgtgtcattcacatcctccctgtccccttgcctggaaataatgactggatccctttaacaccccactcatcatctcttgaatggatacagtgtgtgcattcctgttaatgtgctgcccttatctggaagtagttatgtcccaaggagcctgaaggaaaattgtaagctcacttaaacgcccttcctatcatcctagtgacttacatcaacacagcataagatcacttaggtttgggcagtcttgtttcacttatgattcactcattttgctcttgaacctgaaatgcctacatttctttcccaatatgctgctgagctaacctaaatacaggaccttgtatttattcccgttgtttttagtctcattagaggcagctcattactgcagtgtagcagtatattttttgtattttaattttatctccctctgccaaattccatattcttagtcattgaagaacttgtatatgacttgtattgatatcatggctaaaacatttggtagggttgggtcaaggtcagacctctggcattatgttagaaacctctataggttgatgtatttcattcagctgtttacagattgttgaagtcagcagttgcccttattccagccacatttctatgttaatgacaatgtgatggaggacttctaatatcatacacgccccactagagtttgggcaacactgcatttccatggttacgctgccacagacattaggccagcttaacatgacttttctgtggtgccccattttagttctcacaaatcacctcttggataaaatcctttaaagaatctcacccaagatctgtgtctagctctgtagtttgtaatgtgaagagtctaccttccctttttccaaaaacagccatggcattttcctccttccagttttctggcatgccttcattctctgtagaaccctcaaaaatggttcagcaacctatctgtaagctttcccaggtctcctgaatgtgatcagtcaaatcaagcaaattgaggtcactgagggaagcgtgaggcctaatttctcacagtctctttacgatagaagtactctttctttcttttttttttttttttttttttttgctagtggaatggagcaatatcattattctgtgactccagtcttagcttgatactttctaattcattaaatggtcttacaattatgaaaactacaagaaaatggataggaaaccttcataggtttataacttgtcagcacagtggtatccctcccctgccccatgttggttgtggcatattgagactgcttcagagataaggggtagggaagtgtctcacccttagtaacgacaggtaccattggctttgctcctcatctaatgactgttcatggttgcctgtggtgtgtcctaacctttgaggaatcagaatagatatcatccatgtctatgaaaatttcctctcctgccaagcttctcagcattatattagtttcttttacacagttataagctctctgaccctcctcctcttgactttagcattactcctttgcatttacatcttgccgtactctgccttgatcctatgttgctgcatcagctaggtgatgagccccctaatggtcaatgtccctgggagagtggtactcagaaagtgctcctctgggttcattggtcctgggaagcagggtcagcaagataaatactgtgaaattaagtatgatatcctcacagtgatgtaatacaattaccataatataattctatgtctttttaacagtaaggctccttctatattaataaataattacttccccagtgacatttctgtttctccttttctcaaattatctttgttcactgaatttttccttctttttcttcttacacattggttgtttcatattatactcttgacatttaaaatttttggttcttggcattatttgtttcactgttgcatagtaacatttttgttctttgcaaccatctgcttattttaaggtgtgtaatttttcaatggctggaatacttttatatctttacttgccttaaatgctaatctaggatctttgtgtagcatttttttcctttatagaccttagatcttctctttaatgagcacttgatacagaaagaagaaattttatttagttgataatattttgttttacatctcaataagcattccacatacactaaaaaatatagattgccataaaattattacattgtataaagaactagccatttttatcagtgaggaagtgaggctcagcaaggtagaaactccccccagggcacttaggttttcatcctactcatctcatgtctcaggatccttctattcatacttgagaagatcctgcctgcagttcaaagtctatctaggccttatgtgccatgaaaatgagagattgagaattcacttgctagatagagcaggcaagagaactcatgaggctggggaaatgcacagataaactaatcagacccactatccatttatgcctattaatatggcaagaataaaacaaccaccagcagaaacctgaaacttagaccctctccactaacatttaagccaggagagtagggaagaagatgggatctcagagggtgtgtacatctccccttttacttacggattattattttggaaacagaagactgatactgaaatttgagggaatggggtaacaagtcccagatcaagctatagaattgaagactgtggaagttaattgattataaatgaataataatagtagagtagtttgcaagagaaaactgaagaatgttgagaaaaatatttatagtctcagatgtccctatttgaatatacagagtgacacatctaaacagatagggtctctcgggcatcttaagacttggcgggatttgcctaatgactggaatgagactgaaaatatatcatccttcattcatgtattcatttatttagcaaacattaattgaataccatttaatgtgccaggcactaggctagtttcatggtatgataaagactgtactcactagaagacagagagactgatgtataaatgagttattaaaattttaataacattttacgctaatcatcgtttccccctattttccaaaactgtaggaagtccatatcaggtcagtaagtcttttgacaaacacactgctctcactatgtgttgtcttaggaaaggcattccatctgctgccaagaacctattcttctatcataagctatgggcctaaaaaatagattttcttttcaacaccacattcctagttattgttatctttgaataatcagattcttctaaagaaaccaagctagctataggactccaccaagggtgaccttgttgctagttattaatatgttatatttcttttaaataagcagacttttatttttaagccttctttaggttttaaactctttttttcttttctgttgcaaaaacctcttctgcaattggtaaaacattcttctcatgtcagttaacatttgtagatgtctttttgtgtgcatattactttgaaaacagacccctatagcaatctagaatgtttattatttagtttcttgataagttagtcatatttacttattggttacctgtttagaaaatttagcaatttcacaagtttttgatcatggtgtgtagactgtagtctactgtagttgctaggaaccatctgtaaagccttggttcctgcaagggagcccagaagaaagtgttaaccctttgcctgcttgattgcaggaggaatgccagctcctgagcaggcctcattggtggaggaggggcaaccacagacccgccaggaagctgcctccactggcccaggcatggaacccgagaccacagccaccactattctagcatccgtgaaggagcaggtacatcctcgtattgaaagttgcagtgaattatttctttaatgcctttaaaaaattaatctttggatatgttttaaatttgtgtaacgtccttgacgccttcacgttttctaattataaggtgtttacatccctgagtacattgggatgactggcatgtagagccgctccaggtgccagtcagaatcggaacatgcaggatacttgtgcgtctgcaagtaaggacaatctcgatggtgatcggtgtctctgtctctcccacattgcagagtgtgtgcatgcacgcaaagctgtgtaaagcatagttctcagtgctgacttttctatcaggactctggcaacctgaggcctgtaatagcgttaggtattttgaacattttaacataggtagtatataggattgtctctgtgatttttggataaaggctatatttgtgtgtttgtctaaatttaagtatattcattttgtgagctaatgttctaaaacttgtcgaactgtgccagtttgcttcaatgtcatgtttatgttgatttttttaaggcattaatactctttatccttcaaactcaagtaaccttctatattaggtcttatcagttgtgcttagagaaattggaattctgcgattttaatttcttaagatttcaaagcttaataaggtaaatgtaaatttaaagctccagggatggtttttttgtttttttttccctgcttcttctctccaaaacaacattatgtgtcccctgtgagggttattttgttgaaataatctaagattaagtttttttaaaacatcttataattaagccactagatgtttttttctcaagataggtaatgttgtatttgctgggatattcctttgaaagtcagtatcagtaactcaaatgatgaatgatgacgaagattgaggaaacatttattaccttattgttgtactatttttcgtaacttggaatgtggcatgaaagattgctctataaccgtgacacatgtctgacgttagaactgtgttttcaagaaaaattatttcagtttattctagtaacaagatgtcaacatttttttttattcctcaatgaaatttgaagtttttaaactttccacaaagagtttgagaagatgcaagatatagtcagtacaattttcatcttccaccaaactataaaatgtctaagcttctgttatctttaggagagaaaaaaggactcttcgatagcacttcatagttgtcaagatttgacccacggagccgttaagatgagaagcctcagatttatttggggctcttagtatatactgtgttttggtgaaacgtggtaaatttatcaaaatgtttagaaatgacttaaaactattaactgcgtgcagtaaacatagcaatgggaatgtctgtttgtaccttgagaccatataccctacatgtaagaaaataaggaaacttgttaagattttgacactagaattccttgatggcctcaaatgacttcaaaattttatcttctggcagtaaatagtgttctgaataagtattttgtgggaagtgctaagaagagttcagcttctcaaggcagccaaaaatgtattcatcttattcattaaaacagttattatatataattgtttagtttagtgggatgctatactctagtctttggttctgttcctatcctgagaaattggagttcattaatatatatttgccgtttcatacataatttcttttaaaaattgtaagtacttagcatttcagttgtttaacccaggataccacatctgtgtctttttccaagatactctcctggttttaaatagctcccctgcaatttttgtggcaccaggcaaaatatagttggaataaaaatttcttaagactctcctgaaatatgtcacttcctatcatctacccaatgggatagagcacagaaaagttagatccaagtaagaaaactaattaccattcaccttatatgtttgattttaaaatttactggtcagagtgtgacactcttagcccactgttacatgcaattgcaataaatgttggtcatgttttatatccaaaagagcaatattcttaaatgggatgcataattattattactttttagagctggggtcttgctctgttgcccaggatggagtacagtgtcaccttcttagctcactgcagcttcaaactcctgggctcaagcaatcctcccacctcagcctccctagtagctaggactacaggtgtgtgctaccgtgcccagctaatttttagtttttaatatttttttgtagagatgggggtctcactaccttgcctagactggtcttgaactcctggccgcatgcagtcctcctgcctcagcctctctaaagtgtgaggattataagtgtgagccagtgtacctggcccataattattatttttttaaaaagcgtcactgccatgccgtaatggtatccactctgtgatctcaaataacagaacttgcttagtggcagctgtgtcttaggaatgatatttccttaggtcacaaaaggaagggaccctatcaatgcaactgggtacataaaattctgttttctcttttaaccatgtgaccttggaaagatttcttaacctttctgttctcagtttgctcatttataagatgcagataataatagtgaggaccttaaattaacataggtaaaatgcttacaacagtacctggcacttagtaagggctaacattacgattgtcatcatcatttctgcataagaagaaaaggctcctcttaggaggagctagtggttctacttgtaaccatactaaagattcagtgagccctttttttggacattgatagcagaagacaaactttgaatattgagcactgtttatgctgtgacagtagtttacttatgcagacactaaactttaaaaacttcatattgatctcacaaaaactgtatacataaacatacaattttatgtatatgttatgagaaagagcatataaaaataagttttatgaacatgctaatttattgcaaccccaaacataatgtcaaggcacttggttaaggaattgcaaagtagtatcttataaaattaacctgaattttgagaggaaaagtctgggttcttcagtagagtatatctaagccagtaaaatacctcacacatactccccttgggcaattcatggtaagtggtaggaaaggaaatggcaagcaaccaatagcagtcttgttaacaaaccgttagtctattaaatatctgaaattggacatagagtgtcataaaacagtgaaatctttcttcactgggctatgctttccctagaatcctccagtgccagaagctagctgttccttgttctttggcataatgctagaatttataatgtcttttatgaagtgataacctctcacagtggtatcagtcatgtggatgcgtacctgcgaaggtacagaaaaatccttgctccttgacagaaagaatccttgctacttgtgttcaaacgctgcgtttttgatgaaacatacccagcctgaagtcaaatctctctcctgatctcttttagcactttatactactgccatgactcttaatagtatgcttctttggatttatataatcagttacctgaggatagagccgtgttttaggccttgttttatacctgtgttacaggttgctcctctcccagcaccttggatatattagacctgcaataaatggttgttcgagcagggaatgaatagataatacttactgtcgattactttgtcaccaacttgcggttttattaagataacagaacctgtagccacattcacagaaacattgtgagcaagagagtctcacagcacctagaaaacttgtcactcagccaaaccttcttaagacaatttgaattgcactatatccatattgataaaggatttaaattcaatctttgcttagtacaaaataaaattttatttcatatctatggtcaaataatgacataggtgtcataactttcatctcccgtctgtccaatttagtcgaaagttaagtttagggaataaaaggatgtggttatcttggtgatgtcacaaaatatccaccagtgttatgtgtatcaggtgatacgggtaactactaaagaaatgttaagaattatgctttaagagaaataaaaagtcaatccatgggaataacaaagtaatgtgattctgaaattacaggaagtatcagaacttcagccaccacctggctgtaattaggatcatcctttagcagattctactgttcagctcaactcctaataagaatccaggagtccatgatgaatacagatgtaggaaaggaggaatctcctaatagttttcaaaaatgtctgacaaacttgatactggttagtgcctagcttactctcttagttgtaataactagataaatacagcgctgggcatggtggttcatgcctgtaatcctagcactttgggaggctgaggtgggcagatggcttgagctcaggagttcaaggccagcctgggcaacatgacaaaaaccctgtctctacaaaaaatacaaaaaattggccaggtgtgatggtgtgcgcctgtggtcccagctactcaggagaatcacttgagtctgggaggtcaaggctgcagtaagccgtgatcatgccactgcactccagcctgggtgacagagcaagaacctgtctccaaaaaaagaaagaaaaatgtggtgccctcaaaggatcctgcctcttcctgtggaaaccttagattaaactgattgatttgtcattgaaatgcacagcacacccttggatgcagagaaattggaatttgataagacattcgctgcttatccagagccttgctgctgccctctgcaacttacttagatgggtcagaatgctcactcacaggcacaaggaaacagtgagccaagcatcatgtgcagggtattattatcaagtggtagaatacattgtagttttataatgattccaatatgatctcttggttttagaaacactctttaaaagagaacaatatggccaatcatggctaggatttgcaagtatctttcacaagtatctttgcaagttgatttctggttttgtagaattgcacatgtaatattcattagagttgttcatcttctgtcataaagttgcttgaataattgagatctctatttgaacttggtcatacttttcaggctctctaaccactttttttttttttttttttttttgagacagactctcgctctgtcatccaggctggagtgcagtggtgcgatcttggctcactgcaacctccgccttctgggttcaagcaactcttctgcctcagcctcccaagagtagctgagattacaggtgtctgccactacacccagttaatttttgtatttttagtagagacgaggtttctccatgttggccagactggtctcaaactcctgacctcaggtgatctgcccaccttggcctcccaaagtgctgggattacaggtgtgagccaccacacctggcccacaaaccacattcttatatttttggttaatgatttcagaagcttagaatctagatttaaggttgaggccaatccagatagcatgaactggtaagcaaagaatagatttggtaaaatatgctaattttatatgcactctttttactctggtgaggtctcaagttagatagtgtatgcttcttttgttatctttgatgagtgaaaattgcaatgttcctcatctgtgtggctcttaaagagaataccactttcaatatattttctggcttttgtgaaaataaccattctatcttcagtatgtccttattaacttaagtgatatttaaatatcaaagagtgaaatgagagccagagatccttaattttttgaagataaaataagaaaatctgaagcccaactgtgtcctattgatgttacttcatttttacatagatatcttagcttcagtaattacacacccttcctgtatggcaaaatgcccagaagtgaacaaattccagtacaattatttactttattcctctggaactgaaacaactcagctgttacacacctgcctttgtaacttccttttgtttggcccctatgcttattttcaatgaaatagtcctctctgacacacctcagccacatgcagaagagagaatttttatttcagctgtaaacaagcatagtttgtcacttaactagaagtcttgtgctgtaagtacaatgcctgaaacttctgatttttccaattggcaacttagttatttttccaattggtaactgaattatcctggcagttattgttaccgtgtaacccacagtgaagttttcagtgcctgaactgcagcatctaacccaagataagattggatctcagtggtttttgagggatcatcaaattttacagctttatctccataatattataaaaatgaggttcaaaatgaggacaaatggcagagccttgtgacactgtttggcttgtattcaagaattctgaactctaaaatggctctcaggagatcagtcctcttaagttgcatgtaccatggtcagaatttaacatttcccttcattttgttaacgatgcagggtgtcctccacctcaagcgtccctgtgattaaagaatactacagagtatggccaacaggtttattcagtatttgagtactgcccactcctcaaagaagttgtccttctcaacatcaaaaaattagactgccaagaggtagctaacaacaagcatatgcatttggctacctgcctacattttccgatagtctgatgaatgatcagatggaactgctagcaaagcttccagtcttatatgtcctcaactatatattcagaataacttagtatttgttctctttgatttcatcggaagcatcattttaggttgtattgacactgaggggtttgtttgaaagactgttctatgaacttgaacagactccatgtggctgttcacacataactggatcacacattcaaacatggaaaacatagtaggtgcccaaaatatttattagttaatgaactaaaaatgtaaacatgtttacagtgcctccatacttagattaagcttgcttttaattaattaaaaaatgtttatttaaagactactctgagcaaagcactttgtcaaggaatgggttgagggggataagtagacatataaagttgacctatttcatatagtttctactctcagaagaatgcagaggcacaaaccgtatttatacttcaatatagagtaattgacacattatgaatattcattaattgatgcataagagacaagaatgtgtgtacttttgcccccttttagtttaaacaggctatcagtatgtattatgtcagttttatgtaagtttgttaacttaggcatttttaggtttaatttttaccactgaattaccattagcttttatttacatttgaaagtaatagaatatttttgtttaatttttaccattgaattagcattgtttcgtttacatttgaaaatgatagaatatttttctttgttaacacttaaagccaaccatgactttatacctttaaaattataatttcctttttagttgaataatccagtttacaattcttttcagagttaaattatgaatatatggaataatttccccctgtatatgcaaactttatgctgttaaatttgaaatgagtgactgctgagttgatgagattaaatggatgagaggattattcagcattgaattctctgctttgcatgatcgtttttctttttagaatcacttctggagagaaaaatatttcggaaacatgtttttcccttcaggtataaccctaaagttattccgtagctattgcaaaacatagcctatccagtgcctatcttcatgtttaagggctcccaatttctaaattgccatttttgttactttgcaaaaatgtgtccatatggtctcacttcatctgtttatattttatgaatgtattgttcccaaagtgatcagatctgcttgtacctcagcaaagtaatttgggttatggctattttatttcaggcattcctaagaaagatcatttaaaatgtaaagttattttcagtagttcaaagacaaatctatttcttagcttatagaatcttaagagtttttatgtacccaaaccttaataatgtaggagttacacaaagtagaagcagtctgcaagcaaattgaaataacacattattgaaacttgaagacaaataacatcctatgcaattatattctatatatttcaaatatgaaaatagctataataaattaaaagtatacttagaatttcaatctctgtggctcttgaaagaaaatttaatttttcctttaaaaattggagttcaaagcatttcaatttatagactgtttagtgttttaacttgtagtctttttcttatgaaaattcctataaagcaacgcggcatcagtgaagtgttcatcgtgagttatcatctaccctaataggcatatatctcatttaaaaattttccccaaatcattctaagagcctaaaccaagattaaggtcttaaccactgcctatggccttctaataaactattctggcagaattaataactcttactatttcatccatatgtagtatttctgtattctggtattcctttagaaatgcctttccatcacaaagttgacatgagccatgatttctcttcttttgaaaatacttctgttaattattttcaaagtaagccctttatgcccaactgaagagtcaagtaacaccgtttttcattcataaccttagctgccttatacaccccatggtttaagtctaggactattggaagggatgctgcttactggagatttcccattgtcccactttctcatttgttccttaataagataagtaatattatttttctataatgtaagctcttaacagcaggatttttattttatttcagttagcaaagaataatgaaaaagcaaattttttaactatgatgtgaaaaaatatatcttagtgattgctgctgttgacattctaagctgattgattagaagatttgaaggcctgtaggtaagattatgaaaaatatttgtgtatttatgggtactgaacagaatgctgttgcatttcgctcatttgatctgcactacagaactgggcaaatgtgttttactgatgtggaataatttatctagttgaataatttttttttaaaagcaaactttttaacccaggataaaacttcagtttcccactgaaaacctttgtcagagttggagagtgctcttcttactttaaaaccagtagatcagaaatgcaaagaatggatcatctctgacaggtctgccattgtgcgaaaaaagacccttcattgctttactgggcctgctgctttttgatgcagctagattgctatctctgttctccttactactactaccaccaccaccactaccactattactactgcttctgctgctaccacaacaggaaacaaatgacaaatctagaaaaattgtaattgtgagtaagatatgagaatcagtgatctctatggaatagaaatccaataggagactaacagctaacaattattgagtacttactatgtatcagacattgtacttaattctataagtggtagattttctatgttccttatcacaaattttggggttaatgtagtaaaaaatctttcaggttattttggtcactgaacatttcatctcaatttctttgtgccatgagttttcgtacctttttcaactttgtgaggcaatatatagtcttgaactgtacaatatcctttcagttcagatttttttaaatttttggaatatttgcaaaatatacgtacaaatcgagcatctctagtccaaaatatctgaatgttggagcattttgaattttgggttttctggttaggaatgctcaacaggtatatatttggttatctttgtatttttgtggaatgtgttttagatatgcacatttggttacattagtggtagaggctaaaaagaggagaagggaccaaagaacaagaaatggaaaacacaagatcaaaattaggggacagtgacagcaacagctgatggtcttatgtcgggggaagagacagaacaactgcaagataggtccagaggctaatggtgtctccatgcagttgtgaatgttcatagtggtgctttcagtcatcaagaaaagtgtgtgctctgtatattctggttaataagtcagaaaataagtaataatactagagtagtatttgaaatcagaaaataaattggcatttgaaggataaactttggatatccagaaattataatcctgcagaacagctctttactcaaagatgagagaaatgaaaaattattaagtaatgcaaaggatcaaggtagccagttttcaaatgtaatgcattaaaaggtcgtaactcccttgggagaagagcactgagagaccagggtagttctccgtacgtggttactcttacccagaaaggcaaggtagaattttgttgttagaataataattagtgttcactgagcacttactatgggtatcactgtgcaggtgatgacatgtgtacctcatttaatttctcatcactttgcggttcaggaattatgaggattatctcatttgaaatgagaggaaactgaggtgtaaattgattgctaaagctgttgatagtcacacacaattcataagcaatcagcctgaattctcctccccacccctagtccaccaccactcacagagcttgtgctcttgccagggcttactagagccatgcttaagtgaagcaaaatcacttcctagctttgtggctccagggcagccagccaggtagtgtttccaagcctcagtctgcctgttagacagtggggataagagcaattagttgactgcctattacataggggcatcgtaagactcatgagaataaaggttcttagaaatccaaaaacaattttgtaaaaaggactgttataaagcattgttatggatatccttaagtcagcaaagtaaaaatacacttatttccttttgggaagtattatataacattatgcactaagaaataagaattagagtaatttaggcctaaatattgtcaaattagaaattttaatttggttttccccaccgtaagtattctcttatcttcccctcccccagctcaacaagaaaagtcctcgttatattgtattaatttcattctgatgatatgtaggctgcacaaaaaagacagcaagggtaatgaatttgcttcttacactgatcggtgaatatggtatgaattgaacatcccaccaggagccagaagatcctgtgctgtcattcagttgtctcttcaacctggtaaatgcagagtgtttctctgccactactccaacttatctgttatccatatgtgttggatgagttcatgttcctcatctgttggagctgcagaagacaaacactgtgtcaagagggcccttttttaactgcaggtggaaacagagcagtagccatgaagtgatatttaaggaagctagagcttaatgaatgaaagtcccctgtcccacctagagctatgtattctccaaggcctctcattcacaggactaggatttggttccatcctctgaatgtacagtgccattgggcacccagagatccagcacttgtatttttgagtccaaagtgtaaaagagagcaggcctaacctaagtctttcacttttttttttttttttttttttttttgagccactgggcacaaggcagttgggtattccttttgattagcttttgttagctcaggaggaagcctttcatcacttccccctttgggggctcagcttcctcaccaggcattctgggccttcactctctccctctgtactcccttctttgacaaaggtttccttttcctgttcccttagctttgtcctttttgcactttctgtaatcccaccagcagcagtgttcccttttgtttggaaataaggacgagaaagaaagggaggtggagaagttttaaaattttgagaaatgaataaatctgttcttttaagtcataaaccgctgaaggtcaggtgcccttgttaaatattgttgagcactaataaaatctcatgagcctaatacttttgatagagcatagctattagggagtctaagcagttgcagaggttaggattttcctaataatacttgcattcagttcataatcttatacttatttaaacctgtttctagtcacttttcatcatatccatgaataattacagctactcattcttatatccatatataactgcatatttaccccctaggtttatgcttgatttaaacctggtaccatagttattcctaattgtaaactgatgatgagatttcacatgtgtattgcataatttaattagtttagtgtttgtaaaaattctttgaaggtaaaatattttcataaatgccaagaattatgattacttttgttatgtaatttctaagactcaatttctcttgcatatagttcctctcttaaggaaggtttatatacagtgccttttaaaaatatttcaaaattggaagcatatttttggttgtagtagatactgaattattcttgctggtttgaatcttgaagaaaatgaaatgtaaattcagattaaattggtatctctttagtacccagaatatgtttttgacatttggatactgcccattaaattctttgtatttgactgtctgaaatgtattctgaatttgtgtatctgttctgggttttatttgaactgaattttagttaagtaaagaattttagtatactttaagtggtattaaataaaatgaaaaagactgatttcaaatattaatctttttagattcttttgccatatgttcttttcccaatttattttgtcatatagtttccatttgttcaaacgtcatttttcttcagatttttgctttattctctttgcaagattatgaaaactgtctcttctgtaactgctttcagagtgaagcctgcaaacaggaaatgcccaggtaaagatggttagatggcacaaatagtaagcactgcatatttaaacctgatgcttttgaaatcttctttttttaagtaatcacaagatatttgggagtttggttgtccttctcagtacacaggaaagaaacgtgaaattttggttgagagaagtagcaccatagggcatgagccaaaaaatgtagcagtaggcagcccaagagaggtgtcaaattcaaactaatttcacttttgagaacaagatttcctctcagacagtgcagctcagaggatagaagataagcatagaaaaacagcatgggatctttgaggtgggcacaggttaaggataaagagcaaggggatgtgatttacagacatagagacagtacgaaaccaggcctggtgcattgcagaaatgctgaaatctcaaagttgagagaagaaaaggtcagaggattggcttcacagagaggctacagtaagtaaaaaggcctcttttttatgcagtaagataagaagtagaaggtacacacactggaaaggaaaagtgaaactctgtttttcacaaaggatattattgtatatatagaaaattcttaagcaggaaggagcaaactatagcctacagtctaaattcagtctaccacctatttttgtatcacctatgacctaagatgacttttacatttttgggccatgggggggcagtggtaagtgtaagatggcacaaccatgttggaaaacaatttgataattttttgtaaagttaaacacatttaccctatggcccagcagttctcctgggtcacacctaagaataaaagaaaaagtatgtccacacaaaaacttgtctagaatgttcatagcactgttattcacaaatacccaccaaactagaaaccacttaattatctgtcactgggtgaattaataaattatattcataacatacaacaagaaaaaagaacccaaccattgatacatgcaccatggatgaatctcaaaaatctgctgagtgaaggaagtaagccaaacataaaagagtacgtactgatttactccattgatagaaattttagagcaggcagaattaatctgtaacaacagaaagcaagtccatgattgctggggaacaaagggaggggcagtactgcaaagaagctaaggcaattttgcggggtggtggcatgaccaaaatattctgaatctaattggagctgtggctcgttgttgtgtacatttagtaaaacccctaacgctgtgcctttaaaatgggtgcattttattgcatgtaagttatatctcaataaagttgactttttaaaacacattaacatgtttttaagaatcacagtaagaccctggcttaaactagattatcggcttccatagagcacagactcttggatagacactgttttacaaaactccagtatgcagcttaatattgggcactcataaaatatttttgagcagacacctgagtgaaagaaacaagaccacacattaggctgagcgtcgaggagtgaagctccgtgaagtcggccaacaaggctcaagaccggagttcaagtctgtgctgaggctgggtgaagctgttggatataaaaattttgttttagatttgttcatcttaacatttatttttctattggagaaaaatatgtgcaatgtaatccactatgactagaataaagccttttgaatggcagacagggattcagacaattaactgcctgtggagtactctgtacaggaaacaattttactgaaataacataaggagcctgtattggtagttttaataaaatcaagcctgactcatctatttgaggaccaggattatggaaataacatcttatgcttcaagagtattttaagattggaacagttatactcatatttatgaaaaaacaaaatttgtgcataagtaaaattttaaccctgtggaaaaatttaatatttttatttggcttctttatgttaaccctgaagaaattcctttagattattcaacttcataaatgttaagtttcactcctccagccacccaagatgccaaaaggaaagaaggccaaggggaagaaggtggccctggcccctgttgttgcagagaagcaggaggccaagaaagtgatggatcccctgtttgagaaaagacctgagaattttggcattggataggacatctagcccaaatgggatcttaacccactttgtcaaatgcccctgctactacatcaggttgcagcagcaaagagctgtcctctatccagagctgaaagtgcctcttgcgatgaaccagttcaccccggccgtggaccgccaagcagctactcagctgcttaagctggcccataagtactgaccagagacaaagcaagagaagaagcagagacttggcctgggctgagaagaaagctgccagcaaagggaacatccccattaagagaccacctgtccttcgagtaggggttaacattgtcaccacctttggagaacaagaaggctcagctggtggtgatcgcacatgacatggatcccattgagccagttgtcttcctgcttgccttatgtcctaaaatgggggtccttgactgcattatcaaggggaaggcaagcctgggatgtctgtgcataggaagaccctgcaccactgttgccttcacacaggttaacttggaagacaaaggagcttcggttagctggtggaaactatcaggaccaattacaatgatagatatgatgagatccgccatcactggggaggcagtgtcctgggttccaagtctgtggcttgctttgccaagctggaaagggcaaacgctaaaggacttgccactaaactgggttaaatgtacacggttgagttttctgcacataaaaataacaaaaattctccttccaaaaataaattaagttttcagtattatcagaatggtacttttacaggggtggatcatattttatttcatgtctaaaaaataggcttgagtcagtgtagtctgctttttaatccttttaaattttatttataatatttttcagagtttttgggaaatcgtttagtggcccttcacctacgcccctgtgagggacgagtgctttggttgaatatgttccttcccaccgccacccctagatttagacctctttccccaccctttgctattccacacactaagggctgctgggcctgcaggtggttaggtgccattgcccctctgcttggaattcaaaacagagaactttttttcttataatattttaataagcagagggaggaggtaaagattgattcaactgaatagcccagtattttaatcttccgtgttgaccagtatggaaagggtcattaatattccaacgctcatattttgcatttattcacaaaagtttaaaaagttttcttgatttaattccgatgattttattgaagggatagtagtttattttcataaaacatgtttttttccattattgcttaaattctgtgaatttacagaaacaaaacatttaggttgtgaaaactacttaagattatgcctaataaatgcatggttgtagttttaaaattattcaacctaatgtaagtaatattttatctcatagcagtgtcgctaatgggagtagtattgtccaacataggagggtcaggcacagacggaagatcaaaatctcactctcctgaggctccatctatggctctgctctctaaagaaggttacatttatagatctctcagaataaaacattacttttctgccaagaagaagttaaacaatctattaatgtggaaaaatgttgcttcaaacacagaagtctatttgtaatgtgtatcaaagtggattcatgaatgaatctatagcagtattttgccagagttgtaagaatgtcacttatagcttacaaagtcataacttaataaaaagaaaatatggacatgtgtgttaatgtttttaaaggcaagcttactgaggtataatttatgtaaaataaaatttaatgagttttgacaaatgaatgtagtcatgtaaccataatcaatatatacaacattttcatcaccccagaaaatgttctgtaaagcagttttcaaacggtggttgtgagtccttggacaaacagtgtgacccaacaagcactttaccaccagggctgactccctgatggggtgtgatttctagtcctgctgtttggctgcactctcagcaaaggtggcaacttgggatcatgttaatgtaagacactgtctgttctgatagactggtggggcctgtctacttctcagacttaatggagaattcctgcaattctatgtcccagtgagaaacagtgtttgaaactttttatcactcaagttctcaaactgtggattttacatttgtgcaggattggacatttattgatttaggtacatttacgaagtaatatttattgttagtttagaattacaaaatgaataatttgagagaaagcttataaatgtctgggaaacaaatgtggtgcccttccgggaatttacaacctaggcaacctggccttttaaagatacacataacagagaaagaagactacattgccttgctgtgttatttatgttttttaatataaaatatgtgaccatatattcaaattactatgcatgaatcaccatttttagaataagattttacaaatacagttacttagttgtcattattattttcactattaagtattaattattattctgtaatgtaactctgatttgcttttaggcttacgtggaaaagaatagtaagaatcctatcagacctgtggtctttgggtcaactttataaaagtaattagagctattaaataggcacacagttttatttggccattaaagctctagacagaaaaccccaaactgtttgcctctaggttgttagagaaaaaaacattaattagcattaccattgcttctctgaatcttccctcttccctgtagtggacagtgcaagtgggggtgccaattgctagactgtgaagcgattcccaaggtaattgatcatattgacagaaacttagctgcctgttgctctactaaaaccatctcagttagcattcccccttctggtattcaatcaccctcgcccttcctcaacctaaagactgaaacataaccaagagttaaaagagataacagccatttatttactctaactcctaagggaaaatagtattttcctaaagagtaatttctaaaataaaggcatatctgtttctaaaatatttttactttatgcagaagtattttttaaatctttgcaactatttatatttgctaatttaccagtacttattctacttagctgtaccatcaacctcatttttaaaattatgtttaaaagttaattatacttattcgtaagtgaaaaaatcaaaataagtatctcacatttacatattagcttcagaaaagtaattttgcagcttttgcaatattaagtagtaattttgaaacaactataacttttttatagacaggatagtcttattataaattaatatgctgtctctctaaactgattgtgggaggcagaataatgctctcctccccagagatttattatcccaacgcttggagcctataaacgttatcttatttcaaaactttatgggtgtaaataagttaaaaaatcatgagatggggagattatcctggattatccaggtgagttctaaatgccatcacaagtatctgtctatgagagaggcagagagagacacacgagaaggctctgtgaaggtggaggcagggattggagtgatgtggctgcaagccagggaatgccagctgtccccagagcctgtaaggggcaaagaagaggtttttccctacagcctctggaatgagtacgtcccagcttacaccttgatttcggcccagtgaaaatgatttctgatttctggtttctagaactgtgagaataaatttttgttgttctattccaccaggtttgtggtgattcgttatagcagccataggatgctactacagagtttggcatcaggaaggggagtctgctgtaacaaatacctaaaaatgtggaattgctgtggaattggataatgggtagagtctggaataatttttagccccatgatagggaaagcctagattgctttaaacaaaacgttggtagaaatgtgggtattaaaggtggttctggtgagagctagaaggaaatgaggaatacgtaattggaaactagaggaaagaaaggtgattcttaatatttacaggcataccttggtgatactggttcagtactagaccaccgcaataaagctaatattccaataaagtgagacataaatttttttggtttcccagtgcacataaaagttatgtttacactatactgtagtctattaccttatgtctaaaaaccaatgtacatgcgttatgtctaaaaaccaatgtacatgccttaatttaaaactgtattgctaaaaatgctagtgaaataagcacatattgttggaaaaaaatgtgccagtagacttgctcaactcagggtttccacagaccttcaatttgtaaaagatgcgatagccacagagagtaatgaagcgaagtgcagtgaaacaagatatgccaatactggtagaaaacttagctgaattgtctctcccagtcctgtagaaagcatgtaaatgatggacttggatatttaggtaaagagatttccaagcagagcgtagaaggtacagcctggtttcttcttgctgctaataacaaaatgtgagaggaaaaacaaatcaaggggaaacctctcaagcaaaaatgaatcacagtttgataatttggaaaattctcagcctatccaggttgcaaaaaatggtaaaattaggagattcacttttaggaaagtgctccagagagaacgccaaggatgtagataacctttgactagtgctgaagatatcaggcatgtgactccgcagaaatcaggagtggagatgaaattttccagggaagatctgtggatgacccacttgtttaatggcacaaatacacaggaaacccacaagttttttgaaaatgttgtatcagcaaaaatgctgccagcttgaactgaaaaggacagagacaggttgaaatataggaaagctgttagacttcccaaactgtacaggcttgtcaaaacagtgctcagttgcaaatatgtggtccccttaaagaaaaggaaaaatgacttcaaggatacagctttggcctagagtcatagtctcagactttaaaccttgtcccgctgggttttgaaattatttgggaaaggtggctcctttattctttacatttttttttccttttggaatgggagtgtcataactattatcctatgtctatcccaccactgtattttggaagcagataacttatcttttagcttcacagaatcaatagttggagaagaattttgctccaggatgtattatactcaagtctcccctgtacctgatttggatgtttagatgatgagatttgggatttttgagtgatgaaatttatgtgagatttgacccttctagttgatgctgtaatggtttgagacttttggagatgttggaatgggttgcatgtatttgggacatgggacagacatgaatttatttctttaacatctggttattctcctgccctctgtgttctcaagctaagtaggtggggtcagcattctccttgccccccggttgttgcctgcctttacacgtccctggctcctttgagacttccatgcctggctttaccatgcttcctcctctctcctgacattcagtagccttctggcactcactgtcattcgctgaagattcagctcatggccaccttctccagttcacctcctgctgtgggtctccaggtgacttcagtatctacctagacagcccatccagtctctggtagggcagtcccttggctttctcatcttgcatttcctttagacattatattcttaggccacaaactcctgtccttcagttcactttcttagtattcactcagaaataattattattattattatttttttttttttttgagacggagtctagctctgttgcccaggctggagtgcagtggtgcaatcttggctcactgcaagctccgccttccaggttcacaccattctcctgtctcagcctcccgagtagctgggactacaggtgcccgccaccatgccaggctaattttttgtatttttagtaaagacggggtttcaccgtgttagccaggatggtctcgatctcctgacctcgtgatccgcctgcgtcagcctcccaaagtgctgggattgcaggcgtgagccactgcgccctgccagaaatgattcttcatcaaaaattgctatccattggtcttgccactttctctatacctcaagcaaccctactcttaatataccaaactcttacggcccaagaatagggaaggtagtttctttagataaaaatcaaaatgccacacctagaagaaaggtacaaagatgttaggtagcaagaacaacaggggtccactacataatacttgcacagtgcatgtttctgttatgattatttgctatttacttgtttaaataatcctgaatattttaatatgaatagcttccaaagaatatatctcttcttaaaagccatgtttaaacattagtacatgttttatttagtgaaatgatattttctaattgttctccaggtagttgaggaagcttcccaggctcctaagaaggcaacatgcaacatcagcaaaaatgatctgtaccaatccctagtgacctgtaccagtcttatgtaaattatgagtgcttataaagtaattaaggtttgagttgttcagtccgttctttttctctgaagcctgtctgtggtgtctttgtaattgtgagccagctattctcctgcctagcaggctttagggacaccacctttcccatacatgtgtatattaaagaaatgttagctcatcttaataataaagcaaaatgtaattagatctgctacagaaacatcatactctgcactacaaatataagtgtaaataatttggagtagacacacaccactggatagctctattagcatcaataactaagaattggttgtataaaaatagccttacataaatgcttctctgttctttgatttaaatatttctgaaatgttttactgcctgcaacacaatttatacccaagtgtgggaaatgtttgttaaatgtcttgtatttggatgtgaagatggatggtaatagtacttcacactcatctggatttgcctttggttgattttctgattgtcatgggttttgtccatgccacctgtatcctcacctggtctcacttttgatcatgatataattcgtagggtggctgacagtttgagttgtacaacccacagacataaactggttttttcttctgtggcctatttttttgtttgttctcaaaataccatcccagctgagttaataggccaagtccaagtataatctactctgagactgagcttggttttttccatagcttgcttattttggccactgctgatctaactcaagatactttaaaactcttgatcaaattctaaggacagggcatttatattctgtcataattaacagtgaacgattaaagacatttatgaattagagccaagattcaatatttactagtgataaagggcaatgtcttatttatcacattattacactgtgacattggcaagttttgaaatagcttaaagatgtctgccttattttctaaataagagggaaatgggctacaaacaaacacatctcagtgtgattgtatgtgtgaaaaatatcttcatatcgggtagtttagtttttaaagttcattcagtacactaatggcttacaatttagtttaacagctcggtgtgttgtaatcaagagtgtgaagaggcaatcaaatacttctctgagattctgctccccaaagaattcctggcaagcctgttgctatggtgcagtctcacctgggacttgtttggtatctttctcaattagatatattgacaaaaatgagcttaaaaacagaactcatagaaaatccagaatggagaaatacggatagataaatgaagcattgtggctctttctctcttttttttttttttttaacttgtacttaccaattcttgtttctgatcccaggagtcttaagatatgccaaagatactactttctcactgtaacggatgctggatgtcatagaaggcactgtttatcagatgagaaactgtgaagatgatcatctctaaaaccctgcaaactagattttctgcacccacagctgcttccctggaactttggcagctgtgataattgttgcagaccatccctgtttggtactgccattgtatttagataatgtcaaagaaaggcttatgagtcagttattaaattgaaggagatgatcacgtcagagtaaagccaggtagtgagacctctgttggattacttaggcttatattgtttttaagagattattatcttgccccctccaccttgaaatcaatttcatttccacaccctgaagatcatggcatggggctgaaagacagagtgataaagagcatcaactctggagtcacaccttctaactgcatatccctgccatgtcatctacttggtgtagccttagacattcatgatctacacctctaaaatgagattaatagtaatatattcctcgtggggttattgtagaatttaaataaaagatgcctctcccatagaaattattcactgggtgttggctatattcacacttttgatatgcatagaaagccttagtatatagtatgtggctcattgtatgcacttaatgaataatagccagtaatactattatcatgataccttacctgagtctgtgtcagatgtagacttactgaaaacacaggaggaaatgtaagggaatggctaaaatttgactttatcataaattgtagttgtatgaatgaatgagctggggtagtgaaccagaaaacatcaagtcattctatatactgtcctgaattatatacatgcaaggtttctgggactaaagtcatcctagcagcctttgcagtgaaaatgttgctgttcttaaatccagctaagtacatgctattttaaaacacagtgtttttcaagtgaacttaatgtgtgctgctgagaaaatgccaagttttgccagatcctgtatttttacctgttgtttgatatttatgtcattcataacataatactattaaaatgctttgtttttattgtaatgctttagttcattttaaaagataagtgtcacagatgtatagtaaagtgataacttaggtttagatccaaggagaatgagagatggaacaggacctgtttacgtttgtgtgtggaaggtgatggagctatctaagaggatgcttgggtttgaagaaggcagctggttacagattgctagaatttgtgagagtaaactgatgttctgcatgtgtgtaccttgaggtgattgtggatcatccccaagaagagacccattagatagctggacacatggacttggaccttggtcaggaagatctaggtcaaagttgtcgatatgagatccacaaccacatagttgttacttgaagccatgggagcagcagaggcatgaagaacacaggccctagggtgatcctcagggaatctagtccccattctttcccctgtgcaccatatgaccatggctctatctcctctgaataataagtgttaacagttcctacttcataggcacaattacagagatatcattgcctttcaatcaatttgatttaaaggcttagaataacaggtagcacatagtacatgcttttagtacatttcggccgatgctactatcactattattattgagggactcacccagggaaaatgtctagagcaagtagaaaactggaaaaagcagtatttacaagaggtggggaaggaacaggattctatgaaggagacagtatagccagaggaggcagggtgggcaaaaaatagaaggtgatatctgtgaagccaaaggaaggatgaatgtcagggaggaagtcatcagtgattttgaaggatgcagaaaggtcagggtagatagatggagaacagaaaagtgccttttggatgtagccaccaagaaatggttagtaaccttggagagaacagttggtacagagtttagagcagcagccagatgacagagttgaagagaaaatgagacctgaataagtggagagcccttgaaataagtgtgtctggaaagggaaacaggaactgtctgaagtaaaggactggggaattggggtgctgtcaagagagtgatgcgatggtcaggctgaatatggaaatacataaagaggagaaggtgaaggtgtcatgggtacagggagtgggtactattgcaggctgtggaagttctgagtagtttaggaggtccccaagcaaaatgagtaagggaggatcagggtcagtgcttcagtagaaggtttccctttggaaaccacggtgcctcctgagtgaatgggaggactttggaaaaagctggccacagctacattggtggtacttcagagaaaagtctcacctggtatgtaggatgttgggttagttttttctcttcatcttttgtgggaaaccgcagactctcatgaatggaaggccttgtctgtttttagatttcaggctccagtgtgagttgtaaggatcctaggatatttcttgtgaagagcaaaaattgcccagtgaagtattgattcctttatggttcctggccctgttcacagatccacttttctcgccactagtcccaagagaattgggatcaacccatagcttgctctgtggtgatcctttctacagcccctttaattcactttgctgatgaattcagaaggttgtgggtctcggtggtagactgtgttgtcctttctttccaaagggacccagtcttctaaccctgttaacacacatgcctgagggaggcaggcaggcactgtcccaggcattaaggttgatgatatccctggggaaggtatgggccagtgtgctggcctctgcttacaggagcctcaagccctacgcaggaaccctgacctagcctggcactctgcggaggacttacaccaagcattcagtttagagatggcattctcttgcaattgcggcttcctgcttctggaaggacagaagacagttatggaagtaagcttgatcttttcctgtgtattaactggaggtagggaattgttaccatgaaaactgcccagagtaccttcagaaaacaagggcagagttttttttgttttttagtgttttcataaaatagacaaaggaaaggaatttcttaaaagagtaatatgatgggaaatactgaattaagactttgggttgctttaaatcagtatctgaatattaaagagcaacacaaatgtacccaccatccctgtactggcccttttttttttgaggcagagtctcactctttctcccaggctggagtgcagtggcgcgatcttggctcactgcaacctccatctcctggattcaagtgattctcctgcctcagcgtcccgagtagctgggattacagtcatgcaccaccacgcctggctaatttttgtatttttagtagagaaagggtttcaccatgttggccagggtggtcttgaactcctggcctcaagtgatctgccctcctcagcctcccaaagtgctaggattacaggcgtgagccaccgtgcctggctggcattgatattttgctatctgcaggctggctatataaagaaatcatgcattttaattttgtaagggttgtaagagtgcctaatttgtgtaaatttcttgctttgaaattaaataaatagagcattatggctgtagcaaaaaggaaccactatttttctcactcatttgtcatgagtggtgcttcagccactacttccttcttgtgattttatgtaaaaaaaaaatggatcttctgtatatgaagtttaagaggaaagaacaaaaaatgacattgagaacaaaaaagggttattgagaacagaatatgatcagaagataaaagaggtaaattattaactaagtgtcatgataacattgtacaatgctaagagcttagtaaaaatggaatccaaggcatctgtctatggcagaaattacttaatttttttttctctacttaggaaatgaaaatatatttccaaatttttggcaagtgaacctcttaggaaagaacgtggtatattaaaaaaataaaaatttatattttactttatcatgcctaactctttaaaaaatagctcacagcatttagcattttgttcatgtacttcacacccaactcctctgatgtggttgttactcccattttacaagtgattaaactggggtttacagatgtttaagtgacttgtctaatattatatagctagtaagtgacagagcctagcgtcagatccaagttgataccaaaatcctataatccttccatatttgttctaatctttgtcaaatcgtatgcctttaaagaggcttacaagttgttaaactacaggacaggtggcctaccggctgaatctggccctcgcctgttttttatagcctgcaagctaagaatgttttatacaatttttaatggttaaaaaataatcaaaggcagaatatttgatgacgcctgaaaattagatgaaatcaaatttcagtttccatatatattataaaatcttactggaacacaggcacactcgtcatttatgtttatggctgcttttgcactcccaggtcaaaggtgagtagttgtgacacagacctgtgctatggtccacaaagcctaaaatatttactgtgtatctggccttttctagaaaaagtttgccaactgctgctctaggatattagaacaaaaatctgtgataagaagttttgtatggggcccgaaagcttgttaaagctctcacacaccttaggtcttttgatcatttcagcagccagcaatgcagatggtgttgccttgttgaaccaatggggaatggatgccaagccctgtggtctcatcagcaccatgcagtttgtttatgttcactgactttctaggtgcctacttttatttggcatcttaaaacagggatttgttttgacccttcagcttgaatgttttaatccaattccctgacttccttgaagagaaacttcatatctaatttagaccacctctgctctgtggccccaggccgacttcccaggttacatgagtgctcgtcgcactttgttatgattgtggagcgcaggcactggtgttgcctctgcttttccctctttctctctacccatcgcagtgtttaaacaaatgaatgtataatcaagtcagtctttttttttttttaatttaagttctagggtacatgtgcacaacatgctggtttgttacataggtatacatgtgacatgttggtttgctgcatccatcaacattaggtatttctcccaatgccatccctccccacagccccccaccccccgacaggccccggtgtgtgatgctccccgccctgtgtccaagtgttctcataatcaagtcagtcgtttaaattacagaagaaaaagtcatagaactgttttcatcctgggagataaggcctttcactattgaattttgtgaaagttagtagtttcttgatgggaaaagaagccaggagaggagaaaatagaaatatgaattttaagatatgttttgttgcagaatttggcttaagttttgtatagacttttgggactttaaaaaaatacataaaaataacccaagttgtttttaatgacaagttgtttctattggcagtccattgacagatgaatggataaacaaaatgtggcatatatattgcgatggaatatttatccttaaaaaggaagtaaattctgtaaaccttgaggacattatgctaagtgaaataatgccaatcacaaaaagacaaatagtatatacataatttcatttatacaaggtgcctagagtagtcgaattcatagagacagaaagcacagtggtggttgccagaggctgggtagaagaggtaactgggagttgttttttcagtttgggatgatgaaaaagttctggagatggatgatggtgatggttgcacaacaatgtgaatatacttaaagccctgtacaattaaaaatggttaaagtgttacattttgttagcatatattttgtcacagtaaaaatatatacatacatcatcacctgtttaaaatatcatgtctactttgaatacctaatcaaaattatgtattacaaaagaatgattactctttcaaactatttgtttatcaaatgaaaaatttactatgtgatacatggtatcgaagtgattcagccctaacatgattcaaaatttaaagttaattgggtcctcttgcgtgttttattttcaaagcatatttatataaaatttttaagaatgattaggtagatataagattacggttgattatcagttgctctttccttccttactgattagcaatttatggaagaaattaattaaaaccgtagagtaagccaaaaagcatctttctaaagataccagttctttattaaatcctgtggagtttccagagaaatacatacagtagaatctattaaagcaaacagttcattttacagcatatatatttaagatgttatatatttcatgcccttcatgaaaattaattcttaaaacattttctttgataggtcagaattggaacatttaactattagtaaaaattgggattgtagtgtggttttacgtacgcaaacaactcttactctattttatttacaaaaattaataacaaaaataaatgcccaaggtagagggaattaaatactcagaagtataaaatgaaaagtaagccaccctacaggcatccagtcccatttcccaaaggttaaaacttcctctaaagttaagttttttgagtatacatcaagaaaaaatttatttctgcatattctagcatagatgtctttttaaaaacaactgcctggctttattttcctgcataatctttcttaaacatattctgtatcagcacatttggatttacttcaatcctttctagcaattgcatggaatcctattatgtagatgtatatatatatttagctattcccattttgatgattattgggttgtttccagttttatttggttggttggttttgtgtacttttccaagtatatcacaacctcagcattggaactaatgggacaacaggtaggtatgtaatatttacctttttttttggtattgttaaattgccccaccaagagtttgtactagtgtacattcctgctacaccatttcttcatagcatcaccaatgctgtgtactttcgaatctgatgtgttgtttccaattgttagaataggccataataggttattggaatattattgaacactgttagcatactttaatggcttcagaaaagcaaaaatatcagttgtccactcaatcagaataccacgttcgaggaattgacagtttcctcagcaggtttgtcctggtacatgcaaataatacttcgtgtcttttcttttctttctgcttaattttctgaattcaattttaattacagaaattgtgttgtaacaagtgatacaattaaaagagataatataaaagtgtaaataattgtaaatataaaataatataataatgtaatataaaagtataaatagattggtcacccttctgaggtgaccaatcatactgatctgctgtgtctcattcacagttgtgtctgtgttcaaacaaacctatgtaggctttgggtttttaaattttgttgtgttttactcagttcttcagttgactttttaacataatcatatataatggtccttctgaagcaacagataagagtccaactcattcttttgaataaggatatagtatgctgtagaatggagatgccatcgtttgttacaatattactatgtggatggacattcaaattgtttcaaatgatgctgcaattactgtttaatatataccattgcttttatttctgtagactagatttccaagtggggatggcagggcatgaggaatatggctttttaattttaataggtattaccagattgtttcctcaaagtgttatagcagatcccactcccatgaacagtacgtgtaagtgcccatttccccccagttcctcaccagccctggctgttaaccgcttttttaaatgtttgccagtatgatgaaaaatgacatctcattgttatttgattttctttttccttactaatgaaagtgagcaatgtgtgcatgtgtgtgtatagtttgaggtggtaatctagctttgttttctctacttaacaacagcagtacttttcccattgaatgaaatttcccctttgtcattagttaagttcccatgtatacttgcatctggctctttaattcttatttaattgcagggttttatttgatttgagaagaatgttttgaagtaataaagtcaattacagttctaaatataacctttagcaacagaaaatgacataaccttaatttttcagcttcctataatggaaagagcaagaatttagaatttcagtccaactcttcacttactaattcgtgtgaccttgggcaagtcatttactttgcccctcccattttaggattgctcaattcaaaactgtgttgctttttaaggattagagaaaatataaatagagtgcccgacccacagatggcattcattcagtactgcccgatattattatttttgttatgacttaaaaggaaagttagacatttgatattaaattgtgcccattccaaacataagcaaatatatttcttcataagggaggatgtattttatgcaagagaaaaagaattctcaatatggcaatttaaagattcttttggtcaaataaattagtctgaacaacgtatatattcaaatctggaacttctttttcttcttcttttttccttttttttttttttttttccttttctgccctatagatctaacacaagtaagaagtaacattacttgtctgctctttttttggtaaacagggagtatgcagatattcaataagggtaacgaaaaataaaattgcttttatatataggtggaaggagccaaatgttagggagaaagcaggagagtcggagaaaaacagggacatcaaatatggaagcacaaggaacagagcacttgtggacccaaagactgaaatcagggctttattctggatgtgtatgcactgaggttggacgtagcctgtagctagatgtgcctgagctctcctacagctttaatattccttataggttagatatggcttatggttatcagtaatacattgatctttcttaaccttctttccgaagaagcccacgataatttctggaagtttagaaaggagtgatgatattattgaaaccatacagataacatgaaaaaagttaagacaaaaattttgaacacttgtacctcttgagccagctacccagcattcccaaggaaccatttaattgactagggcataactaataaatatgttttctaattctagtacccctgccacccacacacacattaagccacagaatatctgcggacaattgtaaaagtaaacctagtatagtcttaagaaaaaaatcttcctgtgttaggtggtatttgttttcattctcattagatttcattaacttgctagccaaaccttaaattagtaatttttaaaataagtctcctattctgtagtgcaatttattacatctactgaggaatagaaggttaagtttatttagccttgttgtttctcttatcatttttatattttttactgtgttttcattaactagtctacgtagaggaaggagaaaattggtcatttattcttttagttttccatttcagcaaataatgatttatgcggactattatcatatactgtgtagtcaattaacccccaaataagcatctaacattaggtgatatgcatcattggtcttaataattttgaaatatatatatataaaacccaaattgttcatgttaagtcattactagtttttgtaatttcttaaggtttaaagtaatagctaatcaaatattcaaggcattacattttaaagaaaatctcaccgtgtttttgatattaattctaccaaataactaccttgttggaaaatgatagcaatggttgtcattgacaactacagcttacactcctccaactatccattttccttgtgatacctcttttcctcaatatttatttgactactaaggctttcccaaatgtaaggaattttaaacataaattaataaaacctcaactacaagactgaactagaattatttatatctacaaacacacacacacacagcacacatatctatacatcctatctatacattctacattttaggagaaaaagtaaatgaaaataaatgccattcccagttcaacaattaaatgtcagtagtctgttcaatgagttttcaaaagtggcatgctaaggctggaaactcctggttttttgatatgcaggacgtgatgtctgagagatcaagatgtcagggaggaaggggaggctgtaataagggagtaaatcataaaatcaccctgaattacttaccagagttttctgggtttgttgttgttgttgtttttgcaaagagctggagagatactaagatgagtgaaatatagattccactcttctttaagaggagtcctgtttagtaaattgagaagatgtcacagaacactataccctagggctggataaagaactgtaggtgtttatgggagagtgtttcaagtggatggaacaaatgaggaaaagccttgagtggtgtgtataggaagccataaataattctgtgtaggtgcatgaagggaagtgataggagaccacaaaaagatatttgggggccagactatacagaaggtcttaaaacaaggctgagttggctttttataagtagttttatgggttgggttgggtagagcgtggtgcgcagtggttaacccatggggttaggacagattgagatgatttcaaatcttggttttgagtgaccataggcaagtcagttctctatgaaatgaggctgactctgactccctcacaggctgattatgtggagttcatgaagaaatacttggcacttagcgtagagcctggagcccagtaaaccttttgtaaaacatagagattattggtgagtagtattgaacgttggcaaacatatcaggaaaaaatgtaagcagtggaagcaggaccccacaccaccatggcagggagaagacttaatgagtttttgcagtagtctaaattaatgtgaacctgaaggaatagtgaggaaggaaatggattcagcctatgctaaagatgtgaactgacagaatttgggaaatcacttaatgtgcaaggaatgggataagagaaagggaggaaatgacaaaaggatgaggacacttacagtttgagcctgaatgaaagagggatggtggttccattagcacagtggttttcaaccttccgtgtgcatgagaatctcctggaggacttgtttaaacaggtttctggctgggcatggtggctcacacctgtaatcccagcattttgggaggccgaggcagcagatcacctgaggtcaggagttcaagaccagcctggccaacatggtgaaaccccttctctactaaaaatacaaaaaatatatagctgggtgtggtggcacacacctgtaatctcagctacttgggaagctgaggcaggagaatcacttgaacccgggaggcagaggttgcagtgagctgagatcgtgccattgcactccagcctgggcaacaagagctaaactccatctacgaaagaaagaaaaacacaggtttctaaaccccacccctctgactttaagaagttcccaggtggtgctgatgttgctggttcagggaccacactttgagaactactccgtgcagaaatagacaacacagtaggtggggaagtatgggagaggagagaggtgtgtctgggtaaggccatggtttacccatcatttaggtgtagctacatagcagaccactgaaaattcaattagagatagtgaatttggacattgccactgtacatggacccgtgtgatggtcatattgtcaagtgagaggctgaagagccaagggcaagttactcagtgagtcactgttgagtagacagtcttttaagaagccatcggttcacacctgtaatcccagcactttgggaggctgaggcaggtggatcacctgaggtctggagttcacaaccagcctggccaacatagtgaaaccccatctctactaaaaataaaaaattagccaggcttggtggcacatacctgtaatcccaactactcaggaggctgaggcacaataatcgcttgaaccccggaggcagaggttgcagtgagccaagatcatgccactacactccagcctgggcgacagagtgagaatctttctccaaaaaaaagccatccgtgtgggtggggtatgtaggaaaagcatgagactctacctgtcttctttgaagttctcatccacacatggttccaagtaaaaagcttttcttgtgtatttttaatgtacccccaaacctctcctcctttattttggtttcctaatagaggagctaagttacagatgagagcctgagtcttagaatataaacttcaagcatctggtaaactttactattttctctctgcttcattaaaactggaggaaagatgtcaactagaacttggtttattcctgttttggtggtaggataaaacaacaaagatcttaatattgttcatctcctattagaatattagctagtaaggcaagaaattagatgggtagctgtatgttgcacttttctttgatcgtgagatctcaaggtaacaggcaatgggcatagcatagggcaacgaatcccacagagctgtcctaataatgtatatccttcatgtcttcaaagtgatgcaatgtcagcagtttccatttgaaggctaaccctttgtagtgcccttccctatgtaagtattcagtcttgacaaaagtgattaaaattttgttttccaatttgtaaaaaatattttaaatgtagactatagtatagtacctcttaattcagccttccctaaatacaacaaataaacttttttttcagtgttgcctaagttgtgttctcaaaatgatagttccttgagatgttaatagttgttctttgcaaaagaaaaagtgtgcttagtgttcaataaatcaaagaagtgctgggttaaacaaaggtaagctgacttcctactggtagacttctcagaacttttaatatggtagggttgctgtgactctccaagatttagaatctcctgggcagcatttcccaaatctacttgacccggaacccttcctttaagggaatatctgttaacatcctgtaggacactggtgttctcagtttgagaaacataatttatctttgattcttaatttccttttaacaaaggaagctagccagtacaatgatgattgacatcatatgcccagcatttctataattaattatacattgatttagggactaccaagtagacataataatggtttatcagttattaagtaaattgtggtagatggtcaggacatttgattacctctgtcaaatttgctggttatcttaaggatgagaagttcaaggacctttgtaaatatgactactttggtttttgcaccagcctaggttacaggacaatatttaggatgtttttgggggatttcttggtagttcttaaatatttgtttgtaaaatagtttcctaaacttggcccaaagatatgatcatgaccataattgactcatctttttgatgtgggaaatggggagaaatgctatagcatgtcctgggaacaggacataaacctgcccaatcccctctatcttaaaaatctagtcagtgataattagtattttagtaatataaaactctcagtatactaaggcagaaagtagatttttttgaaagattttcaaccaacaacaattgaaataaaaatgcttgctttcttaaccagtaattctatcacataaggaccatctgttttcttctttcaatataactggaactaagtactttcctgctgagatacatagtcatggaaaggtatgttgcctcttggtgtgttatactgctagcatgagatgatttttgtcacgcagataaacatttctaaaaattactatgtattttatattaaaaatatacaagcattggaaaccaggatttcaatgacttcaatgcctggaatgataaaggagtcagtttaaagaaaaatactcaatgaaagagataatataggtcagaggagaaagaaacagagactgaggagtcctataatcaacaagatatgttctcagatgagaaaaacttgagcattagactaaaatgaaacatagaggattccagagagaagcaaggctctggatgaggcaggagagcatgcagagaccagccttgggtgagaaagggacactccctccactaagcctggaagagaactaaggattagtgtgaatgtgggggcaggagttgagttgtcaagctgatggcctgaaatgagcgcctactgctgtttcttaattgtcgtcatcataattgtagtagctattgcagctactcctgaattagctggactaacttgaagtaaatccatgtaatgatgcaaattgacaactgagctagatggctcgaggctcaaaagacaatgagcttttgcacatatttggaagcataatggtctttactgataaggaagaaaaggaaaacatgatttactaatatcaagaatgtaagggggctatggttgcggatcctgctgacaatgaggacaattatataacatatactgacagcaaagaatattatgaactactttatgctaataattagaggtagtaaggagccaggagcacaccatctctcctctcccttctttgaggcaccttgggtttggggtgtggaggaatacatagtcttcaccagagagggttgtaggaaaatgcagtattttcgagaaagaactacatttcaattaaagcctggaagtggagagtattcttagtaactcagaggtggagaacattctgattaaaagataaagagtttgtaaagagagagtttgtaaactggaatgagacttccacagggcacagttggaaagggtcaggagatatgtcactatggccatcagtgaggacttaatgagggtaagagactaggaggccacaggaggatgaagtatgacctgctttcagtgttacgtgaaaatggttcaagggactgagccttgaactggagtggagctcttcctgctcatcaaaggagcgggagtgcagagacctaattctgaaagctacctagggtttctgaaagccagaaggaagatggtatccttgtgactagatgtgcagtatcctaatacttctgtttgaaagaaacacagtaatcaccaattttaagggcttatttagaactgagtaacttgggagttgaagtagacatcaacctaaacaggaagagaaaacaaaagaagaaagagatttcacacccaatgaccatgcaggaacagacatgaaaaagaactaataagaagtctcagaaatggaaaatactgtctttgaaaaaaaagttcagtagatgagataaaccataaacaagacacatagagaaatagtgaattgaaggcagtgctgagaaattctccctgactacagctcaaagaaattaagagaaaatatgaaagcgctatactgtagattcggtattctaaccagtctttcccctgaaagaaactaaacatactaaataaaatatttgaattgtctttttaaaagcaaggctaagctagaaagaaaagaaataattcacaaaaactaaaaccaaaatgcaaatgagaatcctaagcaataaacctggcttttaccctgaagatatctggcaaatctaggtcatcttaaacatgctatttgacagctccatgccacaggcatttgaggacagcctaaggtgagggttcaaattagatcctttgcccaaagctagaacttgccaaaactacaacattggctaaaactggtaagaaatctgtcccacagaagaggacaggcctgggtgctggcaggaggaagacattttcccccgatagttacgatacctatgagattcaaaaacttaaatggtcaataaacataggaaaaaggtgtttgttatcagggaaatacaaaataaaacacaagcaaaatagcattctatgcctatgagacaaccaaagaaaagagaaatttaaggcccagaatgccagctgatgtcagtgagaatgtggagaagctgaaactctcatttattactggctggaacataaattagtacaactactttgaaaagtaacctgacaatcattatcaagcaaaactgaagatgtgtgtacctttcgaccaagcaattccacttctaggtctctttgctctggagaagtatgattcatgtgcacaagatggtttatacaagaaagcttattttacagaatgtttatgattacataaagttgggaacaacccaaggttcatgatgagaacatataaagacattatgtgatagccgtgcaatggaatactattgggcagtgaaaatagattagctagatctacatgtattgatgttaataaatctcaaaatcatgttgcagtaaaagcaatctgcaaaaactgtacaatataccaattgcataaattgtgtggacatacaaaacaatgctgtatctgttgccatttatggctctctaaataggtagtagtaatataaaatactcatgtgaatattaagcaccaaatttagggtaatgattccttctagggagggaagaaaagagaagaataggatctaggaaagagaaaccaagggattttattgtattttaaaataaaattgtaatattttacttcataaaacatctgaagcaaatgtagcaaaatattaagatttgctgtaccttggtcagattcacagaagtttattgtgttattgtctataattttctgtatttttgaagtgtctcacaatatatttaaattgggagagagaaatctatcatagaaatggaagccaaaaaaaaaaaaaaaaagactgtttcagattgaattctcactgagatggagttttacatgcagaatacttgtcagggatcaacacctgtggaggagaggggaagggaaagcaggattaggcaagggagaattccaaatcaggctgacaaagccttggccaaggccaaagggagcaaatctgggcctggtctttattttcttatcttgatcagtgcctgaatgcaagcttctcagagggtgtgcccatgggcaaggggactgtctgcagccgagacacccctgaaggagctgatgaccacaggccacctgctggcagatgggacagccagcctttccttgggcttccttgggcagtgtagctctgtctaccaaatatggctcatctgaaagtgcagctttattttcatctattcgcttaactctctctcaaagaatatttatcagtatacttacttgagaggaaggaagtaaatacaaagaaaagctttgtaacacaggtgaacagattccattttcatagtatattagtagccttgactttctaaagtcgtgtggtattgtttgctaggctctacgaggaaattttcatacactaaatcactgacaagtgcttttaacattaacttttttcttctcacaaaagaacaaatataagctccccctataattaagattcccaatttgggatactgatttaagaaccattcttcacattttttgtttagaggataaaatataagaatttttaacttcatagatgatgtctctgcatcatcatcttaatgagcgttattttggaaattattagatgtgttttcatatgacggcataatactgtcctcatcagtcagtcaaagaggccagtggagactgaattatcaaatattgatatcccactcatacatcttggtgccattcacatgtgcgtgtgttcaacttgtattcttaggaggaatagtaatagttttgcaagaaagcatattttttctttgtaaacatttacaggtgttaagtcacttttacaaattcagtgctttatagcttcttgatattctgcttttggcactttaatgaagtactacttgtgagaagttgtgggcacgtaataggttgaatggttttgataaaagtagccagtgatgttcagtattatgggctctgcatccagtagggatataatgtggacttaattcagtccataagaatgttaaaggaattgccctacttttaaataaaaagtgtagctacatcatgcatgtataggctttcctagcaactcaagaactgtaaattgtttctgtgggtacgtcaatcaaagtttctagttgtaagatacagaaactaacatggctaattaagcagaaaaggaattcattaagggattattagtgaattcccacatttgttacaggtactggagaacaagacttgagactaagattccaggaacggtgtccaaatttgtgccacaatgttgatcagataaagaaactattgctatagccaccaaacacacagaattgtgtatggaggttgtttccatgtcaggatcttgaccttgagacctaatgcaggaagcacagcaagaaggcaatagagagagaaaacaagtgtcctctttgctggagtcagagtctcagtgtcagcacctgcatcacaacctggcatgagtgtaccttcttggcagagccaaagtcacccgttctgcttttgagggaaggaattatgagaaattccaacttctgccttcaagcaggaactttcccagccatttccttgaaaggttgtttacaaggtcacaggcagccacaaacatgataaaaattcattcctgtacaatggaatttgtttctatgaatggaattttttttctatgttcttatttgcaatgtatcttcataccatactgtacctgatatggtaacttttgcccatcccaaaatgaggacagtactccagccctcaatccctagtagccactgaactcagaggacgaaggtattgtgatggcttggggaatattttgggattcctgagtagtcttttcctggcccagcttgatacaaccaggcagtcttgtgggaaaagatgcatataatgacaagtgagtaaatgaagtgaacaaatagaagtctataacaaaaaaaaaaaaatgatgctgtttaagagcaaagaaagagtaagtgtgaggtaagcataatagtattttcaaattggttatcttagcctggtactgaatgctgaacaatttatgtctatctagtcttttgttactgaacatttattaagagcctaggaattgttaggcagaggcaggcattgtcccacttaccgattatgatcatattgtacagcattattgagccagctattattcatctaggccctgtccaatactgccacaccagttgggatcattaggaaaggattctcagtatcagaagatggtaaggagtttagggactgtttcttaaaaattattccaagaatagcttgtggaatttgcagagccagtactgtcaagcaattacatgtttgcctgatttcacagggagttcatatacttttcaattaaaatttttaatggcaaacgaatgtatacatataatcataaataatattttaggttgttttatttctgaatagtttctagatttaatactcatatgtctggtattttgaactagcagtcatcaaattaaactacttacagttcagcatttgctttgaatagacttgtgaggagacagtatggcacaggggagcttgagatgctatttgtggcttaaaacctttggaatgtacttgatctttagatattttataacatgacatgttttctacttactaaaatcccatcaagctaacaatgagagaaatacaaataaagttaaaacatcctctcctttcatagaacttgtttgccttcactttgcagcatagattcaagaatataatttctgtagactatcttccagcttttgaatatattttaaattctatgttatggcttagtctttttcacttcttgtgttccttctctcctttgcacagtggcacatgattgcttttggacatagcaaatttttgttggttatattatagataaatacggcaagactttttctgtggcattggaatcattttttttcttaattaaaagactgtatatcaaacatggtaaagtgattctgatcacggggatttatatttttttaaactatgctgacatatagtataagaaatataaaaactagccattgtttgctgtgtctctgatgtagatacattaagtaaggtctctggaagccttaactttagtaaggcactgtagcagaagtactgtttgaagacctcagaaccaaaatcagaaaaggcaaataaagatctacatggtttttatgccaaataaaggctgatattctattgcctttagatttgaaaaagctaggaatcaataggtcatttatttcatccaaaaattgcatttcacaaagccacaccatagctttatgttatgggtacgttcctatgtttcctgtgacatacattaattcatatatctgcctgagcagcataccttggcgccttatatgccttttattttcttgaatcacaggagcttcagtttcagcgactcacccgagaactggaagtggaaaggcagattgttgccagtcagctagaaagatgtaggcttggagcagaatcaccaagcatcgccagcaccaggtacagggccaatggctccatctttatgcacactcaagttacatgccttactaggttgttctctatgcagcaaaagattctgttagtgttgttactgttaacttgccttccagaatttgaaaccaaaaatgtccatttattctaattttgagaagcctcttgcaatccctcagtcctgtgcttgaaatgttttctatagcattggcaagcttctgtagcaaaagctactgtgctgccttcagattcctcatatgtacacacagttaatgggtgttgtcgtgattaattgctaattatttggtaaagttaattggctggtgctttgaacacctggtattgatttttttaaaactaagaaatatttctaaataagattgcattaactttaaaaatgtcttcaatttactttgggtttttctagaactctatgaatctaccacacaaactaattactatatggaataatttactgtactcacatacagtaaatactaaatgagtgcattactgtaaaaacataatcatgattgttattttttatttaagtacctcttatgctatttaaaagcataattcctgtaaaaattacatgttccaaatagttgaatcactgcttatcctatctatagatttctttcttaataattacatatttctgtaaagcctactgtaaaatgctttcattgcttgcagttttaagtttgatctgcttacacttaggtagacatgcctgcaataacttttctctcagttatttctaacctcataattattctacttttcagtatcttgtgttactcatgggcaaaaaaacttcttagtgaatagaattctgtctgttgtttctgattgttggtatgaacattaaactattgggctggtaagttgtagtaatatgaatttttcatctctcttaacagttgtgtatattgatatgtttggtaaggcataaagtatataaataaaggtcgtcaaaacttttacaaaacaaatataagattatgtaattattttataaatatccaggaaggtttttatagaaagagaattataagcaaggtataaaataataaattagaaatttctaactcagactttgcaatacccaatgaaataattcgttaagttaaaactgtgaaaacaaaaattagctttaattctctataatattttttagaaattatccgtatctttagcaccaaaaagaacaactcacaaactcaataatatggtattatatatttctaaaaggtatgaaccaactggttttgtttttctaaccagaattatattttaatagaaaagtaattcaacatttaacagaattctgttagtacttcttattctggcaatattactaactaaattaaaatagaaattctcttgataaactcctagtaatacttggtatatcaataataaagaccaatacctagaggaaatggcacaagaggagggaaaatccccagatattgaaactagaaagagcactgaaaaccagagccagaagcttgagctacctctgtaggagatgtgagaacagttgtcaaacctcaaagtaagcactagaggtggattttatacccatagaggagctaaagaatgaagttttgtgtgtgctcaagatggtatgtttgaacttaacatcactgcactaagccatgtcctttaaaggaccccatgattagcaaaccccaggcttctatcatatgtgggtttggagcccaaatgtaactatccacattgctcaggagtccccagtgagaaaatggcaccactaaagatgagctcacagtgagatagtataaaacacaaatttatgagtgacatcagcaagatgacagaataggacttgtcagtgcccatcctctcacagaaacttcaatttgaacaaccattcacacacacaaataccttcactagagctaaggaatccagacgagagattacagcacctgaatgtagcacagaaataagaaaagatgtattgaagagggtaggaaggacagtttcacactgtgctttgttcgtcatgtatttccgaattagttctgattttgtaaaaaaaaaaaaaaagcattgaattacatatcataaaaaaacttgaccatgagtgagagaatcagtgagcaaaagagtagggtttcacagtccaagaactggataccattggaggaagtctgacaggtgtgcacagtaaaacagatacaaagcatgctcattgcagcatcatttgcaaaagtaaaaaattacaaagaacatacttattccttagaatggaaatggaaaataaactgttaataggtacactctaaagcagttaaaatgaaactctagagcagttaaaatgaaataactagatctacatgtatcaacatggacatgtttgcaaaacagacttgaaaagctgtaagttgcagaagaatagctgtaggaggatataatctatgagcaatttaaaatatatatatatagctatatatatattgctatatagatagcaatactgcataataattaaatagtacttggtattgtttgtcagtgtgtgcatgtggagtaaaattataaaatattttggaatgacaccaatttaagatagtggaacctctagaaaggaagaaaggaggacgatactaggaattaggcttttgcagaatctgtagcattttattcaagagccatctggagcaaatataacaaaatgttaacaactgttaaatgagggagtggttgatatatgcatggctattagattatgttctggacttgtgaattttaaaatgttaaataattttaaggctatgtcgttcattggctggttccatatgtttttttaaaatctctaagtaaagtacatattgtgggtagtagtttctgtcagtgactttttttgtggttcctgtctggttctcagtgcctggcatttgtgcctggcaagtgactgtggcaccaccagtgaatgtcgggtgaatgaatgggtcatgcagaaatgggagtggggttgaccagggaaaggaggaaaatgtgcacaaatgcatatatggccccacaaacagttgtcccgagcagtaagaggctcagtgtctaggatatgtcctaaaaggacctactggcttatgaaattggaaaggtgaagctggcatttaattgtgaagaactttattagatctttaaaggagaccaactgaaagttgttattggtggtggtgatggtgattagaagttttccttttttgagagtgcagtgtgtaaaacagaataaagaggccaggcagccagataggaatctattatgaaattttaagggttatgagtaaggtgggtttcttcattcagtgatctctgagctgtggttggaatggtaattgatctacttggattgccctactttcttctcatgttgaattcccatgtattcttgatgtcccaactaaatgcttacccttctttacaacctttctcaagtttctcaggaaaagtcacctccctcatctgaattcccatcactgtttccctgtgcatgttagctgctcaacaggtagtaaggctcattccacccccatggccctggcacagagcctggcgctcagcaagtgggcacccagccaaatgatcattgaatggataatgaaccttaagtccaggatgcttcgggcacatcatgtaaaggtgctttgccattaggggagctaaagttttttattgtgtcacttgagagatcccccttgcatctccagtgtgtttcaattgtcagtcttggaaccagaatctaagtgatacagagaagaacagaaattagctcttagacccaggccccctttccggtatgccatttccgatttgctaaaaaataacaattaaaagtggaattgttgctttgggccatcaagcttctgtttgattcagttcgttcttgcatgaaatgagtttaatcagcaaactgggggatttgatcaccagttacctttcatactgtttgatttggatcctgtggcagagttggtaaggtgatctgtaagattttcttacttttcctggtccaaagatgacactaatgactcaaaggaaaacgaaaagcatttgtttttatttaccttttcacccatccaaagtttttgtcattattggcctcaccctgtgaagaaggacgtggcagtggcatgaggttctgtttaatacctgtttaatgacgcttatgctgtgataaacaaactgtggaatcctcttccccgaatgggtggctctaatagtgagtagttcggttccctcacacttgtaggatcaaagattcatttttaacccatgccagaagatgtttccattttataggtagaaactagtcctctgcatatatttccacctatcaggaaatgtcccaaaaaggtgaactgcataataatcattggcagtttatttgcagtatgccttcttgagaacattttgaaaatcttaagataaaattccttagtttttctattaatgactctttagaattagtagtcttccaaacaaggtaaaaacctcatttctgatgacttttccattggttttatttacttcttaaaaattaataaaactagcactatcaatatattataatgaactttcatctggagttgatgaagtctgtatcaagagatgatatatcagaccagaaataatcgctgcaaccttgaaaagccctgaaggtgggttatggcctcatttaatagagcagttgtagcctttcttcatttgtaccaagtacactaaagttatctatgcaggtaatattatctgtgtatttaatattttactcattgaagtttggttttggaatgaattaataaagaagttatggtttgtctgcatttatattgagtagcatatagttatatttcacctcattgaaaggaaccagttaattagggaagaaaaaacttttctgcatttgttctgaatatgctatagttacttatgcattcaatatttcacctcatccaaaagtatttgaaacacctttcaaaatacaaaaattaaaagttgggaaattagggcaaaaagaagataaaatttagaaaaataagatgaagccaagtttaaactagtacacaaaatgtgtgttgtaaccttccatgccacattcactctgagtgacctaatagccatggtaaagacaaaaacgctaatgaattccacaattcatgtgtctgtaagagaaaaacaaactaggttgctcaggaagatccaccattcctggggctgaggcttaagtggtttctcccgtgtgtccccattaacatactgctgtatgatgaggcaagcagtgtcctcagtggtctctttccagtaaattacaaaaacaagctcatagggctctttcttccattgttaaatggaatataaatggatggaatagcaccttaactaagagtaattttccacggggccaagtctgacactacagcttggctccaggataatacttagcatatgtagatggatgaatcaattttaggtccactaagcaggcagcctaccatgactatttctgtctgtagagccttttagagtcatggatggcaatgagtgctgagatgtgagatggcttgtgttgcttgtcattgtgcaggtgcatagtgtatacatcttagcaacagaaatgactcccaggggatgctggggtatgtacagctcatctcaggaaatctcacagcatagaatcttcagagggaaatatgtcctttaagtctcatgtctcccacgggctaagcaacatccttcaaatccaacttttgatgagcatgggacttgttcttttattccctgcaatatcattgatggggtatcattttcacattagttgggttgagatttcactggatacagtgagagtaaaagggtccaatagcccacattgcagggcccacttggattctgtacctatctactcctccctgggacttccccttatgcctccactccaaggacactgaagcaggcaatggtgtagataagactgtattcttactctgtattttattgattgtggagttaaatgacattccttttagacaagttgtaaagttcaggaaagtataaagagaaaaattcctgaatctaccattcagagataactactatacattttaagtcaactttattgaagtgtgattcacttaccgtaaaattcaaccctttgtagtgtagttttacaatcctttactagcacttttggtatacagttgtgtgacgaccaccaccactacagctgacatatagaacattttcatgaacccccctaaaaagaggcaaccacttttaaaagtttgctgtatttctttctcttaaaaaaatttattttttaatttaattttgaggtaattccccacaggtgactttttatcttgttcctaaagtcccactttggtatgccagggtattctttaaacaatctttttttaatgttttgtttgtttgtttcttatatttttatattttctgattttttttaataaacctttgtgtcgagggcagactttcaatagatcacagcgagggagctgctccactacatacgaaatccaacccagaaacaggtcgtctacaaatggtttagcgccaggttcccaacaagcgttacatgacgggtaagggggaagccgcctttctggccgcattccgtttcccaggaccaggggctctctgcactggggtcccagcgcacgtccaagtggcctgctggcggggacccagtgattcgaggccaactgaggctccggctccgaggccaaccgagggtctgtggccctgctgtatggttctgcctgggcggtattctgacttagaggtgtttagtcataatcccacagatggcagctttgccccattggctcctcagccaagcacgtacaccaaatttaatggtttccacgtgccagcggaattcccaagtgctgaataccttggggcctagggatgctaacttagtaggttagggaccagtgcagccttccaatggcaagcgcattctagtggaagactcggccaggagaaatactgcaagataaattcaccgttccagtaggcattgtacgatctgtgttcacatttcacgcaagcagagaagttacactagtggttcagcttcttgtgtagcaaaactggaaggataggccaggcacagtggctcatgcctttagtcctagcactttgggagtcctaagcaggaggatcacttgaggccaggagtttgaaactagcctggccaacatagtgagaccctgtctctacaaaaaatttaaacaataaaaactagaaggattaaaagtatatagttagaattgaagatttcataaatgaaatatgatcatcttagaattctagaaactatccctgaaattttatagtaaagaatttcaaaactataactgttcttgacaacagacttggaatgttactatttcccagaaactcatcttggttatctattctttgttttttatttacttctcgataaattgtaaacagtgaaagagaaagtttatttctttgtacatcataaattggttccaagtatttgattttacaaatcgtagtttgtctcctgactaaaacaaagccctaagtttttatttatattgaagtaaaaaatatatatttaaaaattgggccttttaataattgtagaaaacattaatggcaacttttggaagtaaagcacagtttagattttcattttcgctttttgcaaatgattttgaaatttgattatcctgttcagaagcatttggtcccttcacattgttcattctttggctggctgctgctggtattaggaaaatgggtggcaatgttgaagttaaataacttcaaagtcttcccaagattatctcccctttttcagttagtttaaagccctgctaaaatagaattctttctgatttcaaaaaggtcatacagttttgacaaatagtgttcttactaccacttaagaaaagaactggtttattttaatgaaaagatttgattccccactgccattcagattttttattttttacacttgatcgagtcatctgcagatgcccatcaggtttcgattgatattactaaaaatcctaaaaatgttttagagctgacagcagcataaaagacctttttgtggttcaaatcttttcttcagtgaatatttttaagtcaatgagaaatcaacctcttcaaataatgtattctttagaaaatgaagaatctttgaatagattgaatgtttgtgctttaacagtttattacttatttaatataccacttcaggaggatgtttgagaaagctctgtccctttgaccttcagtgctctcaccaggcaaaacctgagagtgctttttataaaataactattttattgggatacatttcacataccataaaatccatacttttgaagtgtacaattcagtgtttttaagtatattcagagttgtgcaaccatcaccactacttaattttaaaacatttttatcattccaaaaaaaaaaaaaaaaaccctctagcctcccccttttttccttttccctgtcctcagagaaccacactaatctacactctgtatctatggatttgcctattctcaacatttctaataaattatatcattacaatttgtggtcttttgtgtctggcatttttcactttgcatgaaattttcaaggttcctccatgttgtggcatgtattggtacttcatctttttttatttccaaataatattccatcatgtagatatgccacattttatttattaggcatcagttgtacatttgggttgttttcactttttggctcttatgaatagtgctgctgagtattgtattttaagagggaaaaatatcaagagctttgctctagacattcttaagttgggagaggtgggagcaaagggagattccccttggcctgtccacccatcctcccagtctgtcatgtgggcttgcctcctttcctttctcctttgcttcttcttttaataaatgcttgtttattggtgggttagttgtctgtaatgatttagttttaattttttagtgtatttggtcactagtgactctcttaatggtcaaatattctaaagctccctaacttcatttctaattcagactaaatgaagaataaactgtttaatatctgaatataattaccggaaaccctcgggatctctatggtgaatatttattaaattgatgctcttatgagcaaatttggtaacactgcatttttgtgatgcaactcctattgtaaacacagtaaagagttccacatctgaaagataccaaatgagtcaaagctgacctgcagctctacagaagttgtttatctagagcagtttgctcaactacagttcttccagaaggcatttttaattatgatatctcattgccattccagtcacaagccagtttcaactgggacatacaaatccaaatgacaagtatctctacacatgtgaattaaactagtataactgagtcttgcctaggacatgtgaccccaaggtatttcaaccagtattgcagtaagctaacgtattttaagctaaaaatgtcaccatgaagaattttaaacaatatatcttttatgagtaatagaatcttttttgaacctagaatgttttaatcacagcaaataagtattccaaaataaattacctgtctcttagactgagcattttaaatgttaaatggataatgcagttaggaagaaccacaaaaaagatcaggttaatagcataaatgtttcagattattttaagactattttaatatatgtggttaaaatggaggcacctcagctgtattaatttttctaatacttttaaaaattcagaggcccatacatctaaaatatgtatatcatgccattatttaatcatcttttaaagaacaattttagttaaaacagtatttcattttctgtaatttttcatagtttgctttctgtaattatattattaaattatttaacagtattgaattattgaatcaaaataagaattataatattagcccttacccttcatcattagagtttttgaaattatgtgtacatattgataaagtactttaataggttatacaggatatttcaagatgcttgaacagatttgccttcgctgctttataggagttagtaattacatttaccatctcataaaagcaacaatgctcttaaatcctgtattttcttattactattattattttccccttatctgggttttaaaatcttctttattttgagaaatgttaaaaattgtaaatgcagagaataaaatggaaatgttaagtactcacatcctgtaattaaaaattattaaaaattcattttttataaaaaatattgaacataaaattcaagtcccctttgccacattttctcttccccatagctaaccactagtatgtaatgtttcaattgactttgtatacttttatgtcaatacatatacagtacttatatattatatacatatatattaacacctgtgtaaccaatattttgtgttgctttttttttttacatcaaagattgtaggtgtagtttatgtgccattgtacaccttgattttttccatttgagatccagccacattgaaatgtgtaaatctagttcattcttttaactgctcttgtatatttatatcatagacattaaactgtttagccattccattgttgaagttttacaatattgtaagtgaacatttttgaacatatatcctggttcacatgtgtaagattctggaaaatatataatgagaagtagactatttggatcataatgaatgtacatttttaatttttctagatcttgctggtttgaagcagctttctgaagtagctcaacagttgccacccgcttgagcagtgtaaaaaagttcccggttcattttctcttgcttgcttgctttctttccttctttctttctgccaatatttaatattgaacaggctctttaatttttgccaaactaacgttatctcatttaactttgcattttctcaattactgttggggttgaatatgttttcatatgctatggtccatttgagtgtcctccggctgttgatgttgtttgctcatttttctaatgagtaatttggcttgttatttttggttctatcattagttttttaaagctaaaataactctgggatatatttcttaaaatagtacagatcctagtacattgtagaacaaagtacaccatattgatctattttaagaatatgaacattagtacagtgacacgtatgtggaagaaataactttctttctacctataatataataataaatctcaaattatccaaacctgccacttagggtaggtgaaggcccaactaatattactctcagtttctatttccacattttctttagtgactctgcatttatttttttctgcaaatatttatgatgtcttttctaaattcattcactaaatacttagcttttcctgttttctagagctacaaagagacaagcttagaaatttgccttctatcagcaagagaccattgtgcgtaactaaaccaggtgatgaagtgtcttcctagcagcataaaatgtatgcctgtattttattatttttagttttgtgaagaatgctgttgatgaggttgcactggttctcctagctctgtcccaggatgccttaccttggtatctttgattatcatatcctttggtaaaaatccctttctataattatagtgtaggaaagagaatagcagcagttgaacacctattatgtaatttgcagtttgatagtaaatgtctcgtgcatgttatcctcttactcttcagtagcatttcatttttggtcttggcggtggtggtgtgttttgctttgatttggttttatttattgtacacctgaatctaacatgaggctgacattttcccctaaagatagtgtttttctcttgctttaccattggagtgtcaagggggtgggaagacttcagtactccatttacctccttcttgccactgcacccctccaaacacatgctatctaggtaaaagttgtgttggctgtaccgaggcatctgtgagagtcctcgtctccagccccacctccactaccactattttgtctctcctatctggaaactctgaagcgcttgatatttctattcctggtctttcacaaacatgtacaagaggtcatataaatgttaattcaacaactctaggaaacaacctttaaaaatatattgtctgttgccactaatgtacttagcgcagttaactattttagggggaaattttttgtaattccttcatctaatcactttaatattcatgatgaaataaaggaaggttggtagtaaactctcattctcattaccatttggcaggttaaggacatagagcaacaagagcaatatgtgtgatgtttccttaacccttcaaagaactaccctagacagctctaatccagtgatgtatgggaaaggaaactgaaaatgtgattatctacctaaaagtgagggccatccactagtgcgttttcagcagttaatcagcttgtcgtaaaaatgtacatggcatgtctgcctagggatgggggtgggggacaaacatgacaagtttgccagactttatattgtctgaattgttattatagttatcttccctgaggcttcacaatgtatttaataagaaatcaatataatctgtttttgcatagatttttctatgctgctgttgtgttactccacaattaaataggagaaaaacactctaaaactgaagcaggaaaaagtgtgtagactacagattttcacagctaaaaaaactcccattaaatacctacacattttaaccactgtcaaatgtttggtttgcattaatagactgcttataatccaaggaggaatgtcttgagtgtgtgtgtgtgtgtgtgtgtgtgtgtgtgtgtgtgtgtgtgtgtattgtgtatttcttctagacttttttttttttttggagaaaaataatagccagttattttaggatcctatgatgtgtagtctttgcttcagtccaagtcaattaaagattgatctacttcccagatttagttacattatcaataatggggctatttcagccacagagaaaattcaagtaaaattatcaaccataatacaagaactaatgcttacaaagtacaaaatgcaaaagtgtatctgttttctgaacaacattagcaaatgtctttcagtaaagacatttgtaaatgacaactgaaatagtattatatcataaatgaacatgaagcaaagggagaaattatattactgaatgaagtagtttaatcagaataagtctagaagttaacttggtagaacttcgcaaccactaacaaaatagtgacaaaccaatgatcaccaatggctactaaaatcatcagctggaaaggtagtgagaagttttacaatgaatggatcaggctgacaggacatgaacccacttatctatcttatgttaatatcacagaaagggagacagccagaaatcacagtcacctgatacgatgcaatgagaagtatgtaacgtcacccatgacatgttcttgccctaaaattacttaagcatctagatattaatatcagtttatggggaatacaggagacagaggaacatgtcagttgatactgtactgatacattcattagaaccaggctaaaattctacagagcaaatgaaattatttcaaataggaaaaagaagagagggggaggtaaaactatatatcagaagatttttagagacatagcaaccaaatgtaacatatggaccttgttttggtcctgatttaaaccacccaactgtttttaaattgaaacagggaatatgaatactgactagatacttgttgatactaaaaattttaatgttaatttttggtgtaataatattgtggttatgtttttttttaaagtatctatatttagagatacatttcaagtatttattactgaagtaataagatgtcttgagtttgcttcaaaataatccagtaatgtagagaatataatgtagaataaagatgtcaatgaaataagtttggccacatgttcattttcttgttgaagctgggtaataaatacaaagagtgtttgttatactgttttttattgtatatattttaaatgttgcataacagtttttaaaatgttaggtgattcagatcttaattttctgactgaaattgcattttaaaaattaaccataatttcaatgtttataagattagtatggttatatttcttacaatctgagtaataaatattctttttgaaaatttaaataaatatcatttattagctctaacttttaccatttagagattataaatttacataatatgttccacataccatctaatacctttcctatcaatgatgttcactcatggcaatgaatgggacagggagaaaaaagagggaaagaaagattaagttagtcagcctctcctctgttatgttgtaaattgtcatttctttttggattcatgtttcttaaaagaaacctggacattaaagctagaaatttaaggcagtcttgaccaaccacttaccttttctgtttgccttgaagggtacctgttcaactcctgatcagtgtttatggatcacacactgtttatcaagaatgctgttttaagagactttaccctgtctctccattatcattatcatcattccttcttattcatcctcttaggcttttttctgcttcattcccctacagcagtagttaggaacatgtgggtgatagagaagagtaggaaaccagagtggtgggtaaggggatatgggatgaattagggatccatgagagttttcagagggatttaaaacattctagaaccacttttctaggatccagatgtcttactacatagaaacatagtatatgctatgtagaatattgactgtttccttatgggtccactctttttccaggatagttattaataatcctgggtctgtggactgtcacacatgtgaattcattcctgcttctgcactaaaacagctattcatgtttcttgtccatgaatcaagagctgaaaatgctgttacagagagaaacctttctttttcaaaaagcaaggcagaaatttaacaagtgtattatgctctctcttttcacacttacaattaaatttattaatgaaatttttactgtttataaaaattaaaaatctttactctggataattagtagacagaaagtgaatatcattctttagacacacaccagatttaatagtacctttacatgagtagcaaagaattctctgtgtaaatgattgggggaataaatgtttaattacaaatttaggcttaaaattccttttaagtaaatttttacatagtcttttcaaagcacttaaaatatgaaataatgtacgaaattaaattgtatgcatcaaataaaactatttgtaattataaatttcaaggatttggtatcccagcgtgtctcttactgtagactgctacagcttagtcccatgttaatgctgtgcccagtctcacatagaacaaatagaaaaacagggcccttttcttgttccttaccagcatctgctttatttacaagtataacatatagatgcttttatgcagttctagcagaaaatagtatgtttatatgccctttcttattttaaatttttttaaatttcctttctatttcttcacctttggaaggttttagaagaatagaaatgaggaaggcaacagcattttgtagaccatggacacaaatagttcccagtagcccctctgtttcaaggccaaatctttgcccaaataggatcctaggtttgtggcaggatatttaggaagagagtctgttgttgtgtttagccattttactcttttcatctcagttgctttcattctttcaaatgtcacttgaaatattagaaaaccttccttttctgatttctactttgactagttggaacacctgttgtgggatgggcataaacagaagtcatgtttcctgtataatttatagggataccagagggaactgtttgtctcatttttgtctagtactacgtcctttttgatcttccctttcccatatggtcttctgactcttttattcatagattcaaggcactaacataaaatgcttttgtcaaagaatatttaacatcttctgaaatttgttcacctctagtccctatgaaggttacttgaactgtatttcctgttcctttcatgtttttgctgtgcatcaaataagcaactttcgccttcaggaggctgatcatgatattgtttatttaaatcttaactttccctggaatgcgttttagacagctgttatagggatccaaaaatatacagtagagtagcacaaaggaaaagtagaatgaagaactgagaaaacaagtatgaaaacaaaatagggccatgaataagaccaaacatgttcaccacagtagctgggcatacattttactcaaacttgctagcagccaatgtaaaccaagagtggactttttttccacattttgctgtccctgttgctcatgattttgtaaagactaaaattgtaaaagcacattctgagcatggccaagtttttcaggtaaagtgtcactgagggaaatatgagtctgactctaggcccttgaccttttctgccttccatgaggtatcaggtctgccttcctatagccatcttgtttgctcattctgttggtcacaccagtggttgggtttggagtggagatggattgacgcagagcctcactggtggaaggcaactcaagcctcatgtcctgttgctgatgggtcaggaacagctatagcctacatgaagggtgtcatttttaattcaagtgctcttgcttttctgtaacctcgatatcaccctcagatcatataaataattatgaaaagaagccctttgccctgtctcatttgttatgccttgcttagttcaaactataggcatgtaccattttcaggggcaaggtcataacacataaaaataactaaactacagttaggcacctgttgtcacattttcacttttcctggctgctgagatcttgggaatagccttaggaagagaggggactaacggccattctgatgaaaagccaggaagaattaattagtggccctttcttgggaagaaagaaatcagtctccatccaacagagaattgcccaggatctgacagcatggtaaagagacacttggtcagtgaaaaaccaggaatttggaggaagaggttttgttttgtttttgttttcattgagattgattgtgaatggacactaagtaaatttggaaggggtttcaaaaaatatagttaaatactaaggaggattgctttcagaatatttttgctaagaaatcattactgcctggatttgtgatttttcaaactagggtcctgagagcccctccgaggtggtagtgaatgtggtggtggagatatttgtttgccttccaactccctcgtccttcagctgggcaaagcagttcactttcactgtcttcacgtgttgaccttcctgtcttcaccttactgaactagcttagtgcaacgatgaagagctatccaaacttgttttgggaagaataatcatgacatattgtttaatttgtgtaactgctctatttgttctgacgttaagacagagagcataagtctctagtgtaaagaatttatttcccgggcaatccttacctgactaagagcaacagataaaggccctgtttcccaaacaggaaaaacggaactggttgtaacctaacagttacctattagtaagtggtatgaattttcagaacatcagaagacaggttatagcattagagaaccctctattccatcttagtcttctagatcctacttctcaccatgcttattgtaaatataaaatgagctcacggacattcttcttgagggtcagggtaaggagaaatctgacctgcccacaggtgaatgcctggtcttaataagaccagggacttccataggaattatattcaaaaagcggtattctcagcataaattcacgagcactcaagaaagctaaagcaaagaatgcatttaacctagctaagaattcacaagaaactaatggaatattttacaaatgcattaagagatagacggagtaaagttttaaatgtactaattaaaacagaagccaaagcaatgttagatagaaataaaaatcttaaagtatgttgtatctcctgatcataattgaagatttcatttaattataattaatgacgatatagaaatttaagtgtttgacagaatgtgttaaacttagttaaggtagtttgttttaaatttatcctgtaacattcttaagtagagacaaacttaagaatcattagtagttattttgtcatatttccttggggaggggaaaaaaaaatcccagatgcataatgggaaatacagagtgacagggaactatggagcccagttcacataactaagaggattctggaataattctttaaaaagcaatttgtaatgcctagaggataacaaggtgttaagtaattgcaatgtgaactcattgccaaaaaataaaatcacaaaatgagtttacctttttttttttttaacttagaaatagaccttggaattgactaaaaagtagacttagctagaacttctcacaatagatttggaatccagaaagcctatacatttgctaatggagtaattttgattagtggaaaaataaagcccaccaatggcacaataaaaggtgaaacatatgttacaaaatgagcaaatcacaaattgaaagtaagataataaagaattggtggaaaaagagagaaatgcagtttggaacttatgtcctgaagccactgagatttcatctgtaaacgtgggcgtttttaaactctaattcaataattaatatgtacagaaatacagacttgtgtggaacttaggatcagagctcaaaatggtaaaactgagagaaaattgaggagtgaaacatcaaggaaaggccacaatgtacaaatgtattttaaaaatttttcatagtaaagattaatatacatctgattcatgtattaattacatctatttaatagaagaacacttaagaataatttagagaatattgtgtaccaggcacagtggctcatgcctgtaatcccagcctgggcaatgaaatgagaccttgtctctttaaaaaaaaaaaaagaaaagaatattgtaatattgtaaaaaactatggtgtgacagtgaaagtagatcatgtaacgctactcatttgagatggtttaaacagccattaaagagatcatctgtcatgacacagagggggagaaatgtcagatttcttacacatgcagcgtattattttggtggtctcccaaactggcttattcccaaccccttacggtttttgagctgtggaagtcaaggtgcagtctagactatggcgtatagttcatattccatacctgtctcactggggacttcatgttcagattcctacctgggtgctcccagtaccagttgaccttcttttcatagatgagtataaggagagttaggtctttgtttttgtttttaaaagttgcttcacacttttgtttgtgatagatatgtgaatgtctctttagtcggcatagtgctgggccctgtgacattgacatcagagtcctctcttgtagaatgctcttctcaccatgtattcccagcctctaacaatggctggtgctcaataaatgatcaacagatatttgttgaatgaatccatacgatatatgcagtaaacatcttttctataagatacaaagagcccaaatcgggaggaatctgtctcttttgcagaatgattgaaacagtttctaaaattatgtagcattaatctttaaaacaacaacccaaagagtgaagatcagctatcatctatttaagcatcctactcaatgccagttcctggttagatgcaggtagaattaatatactatctttactctcaagaaggctgcagtctgctagtagaacaggtaggtaaacaaatactatggttacaatgtgaaaagtgcaaaaatagagataaattattgggtacattcacgataaaaaggaggaggtgaccaactctcctcaaggtaattctggaaggatgattgttggtcaccagagagaaggctatagatggtacatagtctagacagtgggacacacccatgctccattcataaataaaacaatttctaggataatttgagttatcccttctaattaatactgagtaaaatttaatttgttattggctatggtttattttttcagctattaatgagttatattcatatataaatatacatgtgtgtgtaaaatttcttgacacaattatttttgtttatttttttgaaacagggtctcactctgttgcccaggctggagtgtggtggcatgatcacagctcactgcagccttgcttgccttgagccttgctctcaggctcaggcaaccttctcacctcagcctcccaagtagctgagactaaaggcacatgtcaccatgcccggcaattttttttttaaacttttctgtagagatagggtctcactttgttgccccggctggtctcaaacatctgggctaagcaatcctcccaccttagcctcccagagtggtggattataggcgtgagccgctgtgtcaagcctgatttttttaaataaagcagtaaattttgcaatttgaccgtattctgatttcaggctaagaactgtttctttttcagaaaggagtaacccttggatcttgtcctaattcagtatgtcttgctaagagactagtaacagtagcttgtgtatacgtgtgataaaatgagccctacctgaaagaaggtgagggaaatggcatggcagaattaccatgtggctccatccagttctctactgtcccctctcctagcgtttacctactggtatccactaaagcaggcttgctcacatcagacagaggaaccaggagaaaattgggtaccaacttaagtaaaacattttttaaaaatattcctgttattgccgggcgtggtggctcacgcctgtaatcctagcactttgggaggctgaggcgggcggatcacgaggtcacgagatcgagaccatcctggctaacacggtgaaaccccgtctctactaaaaaaatacaaaaaattagccgggcatggtagcgggcacctgtagtcccagctacttgggaggctgagggaggagaatggcgtgaacctgggaggcggagcttgcagtgaggcgagatcgcgccactgcactccagcctgggcgagagcaagactccaactcaaaaaaaataaaaatattcctgttattatagaacgtgatacaaagtgaaggtaaactttagagcattctgtttcatgggtatataaacaagttatatggtacctgcatgtgccattctagaatttgagtaattctgaaagaatttccagactctattcctgcatgttctaccctaaaaatagcagtggaagtgtgaaacagtatggtgtgtgaggcaactgcaagcagttagaaatgcttcagatgtaggtttgtgtgggaaagggcacactaggaggagccaggtggtgcagggccttctgtgccatctgagatgtttgcattttatcctgtatggatctgttgtgcattagcagcagaagaatgacatcagaggtgagtgtttgaaaaaaatcgcagtagtagcagcgtggaagagagcctggcaggatgagaaatgaaagccaggaagaccagttaggagagagactgaaagaatgacccagccaaaagaggataagaggataaaggccagaacagtgtcagtggtagtagagatgaattcaaaatgagtgatagccatgtgtcagatactgccttaggctctggccattgtctgtaaacaaggccacctgccataccctcatggaggttacacactagtgggaagaacaaatagtaaaattactccctgctcttcagtttgagtgactgaaggtgggaatcactaaacaggagtcagtttagagggaaataatttcaatacgttgaatctgagctgtgttacatatccagtatgcagttggaaatagtctacagttatgagtcttgggcccttttcagagggctactttgtctttgttagttttaggataacatcagtcaggatttttggttgcaaacaatagaatcttctctggcttatgtaagcagaaaagcaactttttaggagctattggatatcaactcatggagtctctaggaaggccagggagccagaatctgaatctgggtttcaaggagcagtgcctactgccaccactgtatccaccacaaatgctcaggatcaccctatctccacatgtggcttcttgtgaacttcactcactggcctgccctctggctggaggggattatgagcaggtaattttctgactcctaatatgggaaacagcaaaataaggagagttttcaaagatattgcacagctgtcaatgtccaacaaagatatttttgcctccatttgcatctgaatgaaaaaaattaatttcaggagtatgtagaattttatagtgatctacaacatattttcatgtaatattatgatgaaggcacattgtcttcctgtaaacaaaactgatttttcgtattaaaatgaactgttttgttaatttggtaataaatttgcttttgattgatgttcaccatctgactggacagccccaaggttattagtggatttcattctaaatgattaagttattaacgtattaaattatgaatatatcttcccattgaaacaaagttatcatgggtgactcagttcctgtgtgtattttaaaatgtgtttcacattccagtggaagctcctagaacgcaagctgcttggcatcttcagaagagaagtgaaagggaaccgggatggagtcatttgtgggcacagtgcctacagacacattgtagccattcaataaaagttgaggaagtgtttctaggaatagatggttggagggagagaaggaggaaataagcctatgtttctaacatgaagctgcctgtgattgttgtaataaacatgggtttattagaacaattgcctttggtggtttaaaacagcatttcaaaattccatctgttttgttgtccaatccctgagtcccaaagtagtgaacaatttgagagtcatttgaagtgagtaattcaaaaagaaaataggctgttatgaataacatgtaatgaccagttatttctcagaattatagaagtttctgtgaaagtagttgggctgaatagatgatcttcagagtataccatggaactatttatttatttttaatttcattattagcttgtttttctaatgatttatatatggtaccttaaatggaggagggaatattattgaggcttcccattgccttcacctaggaatacctattatattttggtaaccaaaggtcctttcagcagcaaaaatgctgtttgcttgattgttacacaacgaggttgctggagcttcctacctagactcggggagaataagttgacctgcttatactaggtaatacctggtaatttgtataatctgacctttcaaaacattaaagaacttgattttttcacaatttaattaagcatctgctgtgtgcctggcaaatgctaggcacttggtataaagagatgagcaaaacaaccacagcccttgccccatttgagcaattagctggaattatattctgtgacctacagttttgaggataaaaagtcttgtatttcattaaagttgatataagtttcaaactcagaagataaaactttcttaatattcccgagaaacttgaggtatactaaacatttccggatggcagtttgatttaccatgtattttaatattgacataaaatatgatccttttgaggaaacagagttgggtaataccaatctcagtgcttagaaactaatttagataatagaattaaataacaaaaacagattgaggagaaattgaaattcagtgtgcagaaccacttttggagtcacaagacagtgatggcctacccttaggagcaagacaaatgtctcattactgatatttgaccaagttttcactttttcctatcagtccattttgaaatcagctaagagtgtttcagataaaggaacatcacagagccctggaggagattagcattaactgattgactccacttgctgggagaaggtcaccctgcttgcaattcgttcagtggtcctggaatgtgaactactgcacctgtgatggagaaaaggcaaatcacacacaaaattgaagttcagggagtttctatggaatctagggttttcaaccagcaagtttcataaccacataatgacttggggaaagtatcaagggggtaataagaacttaaaatctcagaaatatagcactaaaaggacggttcttcccccactccaagtgctttatttggcagaatgtttccttaagcccagagtcacactcctttttctataaatttaataagcactcaaaaaaataccatgaatatatgtcctttttctggttttttaaaaggaaaaaaggtataaatgattaaaaagaaaaacatgtaatggctgtactcagggatataactgctagcacattcatttttatttttctagacttctagtcatattgtctatgtgtctgtatgtgtttaatgcaaaaatgggatcacaagctgttctgccaggtagcacagtgataaggtgcacgagtttggaatctgaccaggagtcctgggtgtggttccagctcttcgagttaccagcatgtgtttctttgtctgtaagataacaataagggtgtacctattcacaagattgtgataaataacataaaggagatcatatgtgaaatgcttaatctagcatttaataaatgcttaataatccattctgttgttcctgtattctgctacactgtccctgtaacaccatggtttcctgtattgattggggcaagagaggtggcaagcagggaggcactgatatgtttttattcacaaattttttaaatgcaccctctaataaccaaggaaaatacatagctgtcactttatcctggcttataggaccttatatttttgatatgaagttctgcgttttaaattttataaggcaatattcaattcaaaagtggcctcagtaatttttgtctctgttctaattgctgcttttgaaaatacataaaataaactgtttaacagcctttttggttctttttcatatatatgatacgtatgtggttttcatattatcacgaaaaaactgtagtacatcatgtaagtactgtgaatatcatacagttgtgctgttttgtcttcttcaagtagaattttatgtcattttataatttgccttaatttccaaatagaaacaatttttgtcccaattttaaatactatctaaaaattaacttagataagtttaaattttatttaaggtttttgtgctcttgtataatttaatgtggaaattaaatgttaatatgcaaaacaggtcctaagctaaattttatgacaaaataaataaatgttccatttttttctttctttttctttagctcaactgagaagtcatttccttggagatcaacaggtatgttttttattatataaaagttatgtttgataaacacaaattacatagcctactctcttaacttactatctcttggtgaaataagccaagcaaagcctttaatagtgacaatattgcgctacattgctttggaatagtacttaatatgcttaagtttttagtataattgagtaaatttgtgtatgtcaactgtaatgaaaaagcattgaacagcagcatttttaatattaaccccatatctgagagtttccatttccatcataagaaaacacagggctgacttcaaaaaaagttattacgtaatcaagaaagctgctaattatacaagttgggtatttcactgtgtttatcatactcagagaaaagtcgcttgaagttttcatttttttaatgtatccacatgtagaatatctagtagcttctaacatagtgtggtagctttccatgtagtctctctatcttttctttttaacctaaattcaccacataggaaggatgaattacattaaggagactgtctgtcacttacacaaatcgttgatgtcttcatactcagccttcactcaataaatgtttattgagtattcacataatgtactgggtgctgtgcacattgctgggcagagtgatgggcataacacacacttgtccctgtccccttcccccatggagcttacatcgtaatcagtaatgtgaacaatgttgtaatgctggaataggcattgatgtgtaaatactttggcccttttcaaacaagacttgaattgaggaagacttagataaccaaatgcccagtatctgagtttatctaaacctagtgccaggattctggtgttccttatactgcatacaaggcacttggctgtcatacaaagaagttctttcccccagaaaaatagcgttaactcaaactgttgatgaggcagaaacgtgaaaagctacctaacaataaggcttctaaacaacagtttaacacaaggcaagtcacaccatgaaataatatgtggttaactgccaagtaagtattatgtgggaaatactgatataagtggacagcccacatctgagatggcagaggagatggtcctgcagccttgggcttgatgggcggctctggagagggcattgtcactgggcaaaagaagagacaacacaagtgtcacgggaagggaacatttaaaactggtctgggaggtgataagacgtgcaaagtctagaaggctgaattggctgaaattacagagatctgtaagttccagggactttatactctctccgtgatcatggggagacactgaaaattcttgaagcaaaatgtcatattatttaaacatttctcagaagaaacagcagaggtgtgaactggtgggaggaaaaattagtgacaagatagaccaattgaaagcttactgcagaatttggtgtgtgagatcatctaggcaattcataaggatttagaggctggtgtggtggtcaggtgggtaggcaataactgtgaggttttgcgtttgggaggatggtacagttaaaacaattaggagtgtcaaaatggagagccagtttcggtgggggtgctctggaccacagtgtgagatgtgttggatttgagatgattaaagggcagcaagtgacaccactcaataagcatttagaaatgtgattactaaagaaagcctttattcaaatgtgaagaaaacacttctgttaaaccgataggtccatgcatattaatactttattatgtggttcagacatgtgggccagagtgctgtggataagggacaactgagttagagaaagcatgcctgaaacctaggagagcagcctatgccaggagaaagctgctgcttcttattcttgggaggtaatgagagaatgatctgaaatctgaccaaggcggacagagggagtcaggtgagatgcagtgttatttcccccactttgtcacagcatttaaggtcgttactgagagtgggagccatgtctgctctgttcaacaaagtattccaagggccttgtgtgtggatggtagaccctaggtgattcaccacctgagcgaatgaatactgcatacatgaacgaatagtaaatgctgctttacacgtcctaggaatatttcgtgtgcatatattagcttcacagccaaattctaagctcttgcaaagtgtctcttttttctctcctacttcatgcctagaaaatgcccaacctttagaaggtattaaaagtatacctaatgagtaaatgaggtgaatattttcatttagtaacaaaatctatattttgaaaaaatatatacacaaggaagttatgtttttaaaagtgacaagaactatttttgattcataacttgactcacaatgccttaaaacctttatagcctaacaggacgttagtacagtattgcaggtttgttttttttatggcaaatttggcacacatgcatgtgaacttaattttttgtttgtttctcttaacagccttttctttctttatgtataatatacaaatttctttattataatagctttattgagagataattcatactatatagtttacccattttaagaatactcttaaattttttttagtatattctgacttgtgcatctatcaccacaattttagaacattttcatcacccctaaaagaaaccatgtgccagttagctgtcacgccattttacccccaaacttaccagtcttaggcaaccactaatctattgtactttctttccttatggatttgcctattctagacatttcagttgaatagaatcatacatgtggtccttgtggctggttcctttcacttggcatgattttttcaaggttcatccttatcatagcatgtaacagtagtttattcctttttatggctgaataatatttattcattcatcagttgatggacatttaggtcttactacttttgtctgttatgaataatgcttttatgaccatttgtataaaagttttgaatatatgttttcagttctcttaagtataaacctattagtggaattgctaggtcacatggtaactctgtgtttaacccgttaagcaactaccagattattttccagagtggctgtaccatttaacatttccactagttaaaaataacggttctacaggagaatggtgtgaacccgagaggcagagcctgcaatgagcggagatagcaccactgcactccagcctgggcaacagagcgagactccttctcaaaaaaaaaaataataataaaataacagttctgatttctccacatcctctcaaacacgttattatcctttttattatagccgtcctagtgggtgtgaagtaatttgttgtattttaaccttaccaactgccttcatctcgactttcttctttactttgtaaatataatttttctcctgattctaaatgtaatatatactcatcaaaagatatttggaaaatatttaaaaagtacaaaaagtggataaaattacttataatcaagctcatcacttagcctttctgtgcatttgtgtgttacatacagtttttttaccttttgagagaaatggggaacatactgtatatgcagttacatttgccagtttttttcatgtaatataaaattcttcaaattcatctttaagaatgcataattaatttatttctgaaataaataaacacttttctagcatgtaattgtcaatgtttaaagcaaacatccttgccctcttaagaacttcaggtttaatgaaggtgagctatagtggagatgtataactatattcagttacagttgggagataggggaattctataagggaaaatcataagtatatacgtatttacccatatctctagtatcggacattcagattttttcttattttttactattttaaataacagtgtggtaaccatccctatatataaaattgtattggtacctttgatttgccttaggctggaatttcaggaagaaaattatttaaagtacttgaatattttaatgcttttgctatatgtaaccaagttgctttcctgaaagattgtattaattttccctccctccaggtgtatgggattgatcttctcatattgccacattagtgtcatcatttgtatttctaattatctagagaatatagaagtacaatatagattgcccttttcttttctattggagacttagtgtttgatggataagagttctttgtaacccaaggataataggtgtatttattagccagggttcagctgggaaaacagaacccatgccaggtagttcaacatacggaatttgatacagaaaatgtagttacgaaagtgtgggttggaagatatgagtgattaaacaggatgatgaagcacccaagagataatgataccagaaagctgctatcatccctaggactgcagaggcaaaggggtaggtagatggttttgtcagtgtcctagagctggagcagtgggaggggcttcagacggggagatttccagcattaggtgaaaccaggaaggagatgccacccgtgccagaaatgttgtttaaaatagagccagagaaataccctgatttccccatgcaatttttctcctaaccctcaccagtctatacactggctgaactgagctggagagggcagttgtggatttttaattaccaaaagccaagcagacactgcatataatcatgtgttgatttacagtctagagagaatgagtttagattatgaagacacattaattatagtggacctatggccttggcatcctttctaccccttccccgttgcttaagtcatttgactgccatcttcagggtttttatcatggccaagtaacaaatataagagtacaaaaaaatagaaaaaaacaataagacctactatttgatagcataacagggtgactatagtcaataatttaattgtacatttcaaaataacaaaagtatgattagatgatttataacgcaaaggataaatgcttaaggggatagatacactattctccatgatgtgattattatgcattacatgcctgtatcaaaacacttaatataccttataaacatatataccttcactgtacccacaaaaatttaaaattaaaaaattaagagaaacccatatatactattacgtgcttagtattttcctttaaattaaagttttcaaatcttttttttacttttctagtaggctgtgcaatcagctgctaaatataaaaatatatatggtacacaaatgtattaaatgatttaaattgaatacataataattaaatgttgtccaaatagctcctcaagtactcaagtactttagtgttaggcagatactaattcagtggctaatctcccctcgccacaggtgtgtccataattcacacttaataactgcatagttccttatttttctcagagcacactcttgcctaaaactcatattcaagcctagtagttacatttactaattttttttcctttgaggggaaggaggaagggtattaacttctaaacacagcaatcacaactggtatttactttctaatattttaactgtataatgttgtggtttttcttaagtttacccacttttcagccatatttatgacatttaaattgtaaccatggcaataagctatagttagaagagtagcaaattgaaaatttatgaataaaatagtaaaatcttattttcttttctttctttctttttttttttttttttttttgagacggagtcttgctctgttgccatagccgaagttcggtggcgccattttggctcactgcaacagccacctcctgggttcaagagattctcctgtctctgcctcctgagtagctgggattataagcgtgcaccaccatgcccagctaatttttgttttttttaaattacagacagggttttgacatattggccaggctggtctcgaactcctaacctcaggtgatccgcccaactctgcctcccaaagtgctgggattacaggcatgagccactgcactggcccatatttccttttctagtaactgtagatgctatttataactttgagtatatattaataattgggataaaacagcagtgttgctgctgctttttctataaattttgacaattgttttttttctttgctgctttgactgcaaagatactgaagataatatgaaaatcatctatcttagaattaggcagtcctactcagaataaatgaggagtggcttaaatttgaaaaatatttaaaagaccatcagtccacttagtctttggctgggtcttgacaaaagcaacctctttattcgttttttggtttcctatacaaaatttcacaaaaggatttaggattgaaggtcctcatttatcctcatttatttttatactttgcatgtttacttgcagacactttctctaccttttttcttaagttttacaaatttgacttgaaaagcttagctctttaaaagcctttcagcaataggtggattgttagagatgcaatggtttgatcactgcttaggagcgatccctgcctactcaggtgttttcaggatgttatattctgttgaaatgtggtaaactggaaccagcctttgaattggatttttaaatagctaacctactgcagcatcattttctaaggaagagcttaggatgccctaggcagaagagattttcatttcactctcatttcattagattcaggagactctagcttgcttgtttgtgtgtttattgttgaggggctgggggcagaagttaaggagggtaggacatttgaaaacaaaaagcccaagtttctgaagtatgggagctgagaaagatacttcccaaagaacgaggaagagctgcccattctgccaaacatttttattttctcaggtctttaaacttcttccctagaagtaataaagttgttttggagcatttatgctttattattatcttgacttttgccctttctcttcattattctgtaccctctagcttaccagtgttacatatttgcattctaaaaatataaatgcacatcttttgtgtttttttatgaggagcagtttatttatgtttcagctttgtcttttcttgcatgtcttataaccttgtgtattctgctgaaacatttccgagggaatgttatgttagcgctcccttctgtttccataatattagtgtgtcagtttttccattgttcactgcttcacatctcgaaatatacaatctctgtgtgccatcaaaatttgaggtaacttgtaagaacgtatataatacaataaaaaataaacatcaaaatcacagaaaatacatactagaataataggtaaagggtgatgaaagtgagaagcatgtataatcataattcttcatgagcgaaaatgctatacagaatctttttctttaaatcctttgaatgtacctctttttaaagaaaaacaccaactcaataataaaaatagctacacacagtatatgctacccatcagaaagaatctataggttgaagccatggattgaagtttttttgtcaaaacagtcattgattgttacttaggtcccccagtcacattccatgaagtgaattttgctgcaagtcacaatatcacagtttttctgtttgcgagaaaaaaaaattactagagtttaggtggttgccaacttgagtagatctgtgtaaaatgcaggggaggagaatcggcctcagaatccagcctccctccgccccagctcttcctagcacattagaccaggagcagtccgtcttacagggctggaatgtgctgctctgtccccaccagccagccagccaagctcattctttttaacactgctgtgttcctagaaaaagaaagtgttcgagaaattgatggatgttacgtaggtgataaagaattggtgctcatgggtaagaaattagaggccaaaaaagattggaatctctaccaaaacaacaagtgagagaaattttctggttgactcagaaggcactgaggggttaatagatttggatgaacaggagagaaaatagtaacaattctgtgcagttaggagttttgatgtttgacagtaaatatggaagggaagaaaaaagaccatagtaaaataggaagtttaaaactgattctataacttcacagtgctgcattcatttattgtataacaggtattgaagtggtatgattttaacatactattcatttaaatcattactgtgtgaaatactggcattagttaatgtttactactaaatttaagactgtaggagctaggctgtgcattttgtttatgtatttaaattttgtttctaaaatgtatagatacaagtttcttccactgggatgagctttaaaaaataaaaataaaaaaacatcaataccgaagataaatgacaaatgagaaagtagtcctaagtcaatttatcttttcttttttcctccatctggtgcaagtaatttacaacacaaaaattcatcagcacatcatgagataagaagttgacttaaattgaaacactttatgcctcagtagaaatgtactgaatttataaaggagatacagtaggaagtgagtgttgtattgtacatgttcataaacaaaatattagatcagcaatcatgtataaaggactattattgaggattttggatgccgtcatttattatagccataaactttacaaatgacaaaactttatcatatatttcttcctgtttctcttctaaatataaggatgataagaatttcttttaaaatcagctgtagagtacaagtttctctcccttattttctacaggcccatttagccacacagtcttgactgcctttttaccaactgcagtgctatagcttcctgattgccactataaaagctcttcttaacttactgttttaagatgaaaataagatatgcttctttaaaaaaaaaaaaacagcctggaagaatctgagtaaaaggtagaaatttccttcattccaacatgttcccataccatgaccaacacacctacacaactgcacacacacacacacacataatgtataggaaaaaatctggaataatgaaacaccccagactgttaactgtgtttgtatgtatgtctaagtatccacacacatttgagttgtttgttttggtttaacacaaatgaagatacactctacgttattctgtgacttttaagtttttcccctaacattacaaagtaatggatgtgtttctatatcagtatataaagccctatttctttttaatggctaaatagtattcatcgtttgaaaatttatataaccagtttcttatcagtgaacattttgttttttccagttttgtactttgacagacaatgagaagattctttctgcacatatatgagtgtctctgataggatttctgtaactgaaacttcctggacaagggtgtatacattttaattttgacaaatattgtcagtttgcccaccagaaagcttaacaatttatgctcctactgatagcacctggtagtcctatctacacttactatgttaccagagtacaggaatgtaaatcttcatgattatttaaaattttaataagttactaggctttaacaaaaacatttgtttcaaatttctctatatcataaaacaggaacagattgaacaaagtaagataatttttaaatatcattattaactattcattaaatcataacactccatggaaacttgagcataccccggaccatcatgctaattaactcgttctcatggagattggagatcagcatgaccttagaatatagtaaaagtatcatactgtttcctgccagtttggctttcttctgtcttcatagctggctcaaaatgatcagatacatttttctatcatgaaaaatgcaacaaccactaccaaatcaagcaaaaaacaaacttaaaaaatcaccactggatataattgtgggtgccaacatctcactccagaggttcctacacactgctatacttcagagtcacctgcagagctactaaaatcttgacgcccaggcatcacccccacacaatttagttcgaaagtctgagttgggaaccaggcgtcagtggggtttaacgagtccccaggtgactccagtgtgcacagtttgagaaccactgctttattctaaaacctagtcattaaagagaagaattaaaaatttatcctgcctgtcctgttcatatttcaggataagtaaataatcctagctattatgtaaaatattccaaaagaattcctgctgataaatgtagaaagaataacaaaattagaaaaatcactagtttgcaagctctaatgaaataattcaagcaaagattgtcagtggatgctaaaacctcttaagttcccaaccctagctgcacagtagaatcaccctgggagttttttaaagttccattattcagaatacagcttagactgattgaattggaatctctgagtgtgggacttggacagcaatagtgttaaaattccacccaattttcaacccaggtgattgcattgtacaaccaaggctgagaaccatcgcattaggagacagattggtggtaaacttgacagaggattaggctgccactacctgcattgcctgatagatcttagcaaccctgaaagttgtaatgtgaaaggtgtgatgtacatggcaccattcataaagtatgctacccacaaaggcttgacctgaaagcttttagctataaccttctgcttaaagaaatagtgtatttagaggaataagtaaatgacatgagaaaaccatcagataaattcaggatgtggaacaacttaaaagtgtattgctgcagtttcctcagttcatcaaaaacatgaaaatgaaggaatgggtgcccctttctaaattgagggacttaaatcagttgtactcaaatgcaatcaggaaaccttatttcagcttgacgagtacaagccaactgaagaaacacatttccaagacatctgaaaaatttgaatttgaacacactatatggcattatggaataattatggttttatgaagtccttattttatagagatacaaatggaagtatttagagttgaaatgatccgacgtgagagatttgttttgaacttctacaacaaaggaaaaagataatggaaaaaagtatgcataaagtagaacttttatatatgtttaaaacttcaattacaaaaaaattaaatacaaatgctttaaacaaaagttttgaaatatcaaggcaaaaatggtgtgctggagtgacatggtaaagccagcaaaattttgaccatattctgaaggtcagccctgacataaatgatatgaagaaaccaactatgaaatggatgcatgagtttcccagccagtggatattacttaatttgtagtttccacatatttgggattttattaagtgaatttttatcgaacaaattacctatattatacagaagatcagcctttcaagtttagaacgatagatgtctcaatatgtttatcgtgggccaccaccaaataagaatattagattttgccctagcaaacataacatctaaatattccaaagccacttatgcatgatatatgaacagattcccaaaagcacattatatgaaaatcaagaatccagttttagcctttaatattttatgtttgatataaacatgccaaatatttaaactttctcatgcttttagtgatatgtgaagaaatgtgctactatctaaaataaaatagaaattgtcaagtctgaaaacccttctttttctattaccacctcctcaaaacacagagccttcgatcctcaatttacaactgttgctttgggaaacatctgaaagccaccctctataatttcacatttcattcttatgacaaagttagtctgcatgtggctttatcttagtatattttacaaaaaaaaaaaataactagtggaaaaatatagaagatcttatttcaaaagaatcgtttctttctttttgatagtgaatatcatcctttataggtttgtgtttttaagaaggtttttttggtttttaacaaaaggaatcttattttgtatctcccactgacagatattcccatttctatatttggtaattttttttcccaaagagaataaaaagtgtctttgaaaaatattttagagtgatttttgatcacttaattgtattttccataagctgactttttatatcacaatgaatcccttacttatccctttttcagctttcctagataggaagcaagagcccctcagccatttatgaagcctgttaaactcagtattgggcaatttatgtcttgttcatttcattttgtatttataattcttagtttcttggtttttttcttgttttccttttataggtataaagtataaatttttatggtagctgtgacatctgtattttaattagtatccagactaaaaatacttaacactcatttttatatgactatttgtggaaatttctcttcagtttattttttgtaaaatttatttttaatggttttatattcttggacagaatttatatatgaccaggagatctcttttagtttagtcattgtggaaatcactacgataccagtttatgcattcacaaaatttgcttatactatagattcgaatccaggcagtcaagctttacagtgaatttcaagacagactagttgatgcttaaagcagagtttaaagtgaagtagaagatacttcgttaatggtttccattttccgaggcctttttatacaacactttttagacgggtaaaatttttagagccattgcctgattaatattgataagataatataaatatgcacaagacccaagaatctagaaaccctcaagaaccagaccagaaatagtttcaagaaacatggtctttctgcctttccttatgtcttcacttccattgaaatccaacttttaaatgatatcctatgtatatagtagcttatatttgaatcaacaaactccaagtatgtgtaatattcttaaaatatctgtcaacttgtattttctcctgtggaggaaggaatactattggtgcttcatgtttccgtcaccctgaaacaacatttctcactctgaaacaacgtttcccagtgacctcattccctctgatgataagcatacctgctatagaaataaatcttgtatgtcacagaaggtactaaagaggagaaatctttttggtgccaccacctatgttctcttccagaatttggctttgcttttttgccgtaggaggcactggacaatttctgcacctctgtggaaagtagactccttcgtaagcctgtggtcctacaggaaaggagagccccatgaccagagaggaagttgagtccatgtaacacaacagtttctactcattttttccacaaaatgttgcccctctgggtatgacagcctaacctcagctcacaagccagagagttggaagaaaccgtcaaggaagagtatcatctgccttaacctcgggtgctattgctgtcccaagagtcctgccaaaactcacaccacactgtcttttatgtaagggcaaacccctaaacaccatagcaactcagaacagactcaaacaaggagaacctgtcatgaggttccagtgtgctggactatgaaagactagtcacagggttgtctatactaaaaatctccttactgatctctgggttcctgtttccatggtgattttacacacactacagaccctgtttcgtacagcaagacatagactaacaaagcagaaccattttaataatttcaggttcattaaagaggccttagactcttttactaagcatatcttcatgcacacactgtatatttggggatgtacattataaaaaagataaaatatctcactttgtattccatcttttaccatgagcttaatgaggtggataatataccagattttcatagccctacagcgttattgtcccttacccactagtattttctatagatgcaatgtaacactttttctaattacatagttttaaatattagagcactcaaatgaaatgtaataagacaagaaagtccatgattccaataattttgcagtcttaggcacaaatggagatttcattctaccttgaagcttgttcaatttctgtatttttagacatacattttcgaagatgctaatttgatgtttgaaagttccccatagtatatttctggtgtcccagaaaacatgtttgtgaattttttttttttaaaccaacgcatgttcttcagtacactgattaaagaagtaacattcacatgctgtttgccatttttacttataaaaatgtctcttgatttcttatgctaattgtgctaaattttaatattccaactatttaattataggttacagcattcatcatgaaatggttatttgcacactatatacctcttctctagtgaatttgactagtatctttcattccacatagcagaggtttttaaaattcattcatcttaaagtaagattgtttaaataatacataattggtaaatgtgaaccttaccatactacagtgaggaatactttatccagtaaaattagaagatgtgtcttctgtttacctgagatatgatgtctgtgcatatataggtttatgcatgtatatagataatttgtggatcacaagttttcaaagaaaatagtaaaactattttgaaaaccatttaaatttcttttcataaatcagaatagatttcaggatactttgatctctgcagctattcttcattatcattgggctctactaaggaaacagaaaaataactgaatggccgagcacaatggctcacgcctgtaatcccagcactttgggaggccaagatgggcagatcacttagggtcaggagtttgaggccagcctggccaacgtggtgaaaccccatctttactaaaaatacagaaattagccaggcatggtggaacacatctgtaatcccagctactcaggaggctgaggcacgagaatcacttgagcccaggaggcagagattgcagtgagccaagatcatgccactgcattccagcctgtagagactccgtctcaaaaaaaagaaaaaataactgaagaccttatttatagaatagaagttgattgctttatactaaagttcatattaaataaatcttttattaactcttagttttatatttacttaaagataggtcacaaaacctaagtcctatcctttaaacccagttacttagattttcaaattagatcctgggtacctgagaattttgtattttagtgttctagttagcatctcagtgtccttttctagattctgttttctagggcgttgcattaaaaaatatatgaaacacaggtcataatatttaaaaggaatatggctgtcatattacttttggaataattttgtattgtttgagatactaatttcgtgaagttttattagggcaaccagtatggaatcacatatctcatgatttgtgctttctctaaggttatttattttaaatagcttctcataaggaagagtttaaatgagcaagattgttacatggtttctgagaatatgtttcattgagtgaaaagacacaatttctgagctacaatttttagggtatgtttctctttttctgttttttttttaagctctgaatagctttttttaaaaagtgggtgggcagcttacataaaattctaatggttttggtttccatggtgaaaaatgttgagaccctgacactacatgccacctagtgtttctaagccaaaagctttaatatattggtgtcctagattttaccttatatttaagtaaagctgagaactatctgaacatctttttcttttccaagacagaacatttttccatgtatgtgaagccttgaggctaccacagtggtactttttatctgtagtttcttgctagttcgtatttgctttcccagggtttccgtccctgatggaacaaaggttgactgctgcatagctctgatttcaggccagcacctgtgcagctattcccagctattccaattccttggtattttacttagtccttagcaaaactcctttgagaattactgtataagaatgtttagaactctggaaaactcatgatagaagatgtacaagtaaagcagagcactttctggtattgtcagcctgacagtgactcagctcatgtttcaacgtgtaccagggaaaccatatacaatctttaatctttgttgaaattccaaactgaagcaatcagaactgtcacagaattctaccatacagaagcattctgtcaaataatataacaggagacaggtcggtaaaaacctatactaagaatgtcagctaatctttccagaggctaggaaacaaaaccttgaattgaatctgacatcaagttaaaggtttagaatgcagtgggatttcccacttctcccttaaaccttgtattcaccttctaaagcagcttaatcagcagtccctaagaagtttgctttacatagccaaacttcattgaacacagtaaggtaaagccacaatgcaatgccaggcatgagtcagcactcagtaaaaggaagctgctgttgttactgggaatttgcttgttcaacaaatatttactgagcacctactgagtactctgcaccatcctagacactgaggatataacaaaccagataaaagtctgtctgtcctcgtggagcttatattctagtggggagaaatggtgataagcgctatacagaaagagaaggctggcctcctgtggtaaatggatgctacttagatgttacttcctttaggaagattttcctaagctccattcccccagacacacacacacaccccttaccttctctcataactgcatagggcctggcatgtaatagggcccagagggagacagggagggaggaaaggaggtagacatttaaatccttaggattgtatgttaaactcagaatgtgataagaacttaattatctttgaagtgagagtgaagtagcatttccgaaaaaaagtttgttaataatataagggttaaatgcaaggaaggaatggcttgtattgaagtccatcagaaaatgggaaaatacattttgaagatactagagaaagaaggacatacgggaatcgaattgggaaaaggaagcatgatctacaccacctaagtttacggcataaaaaacagaagtttgaatggggtttgtttttttcaagttcaggatggcaaatggtactgttaaattaaagcagataatggaagagatgagtttggctggaagaaacaatgattaggttagacttgcctatattcctttaaaaaaggctaaaggaataaaataagcaggtgaacaagaaaattttcattgcttgcaattctaaaactttgtatagagttcctttgactgtaagtgacatgaaatataacataaaatgtgctctaccttcagaggcttcatcaccaagctcaataatatgaacgttgtgtaagttttcatttttaattgtttggaagatggaggacccttcttgaaatacttggtctccattctcagtcttttaatcccttggaggaaggtgtctgagaggtcagttttccaagaggaacaggatcagttttcagattttgatttaatattgagacttacaatcacaacaaacaacattcatgaaattcagcaaaatatattaatgaagtataagtatatggaacacattcatatagttaagagtcagatgtgctgtgtaagctgaaaataatagccttgtattagcatatagattctaagatgctgttgacaaacatctgaaccttttttagcaagtttttatgtaatgttattatatttagctgattaaacttttcttgttacagacgtgccaaatactggtgtaagcaaacctagagtttctgacgctgtccagcccaacaactatctcatcaggacagagccagaacaaggaaccctctattcaccagaacagacatctctccatgaaagtgagggtctgttgtgttatcttttaagtactggatttgcttttaagattttattcttgaaagcgagtgtcagaagtgtgtataataaagatatttcttggtttcattcttacaggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcaggtaagccaaacgcatcaagatctctgcaaagaaataccttccggccgggcacagtggctcatgcctgtaatcccagcattttgggaggccgaggcgggtggatcacctgaggtcaggagttcaagaccagcctgcctaacatggcgaaaccccgtctctactaaaaatacaaaaattagccgggcgtggtggcgggcgcctgtaatctcagcaactcgggaggctgaggcaggagaatcacttgagcccaggaggcagagcttgcagtgagccgagatcgcaccactgcactccagcctgggcgacagagcgagactccgtctcaaaacaaaaaaaaaaaaaaggaaaaaaaaagaaatacactcctagttgaatatctgttataggtatttcttattagaaataaatgtgtacaatttttatagaatggataaaatagtaaaatcattttattctatttgagatacaatgttaaatatgtttgtttctatgagttagctcccattgatgaattctgatgagttcctggatacagtagagtaattcttctggaaacaacaagtttggcatgaggagaagagtctaaggggaatgtaagagagttgaatggaatgttttggtccctgaggggttatgagttcctaaaaatactagggctaaaatatgctataaaaagctctagagggcagggtgctatacccacacctgcataaaatgggatttgcccattctaaccaaaggttattaccatcatcactggaattattctctaaaactacatttcttttcttttactagatagaatacagctattcctgcttaaagaaagttattgtatagaaacatatccattctgttaagttagggttctctaacttgatagcaaaaaatatatattgcatgtatatttataaaaactcttcagctcctttctcattaccactgtattcacatcagtccaccagcatgtcccaggattcagagaggcaataggagtcctgcatggtggtaaccagtgaggctaactatctgtgccaggaccccaaaaccccagtgctttctttagagctgaaaagtagcaagataatcaaataagttaggaggacactgtgctgcttctactgcaatacaggaagctctacaggtacacagcaatgggtcacggttcccaacgcccacagagaaacataatacaactttggcacttttgctcagcaattcaggagaaatttcagagtcatttaaaacatgtttgtattaaacacaaatataacatatgaatttttcaagctaaaatgggaaatcttgtgcatgtggcaagcaacttcaggctgcaccccaagtcctcagattatatatttattcttttgctgttggggatgctttggtggaaaagtttgagaagctctggactaaatgctaatgggagttcatccgcttaggtgaatttctgtgtcagcaggtctgaaatcacacttttcaacagcagttaccttatatctatataaattttattgcccttagtaatgatcatgtaaacacttttttctttaagagtaagttgattttctcactagagctaaagaattgtttgcaagggggtgtctgagacttaatttgcatgtagtctaggcaacacattttctagttgtctggaccaacttatcacttcattttggtagttgcaagtcatgtgggattttctttgcattttgttaccactattaccacccaatcatgctttttttgttgttgttcttaattaatagagacaaggtctcactctgtcacccaggctggagtacaatatggcaaaatcatagctcactatagtctcaatcccctgggctcaagcgattttcctgactcagcctcctggagtagctaagactgcaggcacatgccaccatgcccagctaatttttttgtttgtttgttttttgtagaggctgggcctcactatgttgccctggctggtgtcaagctcctggcctcaagcaatcctccctcctcagtctcccaatgtgtagggattataggtgtcagccaccacacccagccccaatcatgcttgttaactttccagctgtctactaatttttaaaccccatcttttttgccttgttgtttaccatcctctttcctccccatgtcttctcccctgctattgccttcccaaaattgttgaacttgaacacacagtgagttctcactgcaagtgtttcagccagcccagttgcatgcgacacctggaggcagagcagacatcctcatatgacccctaagggtatacaaagccctcatctgatccctgcttctttccttacctccccacctaaaagtggatgtgggttgatgacaactagactctagcagccactaaggaggtaacagagcagcctggtcctagtcttctaacctggatccctaatgtctttatttctcagttggctctcctttttcccatacatgtttcccttgggccccttctccagcctaaccattcctttttattgttgcacagcatgaaaaacagtgtccagcacctgctgtaactgcaggaatcaacagattcagagtaggatcagcaatggcagaaatgttcactttccatcctggtcttttccagctgtctaggccaagaacccaaaagaggctttgaccattcctcctgctggaatagatttgggggtgccttttttttgcatctctttaaatccaccaattaaagctaagaactcatagatcagaagaggtaaaaagaaatggctaaagtgagaagctatgcttgatctaaaggaatcaacaaatttgcctagagcacctgtgtagccaagctgttccccgaagtaaattcacagtggagagcgccagacccacacttgatccaaatgttcatttattccacaatgaaagaacatgttccttttgttaatgggaccaacccataaagaaaaacaatgataaatattccactagctacatttagactgatatattcaaattatattcaaatttttgttttacataaatgcattgccttggccaaactttgcttcatagggaatgaagtaagtacattgttctggtgccccttcacgctcatgaattacatgtaacacttagaataaaacattttatgtgctgtgaaaaatgcataggcaatagttaaaaatgtaaagataaaaaaggagtattaaatgtcttcagatctctttttacaggttaattttagcatttggtttaaaccaccaaaaaaaaaaaaaaaaactaaaacaactaaagcaccgtgaggaaaaattaatgtctggctcaaagcataaaaaggaaaagaatcttagatgcctaaaatagtggattcacattctgtagtgagctatgtgtatttcttttgtaatggcaatgaacacaaaaccctggataaacccattctcttttttccccccctttcatcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggtgcgtacaaggtgacagtgctacataaaacccagtgaggaaatcttctgtgtaacttaagttgaaacaaagaatgaaaaggtggaaaaggctcattcgtgtttttaatctcagattttaaactataaacttaaggttaacttgtctttcaggttctgtaattcttaatacatgaaattatatacatttatatcaatagaatccttttgcaatggatataactcttttgtaatattttcccactaaatattagggtttaaaatgtgctttttttgcatttcataagtattagttgcaattctaagcagttgactaattttttttaatgaaatattttttaccagccaggcctacccctaaacataccctaaagttatgttaaaaggtggtatcagaatatctgtttaaatgtttaaattttttctttagaaatgctttggtaatatagactagactatgaattttatcccctacttgattttggcattttaacggtaaatgcacaaagcgcttatgaatcacttttacatgccactcctattaaagcagaaagacaccgggtccctaatacagctgttccaacttcagggtttttcgtggagggtttcctacatggtgtaaagatttggttattttaaataaaatgcaatttaactttagtgttttaaattatattttaaaagtaacatatacagaatggtaaaaattaaaactatatgggaaaatattgaaataagtgaaagccttttaccctcacccagtcccatcacagttgatgtggctttcagaatgtttctttgcatttacaaatatatgcaatccatgcaaatctgcacacacattgtgttttctattgatggaattctatcatatagatcttctatactttgttcttttcactaactatgtcttaagagctctacctcattcttaatagatgcatgggacccattttttatagatatatcataatttatttgcattttcctcctaatggacagttaggttgtttgttatgtttagctgttagagatgatgtagtacatacattgttctccctgcatatttcacataagtactagggtaactgggatccagtagaattgctgcatcaaaatatatgtgtatttttactttgagagatattacgtagaattgccttctaagaaggttacacacggatttatatttctgccagtagtttgagtgcctgtttgtctataccttgtctacactgcactagtgctgcatattccaagtttttcatctttgccaatctgataggtaaaaagctgtacctcattgtttttaagggcttttattgagttatgactgaggttgaagatttaatctgttcatcaacgactttatttcattttgtgaaactacaagttcttttgtctatttttataattcgtgaaagcttttttttactagagataagctcgcacctcgtaatatgcttctcaagtattttttccattttgtcacttctttttatttcattttggttttaatttacaaaactgtttaacattcttacatagtaaaattagtatcttttttatgtcttctaagaaaatttaagcctttttgagatttttgtgattgaataattttgcctggagaatttatattgaacttgatttttgagctcaaagaaattcttagtggagaaaccacctctttttcattcatctatccaagaagtgtgcttgacttagatattttctgaaatgcctctgaaaagtatgcagcaaaatgatgtaggaatcatttatgaaattctacctcccaaggaaatcttagaaaataaatagttctgaggacttccatattcccccgtgtgtatagaacagctatgtagaaatttctgcttgtaagagagtagagaggagactggaggaaggaagccagcatataaattattgtctccatatttaaccctaagaggactcatttcctctggtttaaacagtctgtttctctgacaatgcaggtaaaattagactttatgtcttggggggaaaatatatataatgtctattttttaggcccagcctctcagtgatttttttctagaaatactgcagtgttctcaagaagcaaagtgttcttgatttcaaaggactaatagcctgctaattgataagcaatgttttgtactacattcagggacttgggtatttgatgatcataatttaaatgatacaaactacagaaatatatatatatatactctaaaatgttcatttcagaataatcatggcatgtaaagaaaacttttgaggagataaagaattgatctttgaaagataaatttatgtttatttctaatgccataaatataaatatttttaatcacatggaatcaccgtaataatagctaaactaatatgtttgtggaattgcaaatagaaagtattggttggataaataatgcagtggcgtatcagtgttttccattatttggaaggggaagtaatgttattaaaaattaatcagtggaaatgcttctgaaaaaattattttttatttatttttatttatttttatttttttatttttttttgagacggagtttcgctctgtcaccaggctggagtacagtggcacgctctcggctcactgcaacttccgcctcccgggttcaagcgattcttctgcctcagcctcccgagtagctgggactacaggcgcctgccaccatgcacggctaatttttgtatttttagtagagacgggttttcaccatgttggccaggatgttctcgatctcttgacctcgtgatctgcccgcctcagcctcccaaagtgctgggattacgggtgtgagccaccacacccagccctgaaaaaattatttctaataccaattatagaacataattatttgaattccagtttcaataatagtaaattatagtgagctgtctacacatattcattttacttaatctacagaggctatttactgtaattttttaaaatgctaatctataggactgtgtacttgtgtttttaaacacacgagcgggtaaacaaaaatagtttactactatttattatgtcattcagaaggattcttaatatcaagaaagtgctacatcccactaaagttctaagtcttttatttcccattatagcctatcacataatagtaattccaatttactaatgatcctataacgagtgaacatctgctggttattttttatatttctaaatgcaaaaagctcattttgttacctttctcatgaaatcatagtctgtgcttacaaaacctttcagattgcatggattccagtgacgaatccagccagatacttgtaaaatgagaatataacattgtaatcgtggtgcagaatgctttgtcttatttcacatccctgtgcagtagtgggaacatgaggactcaaccgatgtcagaagcatccagtcttcggcttggctctgtccaagtgtaaatgatcctcagtgtcttgcactgagtcgtgagtgtctgtggctctgttgggtgttacaatagcacctcataatgataagattatcgaggactaggtacattcacctgtctgctttatgtcactgttaacaaaaactgtgcacttttgtctaaggtattcatgggctccataaagaaatagagcttagactctgctaaaaatgataataataatgagaaattggccagtgcctaaaaagctgaaatcctcaaaagggaattttgcaatagcaatcacagtgtcatctttaaagttggtttccatggccccctccttggtgtgcttaccttcctctttaacctggtgtttgtggagggctctgtggagttcagacttttcctcaccatgtgccgttgctccatgagggatagctgtgtccagtattgggtgtataatgacagaacactgacctgtgctttcctgtcagctcggcaaggaagtagctctctaatgggggcgaatcacatttccttttggactctgtttcctcggttttgaaatgaggtttggctggataatctcccagttataagattgtataaacctgtggtcttcgttatagcaagaggggagccagtagctaaaacccacattgattcgtttagtttctttccatgtcacattgctgtccagggtaggtaataatcattcactttagaagctttatgcatgtgttaactttcttgcctctcctcactaaccaacatgtaattagcactcttattcaggtccatttgcttttagttgtgatttgattaactgaactaacaggatgggagcaatcttttttttttgagacagactctcactctgttgcccaggctggcgtgcagtggcgcgatctcggctcactacaacctcccgcccccagattgaagcagttctgtgcctcagcctcctaggttcaagcaattctctgcccagcctcagctgggattacaggcgcctgccaccatgcccagctaatttttggatttttagtagagtcggggtttcaccaccttggccaggcttgtcttgaactcctgacctcgtgatctacgtgcctcagcctcccaaagtgctggaattacaggcatgcgccaccgtgcctggccaatcttacctttttataattacttactttgttaatgatttgctatttttttaaaagcaaatatatgctgactggcttcagatatgtttgtcctttctcttatatttgggatatacccttaattgatatttttacaagtgacagattttacttaccaataatggaagtcacaaacttctgagcatcataatatagaaaatattcagtctttttaagaaattgaaatgtttgggtttgaagtatacctttttatcatgagtcccatgtgtaaacattagttattagcagtttgaatcaaaatatttaaaatgatttaaggttcatgtactactaactttgtactttttctttatactagaaagaaggtaaacaagaatctggtatgtgagttcttataaaaacagtttttgggtttgattttttttaaaagaaaggaaaaacaatgataaatagtatttcataataatgttagttcactgataatattacaaaacttatagcacaaaacttccagtgtttttctgtaaaaattatatgtgagttaattgacatttcaaaacagcttttaaacatcagcctttaccaagtacattatataggcgttctcttagatgttgggattcaaagaggtgcgagatggtgggctttgtgcccagagagaagctgattgtccactgaatgagactggcaggtccgcaggataggaagagagcagcatgaaccactgctcatataaagcttttaaagtgaaaatgatataataataagtcattctctgtttgatcagcatcataaaatagcttactggaggatgaatctcagtgtatcaaatcatttaattttttgttatttttcttagaaaacctattttcatcctgctgccaagagaaagtgtttttgtttgtttgtttgtttgtttgtttgtttgtttttgagacggagtctcgctctgttgcccaggttggagtgcagtggcgcaatcttggctcactgcaagctccgccttccgggttcacgccattctcctgcctcagcctcccgagtagctgggactataggctcccgccaccacgcccggctaatttttttttgtatttttagtagagacggggtttcaccgtgttagccaggttgatctcgatctcctgacctcgtgatccaccctcctcggcttcccaaagtgctgggattacaggcgtgaaccaccgcgcccggcagagaaagttgtatttaaaatatatatatgcagtccttttcacgtgtggcatttctctttggtaaaacttactagttttagtgtttagacttaacacttggtcctattggttaggattttcttagtatatatctatgtatgtatatatgtatttatttattttgagacagggcctcacctggtcacccaggctggagtgcagtggtgtgatcatggctcactgcagcctcgacattctgggttcaagcaatcttccagtttcagactcctgagtagctgggatcacagacatacaccaccacacccaactaatttttttttttaattattttttgtagagatggggtctcactctgttcccagactggtctcaaattcctgggctcaagccattctcccacctctgtctcccaaagtgctgggattacaggggttaggaatttaattagggtttatgtttttaacctcactgtgattgtctcagttcttaacgatgtaatttttgtgcctctaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtgggcatcaactctgtttactggtttcctgatttcataggccccacagtagaagtgttttattgagattgggttccctgttagaaggaaatcatgttgcccatttggttgtcagataagcagctgtgacagcagatcaataagcaataaaacaggttcatttagtacctatttataggtgatatatttttaccttagtacattctaatcaatgaacatagtgattatactgttaattcaggaataagtttgtaaaactgtaaatctgactctcctcgggttagatgcatattcagtatcaaaaggaaagccttgttggaatatttctttgtaattcttttgccaaacaagtttttggagaaaatccatacatgagttacttggccatctttgatttagcaagcatgaagcccaagtgtatttggcattactccttttttaatgttggatgttctctgaatagttaaatgtagaatgtaaaatagataccccttgcaatggactcaaactggtacaggattcaatagcgacatttataaaagcagggagctggagcatcacacccttgtaccgccagtcctcatgtttatgccataccatcaaggctcatacagcagatgctgtagcccatggtggtgtgagctgccaggttgtgctgcacggctagctcatggagtctcaagactacttttttttttttagtaagtatcacaaatttattaacatgcttacaaatgaaccctaggtagcaataataacccctcaaaggtacaactctagaacaccagagtggggaagactgtatctgaatttgttttttgcaggaaactgacagtttgatccactgagggatttatcttctaataaaatgtaccatttctaatagacgttaataaagaaatatttcgcttttccttatgtctgtaaattgaggaattcctttaataagactaagaaatagatattgtttaaaatctttttaattgcaggaagatatgtacacagttactggagggatacccactgaaataattagtaaagtcattttaaatacagtgtagagtatctttgtaatagcatcatacagtaatttaggggagtagctgtagaatcatttgatatatcagtcttctttccctcttgtgaagtagattttccagtgttattacaatccacaggtctagaaataaaatgtataatagtctgtctgtatccatggagaatacgttccaaaaccatcagtggatgcctgaaatggcagatggtactgaaccctgtatatactatgtgttttcctatacattcattcatgtgataaagtttaatttataaatcaggcacagtaagagattaacaacaataacaaagaatgaaatagaacaattaagtaaaataagggttgtttaaacacaagcactgcagtactgagacagtaaatctaatagtcaagacagctgctaagtgactaacagactagtagcatctatagcatgggtacactggacaaagggattattcacgtcccagtgggatcacagctgaatggcacagatttcatcatgttactcagaatggtgtgcaatttaaaacttatgaattacttgtttctggaattttccatttgatatttttggacaattgaccacgggtaactgaaaccatggaaagcaaaaccaaaagataaggatggactactgtagaataaaataagtaacctgggtacacgaagtgttaaaattttgatggttttaattacttacaaatttgaataaatatcttgtttttaccactagaatgaaattaataaattttgctattttatcatttatctctaagattcttatatttctctcagttttgttactgaacctcaatgaacatactatataagcagatttgtagtttcacttttgctgtttcttgctaaaaaattaacaaaatatttatgtacattaaaaacttaagtaccctttttagcactaataaggtagaattttaaaatctaaaagtaagcgatttatataattgccaaaaaatatagtccttaaaattaaaaatgttttacctttaattaaagtgtgatctcatggagaacatactaatctttttcaaaatgttgactttctagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccaggcgagtaccagttaggagtctctagaaggctacagtattgcaggagtcagccagttcctccattttgacttttttaagttgctaagtctattatactatcattatactatcattaattccatatatattaatacttccagttgtattccagctatataggtcattgaggttaatttcattttaaagatagattccttctttccatcctttcataataagttagagaaggcacagatccatgggaatatctgcagcattcatcactgaaatatttcatcaagacaacaacctggaatagcctcttggaattaaacaaggctttgaaagatcaatttaccctttgcccttatcctgaccgacttcttcgataacagcttcaaaaaatggatttggttattacaaactagagaaagacccgtgttacatgttttcaatcatagtggtcaacaatatataacgctgttattaaccaggtcctttgaaaacaatttgtgacatttaggagaagacagtctttataagaaattctatctaataagcaaaaagtgtttggcaaatcatagacgtttcctccttctgattttatttggccctgtagacagcattttttattaagataatatgagtcatttaatacttgattgattttgaaaaactgaccttgtccttaaagccatttaaaatattcaggaaataaagatattttgaaactaaaagaattttcatttctgaaagagtgaaattgttgctaaattttaagcagctttagtgttattttaaggcgtgtatgcaagatttcattcactcttcgcccacaaatagttgcttcactggaaaattgttataattatcaattcatttttagcagcctaccaacttgttttaatgaatgtgaattaaaatgatgagtgaggttttggtcattaaaacaaaatgactaaagataccttaaagttgagtgggaaatccactgcttcactaaaaccgcttcacttattcacttctattcctgaaattctttaagctatataaatgcatttggttctgctactcctggtttgccacctttttgtcatttttaaggagtttcaaaaataacttgtctaataacacctacagcttgtcagagatactcttactgattttgttttttcaaatcctcaaaatgacaaagacctaaggcacccaaatagatgcagaaattcccaaaagagttttgaattgtaggtaatttagaccatcccttggctggacctgaagagaaaataatagctacctagaaaggcagtgaagtgtgatgagaactttgagtttaatatgtgtccctgaagacttcagttttgacctctaatgtgagttgattctctataaacaaggacttcatgtatgataatatacctcagctattcatagtgtgataatttcatagtctaatgcataaaactgatggctgtctttgattatgtgaaactttactgataatgcatttcgtaaggtgaataagtgattatttggtaggtgcatttattctagctaaaactggaattcaggtgactttgaagtttgaatatttaaaccaaaattaaaagctcatgacaactgttaatttttagttttgaaaatagcaatttgaagtaatagttttattcacttgtaagcctttattattaatgctacattacagttggcctgaaaaattctctttaagactgaggaagttattgatctttactgtataaaaggaaatctgtgagtttttttatagttgtctacttggaaaccatatttattaataacatcaatgatgcttctgaaaggagtaacgtaaaagacttcctgtgtattcacgtttccatctcaactcatttccctttggcctaaagaacttcctttagcctttcttgtcttgcatttctgcttgtaacaaattctctcagctttagtttatctgaaaatatttcacttgtttttttaaaggattttttttttgctagatatataattcaggatttacaggtgtgcatttttttctttctgtattttaaaagatgtcattcattgtcttcagatctccgttgtttctgttgataaggcagacatcatgtgcattcttctcattatgtaatgtgtcttttctttggctgcttttcagatttttctctagctttcagctgttttattctggtgagcctaagtataattttctttgcatttaacctgcttagggttcactgagattcttggaatgtaggttgatgtttttgtcaaaattgggaaattttcagccattaattctttaagtttttttttctgccccaaactctcttttctccttctaggacttgaattaaacacataggatcactttattattttgcagattactgaatctgtcttcattttttaaatcttttttccctgtattcttgtaatcagaaatttttattaatgccttcaaatttagtgttctttgtcctatagactacaatctattgtgaagcccttgcaaatttgtttttatttccaatccttgaatttggttccttttatatattccatgttcctatgagattctccatctcttcactccttatatacatctttttctttaagtctttgacacatttatcataaccatttaaaatatttcctctgataagttcaacatctggggtgagtctgggtctgtttctattggttgccttttttacatatttataagtcatatgtttctgtttcttctcatgtttagtcattttaaattatatactgacggttgtagatgatacattatagggaatctggattaagttgtctcctgttagggtgctgagttttgttgtggcagagaactaaattactggcagatcctttcaatcccatcaagattggttttgttcattgttaggtctagttcatatttcttttaagccttagaacatgatccttacccctaaaagttggcctttgtggagtcttgactaaattcccaaggtgttcagtgaggtctgcactctgactaggctgggagtccacatcacctggtacctgttcagccttgagccgtgcagcagccactttccaccagacctgtgcatgtgccctacagctcagggtgcaactaaggacttcggatagtccacacgcaaacccggagaatcacctctgcttagctcccttgtctccagtactctgccttgcacattctaaccactttggcacccacaaattccactcgctccctgcctcagctcactaaatccctcacatactacttggcctcagcttcctgtgtcttggtccagaaagtgccctcaggcagaaagccaagtaaacatgggactcgtggatgtttccctcctctcaaggattatattcttgtgttgcctgttttcgagggtctaaaaacagttttctcctacatttagctaaattcacttttataattgtttatggtgggagggcgaaatccagtacgagttactctatcatggctggaaacagaagtctgggcttaggttatactgaagcaaatcctggcaggcattgatgccatccagccagcctacaaattgatagcagtttttcgagggtaaatttctactgaattttcatcgaggttggagttgaagccaagcaagcctaattgcccagctctggcaggagcccaccctcggggctgtctggccctcatggcaccggggatgtcaggaaatcttgaccctcagtgtcccatttaaagaggacaaaaatgtgtatttgtaatgattgtgagtcatcaaagaaagagtaaatcacactccttgcactctgttaattacaacagagatttacataataggctttagacagattttctgagaaacgattgataacagtttcaatatataaaaggaaaactatttgttaccaggaattcatctatttagaatagctcattttttagggatgatgaatattaataaaacatctgtgtcagaagtaaaaatatataaaatattttagtattcatcatcatatttaatcatcacaaccaaccagtgaagattgaaatattagtttcattgatcttgttttacagttgaggaaactgaagctccaaataattaattggttttcaaaatcacacagaaatggaaggacccaagactgaaacccaggcaatctaactccatattctatgctttttctgctgttatcctgcctcccttggcatttgctgtattcttaatggctgttagtgacatcaccctccagcctgttcaccaagccagaaactccatctcacacctgacttcagtttttagatcatctggctgctgtataaagaatggattgggggtgcaggtggggtgaggggataatattagaagcagagagaacatgtaggaaactgttagactcttctgggcaaaatggagaaaatgaatggatttggtatatgttaaatattttgtagatagtcaacagaacttgctgatggattccatgagggaagatgaagaaaagagaggaatcaaagagaagtctatttcgtttcaagcagatgtatagattcctgtgcagatagtgggtaatctgcatgacacccatctttttgtattctagggcattctttccttggccactagagttatcgtctgtataaatgtgactatgtcacatcctcttactctcctgcttcacagccttcattccttatgtgtaggcacacatatagaccacctgggtttcactaacctctatcactaattactaatcctgagttccttatctgtatctaatgttattttaatagtgcttacctcatgaggcaacagtaaaggtaaatgagataatgaaggtaaagttcttggcacaaagcctgatataagtaaactcaataaaggataactcctgttattggtattaagactaaactttttagtttggcagagaagaccctgtaaatagaatcgtatcttaccaatatttgtatctccagcaccatagcacagtaagaattcactaactgaatgcatgaggtgtgtgtgtgtgtgtgtgtgtgtgtgcgtgcgtgtgtgtttgcgtgtgtgcacacaggtgtgggatgacatgcccctttgcaggggtctaacaagttaatacatggagacttcccagatcaagagagactctaaggcttcaaaaaccaggcaggagaattatcactcggtcattaattttaaagataattttaaaggtttactcagtatgaattcttttttttaataaacaactaactttatcctgtaatcagagtctgcatatttgttgttctgtgagccattttctaacaatctgcttttcacataatataagcacaaactcacatttaacaagaattccaaacagtacaccaatcagatgacattagaaaatcctgaaaatggatgttagctgaaaaaaaggaaagtataaaagtatatatacatagcatgattatatattcattgttcaaaaaaatggtatagcatagtgttggagggcacagactctgaaggcagggtaccgcttcgcagtttacagccacgtggccaggcgcatggcctttctgcctcaacttccatttctctaaggttgccgtaagaataaattaataaatatatataaaatgcctggaatagtgcctgacacaggataggggtttatgaaatattaactactatttaataataacccagttttatggaaaaaattccaaactcacacatgtgtgcacatttgcacacatatatagaaaaacaggaaatgtcagcagtaatcctgaatataggatgactggtcaaatacttgtttatagttttctgtgtttctgtgttatactcaagagcaaccataaacattgtttcttaaaaatcctcaggcccacaatgtttgtgatttctaggctgacgccagccctgtctgttcccaccagcccttcctctcccttcaggcatgacatctcacttcgctacagtgcacgtgtttacctgagccttgcacctgcagatttcttacataggtagaaagacataaaattagaatcaggaggaggaacacgagagtggaagttacttatattaagaattttctttgttcccctgaatctctttctgtgcatctgtgcgtcatgatttccttaagatcataagcatctgggcctctgcatatgttcatcagggggaaaaattatttaggtatgtattttttaggatttttgtaacttcccatttttgtctcagctgagctttttttccttataccaagtgtttttttcagtgtatttttacaacatgggccttcctttctgaagccatgtttttctcatgtagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtacaggacatggtgcctgggatgactggggaaaataatgcctttgcatttaacagccacgtgcttctgtatttaagaaattacccagtgtaattcaagagtctttttaaagggatattttgataccagatactctttcacttaactatgcatttcagtatctctcaggaaaaactaggatacatatatttcttggagtgctttcagcattttcaaatcgtatgtctacttcattagcttatttataaaaccatgaagcaaaaatcaatttaacttgcatttaaaaaatattttaggccaggcacagtggctcatgcctataatctcagcactttgggagacagaggctggcagatcacctgaggtccggaattcaagaccagcctggccaacatggtgaaatcccttctctactaaaaacacaaaaattagctggacatggtggtgcatggcctgtaatccccgctactcagaaggctgaggcgggagaatcacttgaacctgggagaaggaggttgcagtgagccgagatcaagccactgcactacagcctaggagcgagactctgtctcaaaaaaaaaaaaaaattattaggttaaaaattatagtattcattgaactagtgagccaatgtgttttatgggattctagtcagattggtgccaactataaataagttatagaggattataaccatcactaatgctgaacatacatgaatattttatttcagggtttttttggtatttatagaaacatagcaagttactggttattggctataattctatataacatatagattctttctttaacgtttcaagccttcttctgacccactgtgttatataaaactgaagtgtttttcatcattttaatgtgcataacagtataccagttccagacctaaaagtgaatgtagtacataaagcccagaaatactcaaataatgtactaatgaattgacaaatggaagaaaatttaaggagagtagcctagagaactcattctagaaactaaataacttaagtcaaaaattatttcctatattgcctcaagccctgcagatagctttgctatgtttgtgtatttgcacattgcactgctggagtgaaagcacaattcttgatgtgtgttctgaggcttggaggaggactgtgctgcctgccgatggacattaaaccacttaaatctcctatctttttttgaagccatgaacccaggaaaagtatcatctacaagagtgtccttagaattctgtttttttggtggggggtggggggcacagagtctcactctgttgcccaggctggagtgcagtggtgcaatcttggctcactgcaacctccacctcccaggttccagcgattcttgtgcctcagccttccaagtagttgggattacaggcgtgtgcctcaacacccagctaagttttctctatttttagtagagacggggtttcatcatgttggccaggctggtcttgaactcctgacctcaagtgatccgcccatcttggcctcccaatgtgctgagattacaggcatgagccaccgcacctggcctctccttagaatgtgtaaaagttgtcttatttggaataaaaagtaacctttgaaatggtctagagatatccacatcctgtgatctctccataacggacttctgtttgatcactgattaattgcatgttacttaggcctggtacctaatatttttcattctaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggtaggtatagaatgtgatctcgtcctagaggaaatgttgaaaacagtctggactgtgcccttgtatagtggcactatggaagagttggaggttccaggtaatagataatgagatatatatagtgctcacaactgtgaaggctgagaattatttagtctaatgagtcagaaaccgtttagaatgcagtcatctctattagtataagttattgtacttattaatttgtaaatatcagctaacagatgtctttttcatggaggactaaatatgacattttttacatgtatttcatagtaaatctagttgtattaaatagactatcctatattatgaaaataaaatatacttaatggattggcagtcttttacgttagctcagctggtgtctgagtgcctgtttgtattcccacgtactttactaggccccagggatagaaagatgaataaaactcagtgcctgcgcttaagtcaccctcagattggtgaggaacacaggtggttttgtgagcgtcagggaaatgtggcaagtctcactcaacagaggttgcattgggcacagaggatgggtaacgaagttccctgggtgacatgaaactgaagttggcctaagggatgaggaagcattggctggataggcagaggtctttctagttacaagctccgaaacagcatgggatatagttctggagctaccagcaagagggggctgctgtgttaaaacctcgtgagggccaagtgtggtagctcacacctgtaatcgcaacactttgggagaccgaggcaagagggtcacttgaggccaggagtccaagaccaacctgggcaacacagggagaccacatctctacaaaaaataaaaataagtagctggatgtggtggcacatgcctgtggttccaggtacttgggagtctgaagtagggggatcacttaagcccaggaggttgaggctgcagtgagccatgatcacaccactgcactccagcctggatgacaagtgaggccctgtttcaaaaaaaaaaaaagaaaaaaaagaaaacaaggccagagagagatagagtcttcatttagggaactgtttttttagacggagtcttgctctgtcacccaggctgggatgcaatggcatgatctgagctcactgcaacctctgcctcccgggttcaagcgattctctcgcctcagcctcctgagtaactgggattacacacacgcgccaccaaacccagctaatttttgtatttttagtagagatggagtctcaccatgttggccagactggtctccaacttctgacctcaggtgatccgcccgcctcagcctctcaaagtgctgagattacaggtgtaagccactgcaccccgcccatttagggaacttttataaggaacttaattgtgtcccacatgcagtagggacactggggtatggcatggccagttcaggcctttaaatgccttcttccagcaggcagcagggtagaggattgatttgaagtgggagagcgtgggaggcctatgaacagaccaacagtctactgataacagcttgaactattttaatgatgaaaaggaagagtggggtggagcagtcagagaaatattttgtggtctgggcatgatggtcggaagtgcggagtgagagagagggagaagtgagtaatgcctggatgttgcagtgctagtggctggattcaaggatacttgagattgagctggaagaatggttctgcaggaggacacattgatgacagcattgcttgtaataataattcagggaaaatactaagagttcattgacaaaagaatggttacatcaatggcagtactctcacacagtgaaaccacatacagcagttaaaataagcacagtagactacacataacatagatacatgcagctttagaaatacttgcagaatgataactacagagtaatactatttgaataaagtttttaaatatgtagattgatgtggatatatgcacatgcaataaagttaaaatttctaattggaataataaaaatagattcaggataggggttacctctgtgaagaggaaggaggaaaatgggactgggggttgtattccacctctgtttctttagagaactctgaaatacataagacaaaatgttaatatttgacaaagctggcatacctgggtgtttgttttatattttctttgccttttttcatgcttgagatatttaatttaaaattttaaaacaacatttcttcaaaattaatttcattccccccaggtttccactgtgaaatcagagttgtagtttctgtaacacttgggaatgaataaactatcctgcatccaatatttaaggggaatcaactttctcataagatattaatgttcaaaatacaacattaatattcccttgtactctaaataaaataccaaaagtagaatatacgttacaaataatcataaatctggaatggaccatctgccttaatgtattttgactattaatgctttcgcgcttctaaattagtactcccactttctaaaatgcttttgaggcatctcaccaaaaaacaaattataattatttttgtttacgtgtacatgtagatataaaatgaaaattagagcaagctaaacagaattaagaaaaaataaaaatgtagctatgttcatcctagaagtcaacacagtcactgtgattacgcccacaaatttaccctgagcctactgttagggaggcatagaggagacagaatcatttgcattacatgagtgctttcctgctttgtctgatgtttctcttcccatcactttgaacttcctgtgtcatgtccagttgtcttcccatagtaacaccgtgcagccaggagggctgcagtcgatcgtgtgcgctactccctgagagagcagtggcgatccagggacaaatgacatggaaaacacagcttctcctcaaatttaactagccagattcatcatgactcgatccttacatccttaatgtgaagctttttcctgctcttctgtcctctcataggaggaatgagtcttttctgaatttctgtttgagttttttccttgggagagactattacagtgcctttcctgagctgagctcaaggaatttgtaagatttagtgttaaacaggaagaaaagtacatgattgtgtgctctttttttgtttacatttaaaaataagtcaaaattactttaagtagagcccgactttactaccaagggcttttatgtactaggttacctggagcacactctggaattgagtgctaatttagatgatttcctccttattttatagagaacataagatgttttaacacatggaccttggccttgaaaagaggatataagtgttttctaattcaaaaagagctgttttcctaatagatcatatcaatcacttctaatgtaaaactaagaagtacctctgatatttgtcttgaaaatatctgccggtagcttttaggctataagaaacaattttttgccatacttatagagtaggagacattaagaattgctttataactatatactgttaccactaatcctttattttgacatgtggactgattatcaaatgttttcttcaaaacattgaaatgagagtggtcagtgggtaaacacttcatgcaattgccataagtaaagtaggttggaccagaagacttcagaaatgagttcccagttcaaaaagccaaatggcagctgtgtttgatttatacctaaacattgtctaactaacatgaaacaagtcacaatataaatctagcatagttgctttttttgtgtgtgtacatatatttatagtctaagctttatagagacagcaaaattgctcacatttcccagtcctacaatttagtggtaccaatcttaactgatgttcagtaatattttaagggtgattgatccttgatacatattaaagcatgaaaacatcaaaaaatgcttgaactcttctttcttctttcattaactcttcctcacatcaaatgctcaagccgtctttaattgtagcacagggttgggggagacctcagaactcattttgttcagtcatccatccagtgcatgaatctcctgtacagtttccatacaaagtagccgccatcacatgcatgaacccacagcacaggaagctcattacctggtggggttaagtctggacaacaaggttatccagaaagcagcaagaagttatctgatataacttgaaaaggcaaaaaatacagaccctcaggaggtcatttttgcataggaatggccctacaaaaagaccagttccaccctagatccagccaccagcactcctaaccaaggaagtaagcccccagtctgaactgtcgttaaagcacgtctgctctgaactcaggctgaaggtgctgtgtgaccgtgtcacccagcattccccatcaggtgcccatctcctataaagtcccctttgaaaacagaacattagccttagattttagtgttctgctagtatcattcacaaataccatggctagccttgcacggtgcttggcctttgtaggtacactccacacattcctaagtgaaaattatagtcaacttaggatcatgagatgttaaaatacagtgaaccattgtgttccaaatattatataatttgaagaaactactatgcccttgaaactaggaattctttgattcttaatattaagtaattcaacccagttattaatccagtctttttttctagttccctttgtttcagtttggcagtttttactgtacttaagtggagaaattttagctgttttttataaagatgccttgcctttgctttaaacacaataactgcccagggcctatatttttggccacatctttattttcagagggaaaaaaggacttttcttcaaatgtattttcccaagacaatatggctgtcattgttaattaaaatggttctctagtatgtaacatgattcttgtgttttcctcattgtgttgaacattttccagttgaaacctaatgagcttttcttttagtaagtgctgatatatgtgagtgcttagggtaatttttcttttattccaaaagtattttttgctgttgttgtacttaaacttgaaagctggatgaagtatggttgttccccagtttggttataaaatgaatgtctgctaggccacaaagtatggaggacagatgggaacatcttgtcactaaaaaagatatgttgaactcatttgttcaaaataattaaatagtgtttctaagctaggaaacatgagtttcaagttattgagcctcctgaaaacatcattttttaaaactatagacattgaagatattgcgcaaatctggaggcctgctttttaatgtacgtaccagatgtccccaactgtcacacttctattaccctcttaaataccaaaaagtagcctttgttcttcggtaataatagactttgttcatatgactgctacatgtacatttcttccaatttagtaagtgattattcatccatatagctaagtaaaatatttccactgtttattgtgaaatgtttggatgccagcaatggattccagacactgcagaacatgaaatgaagtgtattgttttcctgatcattagctccatatttttaattcgatgataaattaataagaaaataatagttgtaactaaggaagggtagatgggccaggctaaggtttaacaaagggcagaacagtctggcaagaattagtcttatatactataaaaagcaggagcttagtggacatgccttttggacgattacttgccgttacaggatgaaaacagtttacgaagcatgtccccttagcctaattaatatgccttcaaaacaggtcatttatgctctggtccagagaggagtcagtcctactgttatgggccactagggctgttagaagctatgtgggtcatttttagaaatctagcaacatctcctcccaattcccagcccaaatcagtaaggatccatgtcacttggtccactttataaaacatagctgggtgcagtggctcacacctgtaatccccacactttgggaggccaaggaaggcaaatcactcgaggtcaggagttcaagaccagccaggccaacatggtgaaaccccatctctactaaaaatacaaaaattagccaggtgtggtggcacatgcctgtaatccagctactagagagtctgaggcaggaaaatcgcttgagcctgaaaggcggatgttgcagcgagtcgacatcgcgccactgcactccagcctgggcgacagagactctgtctcaaaaaaataaatgaaacaatcacaacagaaacattcccttattcactgaacatttcaaaccctgaaaatgtgtaatgagaaatgacaaatttttaaaagtttaattactaagaagacaaaaaatgtctattatgaatagaccaattctcaattggtagagaactttgaactggaaagaaccctaaagaaatctcctgtctacccctgttattacagattagaaaccgaagtccaggaaggttgagcaggcaagtctccaggctgagttcctgatgtccaggctggaggtgtttcttccctgacccttcccctgcctaccctggccactgagaagggctgaacaggagctaaatctggagggtacaaatgttatttcccttgttctttaagattaccaccaaaaagggaaaagaaaaaaagccccacaataaactactctctgaattttacccaggaccatagagaaatatccctgaatttcaccactagcactataatatcaaactagtgatcaagtataatcataaagcttcagtttgcttaggaaatctatgaaacgtgattttaggtcttgcgtctatttcaagatttatagttttgagtatgaaaagattcaaccctctaagtggaatatgaccctgtattttgagtgtaggcttccgagtgccaagcacaaggaggcagtcaagtagggagtctcagaaggtcacttataagacttgggtattcaaacatcagtcagagtggaacttctcagcaaaagagaggccctgtaataacatgctccctcagttgactagacgtcctacaaatgcaagaaaggtgggaatatggagaccccaggccaggtcctgcaaatgctttgcagtttctgagtatgatgctctatagcttacagctggaggcacctttgtctctaagcttctgccagcaccagacaactgggttgaagatctagtgcagttacagatgagcaagtgtgttcctggaacatgtaggtcagctgtggagtatatgacttcagtgacagtttcttgggcaaatctctatgatagtgtaactgtgacagtataaatgacctaattctgtgtcacactgaaataacctgcagaacaagggtggccagggccgctgcccccactgccgtttctgccccagaaggattctctaatttcctttcatgtgacctgttcccttttattagctctgcttcaacagaaggagccactctgtgtgtcccatatgggcaattctcagtcagcatttctgaattgtaagcttatttattttctgtagaaatgcctttccagggaacatagaactgtataactacattatgtcattaatcctcaaaacatatccaagaagtggtaaaattacctagaataaagaagaatacattaaaatgcaaatatgattctgtaaatggatctctaaaagttggtagatcttttcaaaggtgctgtgatccacctttatgcctgcaaaatcgcagagactcgggctaacccttatattctctaaaggcactaaagatctatcttgtcccaactggggacaaatttcagcagcaggaatggtcaccttcaactggaatatgcaggctggggcccctgtgtgcagcctctgtgaccagcccagttccttacttccacacagctccctcctaggaagcatcttgccctcagaccacctgagcacccacttcccactgcgctgaaagctgagatggtggtgttccgagcacagctggacctgagtgagctcccccgtgccccatgaggattatgcatctgctgtgcaggaaatcccagagaacacaggggtgagcaaggcaggcctgtccaccacctgcagtgctctgtgccaggcagcagggagtgcagcaactggcctctcatgctttggggcaggaaggagaaagcctcaagccacacctatagaccaggagcctcactgcatggaggggtcactgcacaggtttcaggaactctgctcagatagtggcatcttagaaactctgggaatggctatataccaccacaacttgttttcctcagcatttatccagagaaaggtatttttctataactgaggatagtagttttatccctgtctcgtaattgttttcccactatttcagtttcacttagatttcgtaatttgttgacagccttcagccctgttagaaagcttgggcaattgattagcccagcagacagttttatggcactgattctccccaccacccccttgacttcctcatttctgttaacagtgccatattttcacacgtattcaaactcctggcttacctgtgacaccaccctcagtttgcatctggctccaaattctcactacaggcacttcccttcccttttggcctcctccctcctccatcctgtcctgtgaaataggctctgcccctcctagcccattggcctcacccacctccctgggataacacctgtgcctgcagttcaggttttcccacctgcctgtccaaatcagtagcttctgtgacctcctgccagccagctccagcatgtgccgtcacctcttctgcttctttcccaggctatatatagttggcctgaagagctctgcactccaaacctgcttctttctggcctctgtccttgacactgcaactcaaatgtggtctcccatcctcctgtcaaacacaagttcacacactttgaaaaacatccaaggagaagcggcatggtctcgagtgagtgtgagctttggagccaggttgacttgtttccttccagctctgtggctccagacacatcaccactgtcaaaccccagtgtccccggcaatgacacattacctgctgcttggtgtttttgtgatgatgtgtgttgagctcctggcacacaggatattcaagccatacctgttgctcttcctgccctttgtcacaactgcctggtggtgtaactgtttgtggtaaggcccccctgagaacagatggctcccctgtgtgtctccctcggagtctggcatgaagcaagcaagcatctctgccagcgctgttcaataggagaataatatgagctgcatattttctacattttctagcagccatgggaaatctattttagtaatgtattttatttggcctaatagtttcaaagtatttcaacttctaagaaatataaaaattattaatattttgtgttcacttcttcgtaccaagtcttcataatctgttttttactcaacagtgcatctcagtttggactagccatatttcaagtagccacatgtggctgatggccaccgtatggggcagcacaggtctatactgcatttgggtagaggtaacgtaaatgtcaaaggtatgaggtgtgtaactttaaggctggcgggaggccatattgtagcaggatgtaggtgccatagcatcttggcattactctcgtcccaagaaaaagccgcagaagtttataaaaacccattgggctaaggggagaacttcaagggcagctgcatagagaaagaaatgaagatgtgtgtttgctagatcctgagtgtttcagccagagactgtatagggaatgataatggaggcatgtgctaggagaagcaggcaagggccgtgatacaatctgcagccctgatattattatgtttgtgctattaatctaatatttctacccccatttttcaagaatgtttgcagggtggttccagtgagcccatagatgcagaatagccaggagctggggcaggaggtggggaggattacataaggagcagtgttccccagagcttcaacgggaatgcacagtcctgttagccactggtcatgacacttgctttgtactgggaatggagtgggggttgagtgtgcacaagaccttagcatccattatctccttgatggttcctcacaccctgagcctgggtagttttacctgcctccatcatgaacgtcttgtgaaagagcacgactaaaaccagagcactcagagcgaggttcactcaagaaggaaaatgcaggggcctgtccagtgatgatgtttgaagcacactggcacctttatggctgttgcttttttgcttttggcaatgtctacaaacacttgggctctttttaatataattaggaaacatggcataaattgaatgctgtctaaaaatgagtggtttaagattgtctttcatatcaaaaagaaaaacagttgtataggctgccatgcatatctgccaccagagaaatcgcattttccaaatgttttgttgttttttaatatcctttaagaagtacatttttcaaatagttgctattattttaattaatcagtaaaatcagcttctaatttgactataaaattatcagtttgccattagaatagctataaagttagttttaaatgtgagctctttcaaaattgtgcagcataggatttatgtgaaatggtattttaattactttattcattctttgtgaggaaaatgaactttcatctctcatggcagtatttcattgtgattattggttactcataattatatgtacttgttcctgtgacagggaataagcagcgttttctacaataatatgcatgagactccctaatattttctaaattagtttgtatgtttatattcttagtcctcacaacaaatagctaattgctttaaattaaataaaacctcaagcttcctcaaccaaattctagtttatttttaactttccctttgagaaccaggagataatggagtatggtgataaatatttttgaagcaaattttgcattaggatgttggagttagaggttatcatgttgatggagaaggctaatcctacagctcttcattttctcatcagtcttactacatctgggagttggtgtattctctattcattacttactgccctagcaagattcttcctgacccattaaatgaagccctagacaaagtggagagaacattgttttagtgaggtcgagcacacacaggtgttattagccggtcttaagagaggtgctttttactttgagcaaaaaagccaaattaatcatttcatatctaaggcttttaagtttaattaaatctttttcatccattatttattgactagagctggttgttttggctttatataaccttagttttggaatagaaagtgaggaagaaaaaccagtcaaaatggtgagttaaatccataccgaaggttgcaactctttgtgttacatggtgaagtgcaggattagaggataatataacacacaatgcagggtgataaagctgccttttggtgggtcccttgaacaccacatacttagcaaaaatagaacctttccttttttctgatcaagaataactgtaaacatttttttttggaagttgcagaaatgaaagcctgaatttctatagtaggctagtgttatgatcaataagtcattttagttgactaaaagatagcatagtcaacttgtctactgaagggtaacatattttttaacaactttatattttataatttggcagcactgttcctttctattttgcactttgagggatggggattctggcatgttggtgtgacttttccgattctgggagatagaatggcaactggattctcctatccccgtaactaagatggtggtttcagcaaccatctgttttggtctcagtgtgaaaggcaggcaaaactatgctgacaaattttgttagagatcctctcccccagttgcaaacttaaaggacactcctgaatactcagttttacaaaaaggcacaaaggggaggtaataataataatacttataagccaagtctgataggtaggaaataaaagagaaatctaaaaacaaatacaggatataaaaatagatccatcacaaatatttttgaccacctactatgtgtcctgcatatgtgtcacacaacatatatataaaaggatggataatgatagggtatttcttcctcattatataatacttgcctaatgaaattaaaatttaatttcagcatataaatgttcatcttttttttaaaaaaaatcaacatgtagaatttcaaacctataaaaatatttaaaagggaaagttaattaattttgtacaacttggctttttaaggtattatatgtaaagcacacaatgcctggcacagagtaaagccacagtaaatggtgatgctaccattgtttacattgatttatgaatgtttatgctatgtccaatcccaagtatatatactggctaatactaagctgtagaatgacatacaactccatcagtcattctgaatgcctgggaagaaaaagacagagcaggacaaaattctaccaccagcatgaaaatcagggaaattctcaaatcagagaaatattctcttgccagaagtaggtgttagaagtagctgggagtagagacagaaacaacaaaaaaaaacaggtttttctgactgcaatcagagaatttctaggcatcaactccaggatccaatatgctgaaaaactactcttcttcttagtcatgttttcacctgaagtttgtgacacaggttgtttaattttctgtatatatatccaatattatagtatgatagactttactttccataaaccttgccttgcagctaactttactggaatgcatttattctgtgaagttgaaaatatcctattgaaaaatgcagctctctgccatgcattgaggaattcgaaagctgtgacagaaaatttgtgccaatggcattaggaatcacatgttatgaaactgtcagcaggggagcttagggagtcacccttttcccactgatgacttctgggctgcatgctgccactgtggctggcttatgctcctggaggccccatcagggcccagcgtgactatggttggcctccctagcaggaaatgttaaagcccatgttagtgacagagtctgttgtcctctcctgctatgccttgacccaactctgtcttctgttttcactcccttgccctgttatttggtcaggacagactgccaaaaaaagtgtttctcatccttagctcctggatcctttctgtggtcgtcaggcttatcaaatgtcttttagatttgaaacagaaacccaattaagcccaaaattgagcatagataatatgaagctgctctgagtcaattggggtggggatctggagccttacgaccaattcttcctcaattcctcacatggctgcccctatgggaggccagcaaaacccccaggatccagggagcacagtttaaaaccattgcccaaaagcactttatatagaagcatggccaattttctaagaatccgtggagaaatagctccaactgtagaatttaagttcttttcataagcacccataatgcgtgctgccttctaaccgggaccctagcttttgtgtaccccaagataattatataagcaaaggtctatcatgaacagaagaaaagaagaacagagcaagcttttggaagtaaagcaaggtctttacttgcctgactcagaactgtcttaagtctcccgcccgtcctgtgtcctgaaggctgtagttatggtggaataggagtagaaaaggggtaaaagtccttggggaacaagggaaaccaaatcagcaaggtccagaagtcaaagccaagtgaaagaggagagttgtgggcacaggtgcagagcagaacacaagaggaggccagagcacaagcatcaggttccagtccgaccattccctccacagcacgtggacaggcctgggaaggggcagtcctcacgcagtttagagtcagaagattgtttcactctcttcacttctagcccttggcttctacatccccttcctccacaaaggaaggagctcctgtcttcctccccataccaccctcttttacagggggcacccagagaaggctgagcaggtggtgtccaggctggcttcttgggccgtgacagctgcagcagcagtgctcagtcttgtctccgggccacgctcttgatcagtcatgttcacaagcctgacacgctcccatggacatgggcagattttgccacccctccctctgcaaggccacaaacgtttttgtgtgttggtagttgtgaaagcactgtacagactcgagcaacttgccaagggtatgtcaggagtgtaggactctgggggggacttgaatgcagagaaaaaccagctgcaccatctcttctccacctactttcctcttactcaggaagatgcactgatgtgaaaatgacattagggtaggtatcatctcaaatttgctccaatgtctatgagagcaattattggaaaacctgtgctatgataataattttagctacctcatacttggtgcaaaaattaaggccctctaatatcattaaacagaactctaataagctccatttaagatctgttatcctgaaatcttgatatgaattacaatacaggcgattcttaatttattgttagtttcacctatttccaaaaaggaatgacagtaacgtgtatttctaaagcacatgataataaaactcttaaaattgagatagaagtgtttaaaccttatctaagtaaggtggatgaagcaaatataacaaacatccgtgccaggaaagttacggcaagtgctttattgaagcttgagctttctgatagcaaaagtaagaaaaggaagcagatgaagaaaaacatgccagtctttcaagaaaaagaaatatttttccaagtactaaattctaaaaatggtttgtcacacagacattaaatgtaaaatacaatgcaatgaatagcagttttgtaaaaatcacagatgcattatattcaagacccctgcttggattgtgcccctctccctttgcagagtaactaatttgctttgcaaaatccacagtcaccttgcctaatagatacagagggtgtataatattcaccctctaaaatccaagagggtgaatattaagaatttgtaatatgttgtcggaggctcataccttcactcaaaactcattagaggtctattcccaccctggttgcaaatataggccatagattaggtttggaacagactgacttcatattaattagagctaatacgtttattttatttctaaagccacaggatctctatttgtttgattttttaaatctccttttttaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggtaaattctttatttcttctttccagttaattctgtgattaaatatgtgtcataggtaaattgattttaggaggacttactttattaacatctatctaagtttccagtttttatttcaaaatttaggccactggactttgttattctgggagaaaaacatcgtgagcacagacttgtggccttaaagaagttatcttgtaaatgactcttctgtgacttactcagaaaggccctttcagtctaagattactgccaaaattccagtgttttccactttaacagcatttttctggtaatcgcattctgattgctaatgtgtttgcagcctgctgtttgtttaaattcaaaatgtgatggttaaaaccattttgcttttaaagaggtgtgtgatttaaacaatcagtttcaagttgtataaataagtgaaaatgagcccaaatacttttttagtcattatcttttacagttaaaatctatatataaagcctctttcgagtgtgcacagtagagttcattatttgcccttaacactcatcagctccattttgaccctatttcccagccttacagtaccctgggaactggaagcaagccttagggcagagtggcacagggacagagagagtgggctctggtctcagaccacctggcttccaggacccgtttgagcctccgtttcctcatctgtagaatagggatgataataccacctcagagctgtgaggggtcagcaggtacttgtggaaggtgcttagcacagtgtcatcgcatgagcactcagtgagtgctgtttaacatctagcatcaccaagacaggcagcctgaaagagagcaaagcttgtgtggctggtctgcagccttctagcattgcgacaggtggctatcggccctggtcagggggcagtgttggtggggaggtaacaagagtcaggatcccagaatgcaggccagctcctcctaattcagatgcccacatctcagggtgggtctcatggcctagcaatcatccagggagctaggattactcctcagccagccagctaggcttcagggagagcctggggcaggactcactgtagctcccccagtgggtcagggatagaaacatttggtgaatgccctctgtgtgaaaccagtgacgaataaaacagactagatccctgctctgatggaaccacattctaccaggaagacagacaaacaaggaaacaagaaaataacagtaggtgccataaaaacaaatagggtgatgtgagggttattgaatggttactttggtggtcagggggtctctcaaggagtttaaatttaagcctacatctgaaataccacaaggagtgactcactagagggtggtgttggggaagacaggagtcataggccagtcaaggaaatggttaaggtaaaggttctggagcagaaatgagcttgcagccgtagcctactgagcaaagggcagagtggtaccagattatataggattttgtaagtcagatggggtttgcattttattccaagtgccatgggaaaccatcagagtgttctaagcagtggagtagtgggcctcatttctggctgcagtgtggaggagtgagtacaggcagaagtagagacaggaacatcagactgttgcagagatccaggcaaacagtgagagtggcctaaaccaggtgctggggtgaggtaggcagatttgggttattttgtggaggaagagctgacaaggcttgctaatagatcgaatattaagagcgaggaaaggggggaaataaggatacacctagatctttggctggatcagctgcaagcacagaagtgctgttgatggggggaagggacaggaatgcttggaagggtgagcagctcagagttttgacaatgtccagtttgagaagtctaattagctgtctatgtgccagtgtcaagaaagcattggagaaaagaatccgcaattctagagagcagtcagggctaaaggcagatgtgtgccaacctatggccctgtgtccataggttgtattaaagacaaggagcagaaggcaccttggagagtgcaaagatgaagacaagacaggacctggggcactcctggaggtgcccatgggcagatgagtctgagaagtagcaaggtgagagagaagccaggtggggtcccagaagctgtggagaaaaggaaagtgctgcggagaggcagggcagatgagagccgccattccaccgccccctcatctagtcacagttttgcaaattctcaatttgcataattttacagttagcctagaaccattgttaatgggacataaaatagatccttatttggtatcaatttatgaaggcaaattgatataaaaaaatttagacacaaaaccgttttctgggtgttttataattgaaaagatcagaaaagttttagcataagcaaatatctatatttaacttgaaatgtttataatacaagaaattatatgtttcctctgttcatccaaaaaacatttaatgaccacctacttactgcacgcaaaatattataataggcccaggggactgcaagaagcttctggcctaacaagggaggtgaagcatgtctagtagtagccaccaccatgactgacagcaggccaccttctgggaaggaggcacttttctaattgctttctatgtagcaactcgtttcttcttcacagcaaccctgtgaggtagttactgttattttcccccttttacatatgaagaacctcaggagaataggcccctaaagaattatatgagggaattagaaagtgacacgtcatgagagagatacagtccaaatgtgcaggttcccttccatgtgtggataatggggagcgggccatcattgtgagcttcaggatgttaccatgcaagcccccagtgcctcctccgacctctaagtggctgccacctgttgttcgctctctcagatccttaaggttaagtccacgtggctgatgagtgcatggttcatctcagcagctcctcctgtctccacccctttaggaacctcagctccgcgggggaagaagctcggaagcaaatgcggtcctgcgaggggctggtagactcactgttgtatgtgatccacacgtgtgtgaacacatccgattacgacagcaaggtcagtgccggcctggttgcaggagggcgtggtggcaggtgaccatgatgcctggtgccactatttgcatgccattggttctttctgacctgcggatcctgtcctcctcaggaggccactctccagatcaaagggcaagtctccaaagttacaggggcaaggacgtggcaacttaagaaaatatcctgagaaccgtgagaacagagtggcttggtgtggtaaaggctttctctctggttcccctaggctcattctcagggtggtgcccatgctgctatttcctccaattctgtatccgcactagaatcagagccatcagtatttgagtatctactgactaaaagttcctggttgaggcactgtaatccccccaaactctctgccctcctggctgcagtgcagtccacagtccccacccccagcactaactgttgttgcacctctctacaccccctcctgctgctgctgcctgtggttggtctgtccccagcatgagccccttaccctctccctcctgtgcccgagtacagggcattctgctcatcatttgtcagctgtgacgaccatccaggatcctcctgggggccgaggaaagtggaaagaacaggaaagagggactgaaagtgtcaggacttccaaagcgggccagttacttggtgtcaggatggactggactaggagaggccattggaaggtgttggattgtaagggtgagcctgagagaaaaaaggatgaagagtgcctgggagaagagagaggaatgcaagggaacagccagtttttgagccttattgaaccaggagatctgcagatgaaattgagaggagtaagcaagttggaaagggaagcttgctagatagacaaatgctgaacttggttttagacactcaaacactcagttaaatgacagttggcctcccaatcagaggtgtgatgcagtcttttagggaacaaaagaccatgtacagaaggcaaatgtcagcagggaaagacaccgctgaacatggctcaaaaggagggtggagttgggagattgagaaggaggcagacatgggacttggggatatagttgtccccagggagggagttggggcatctgttgtcacgccaaggatctgcagtagtgagaagtgaggctcaagcatcatgggtgcagtctgcacggcagcagccctgaagagaaacactgggccggagcctcaagcatttcggtcggcatgaagtcaaatcctcagcaggactgagaagggctctgcatcctgtcatctgggtattccacaaacactctagaatcataattctctcttcagattgtttcaagttctcataaataaaaagtagttctttcatatttcccatttatttcctgtctgtagtgttcagtacagaagtgttttgctctaatgtgccgagttgtttttaattatacgccatgctgggtttcagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaagttagcattttattttatatgagactctcaagtttaatttttctgggagtgaggaatcacatatttggcaagaaaataaattttctgcatagctatagctgagtcccgcaaaggtgaatgttttcaagtattggagatcatgttcattctgcctccatttaacgtgtgctgtttgtctttcagtgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaaggtaggatgacttccacttatctacacttctttccatctttgcaaactaacttgaaatgttatatatatatgttctgcctcagtcagatcagccctgatggtgaaagggtcacagctacttagcttgtgtgtgaaggggttaaagggaaaaaagggagacaagcagttgctctggggatacaaagataaatacaagtccctcactatgagaaacagaaggctagtgagaaaaacagatggtgccagcacagtgtagaagccacaggatgtatgtgctgtggggtcctgaaagaagacatctaacccagccacacagtgtaagggaaggtcaggaaaagagcggagtaaggacgtggaggagatttcctgaaggggatgctgcccggcagaatctctgaagatgagtgaaagtaagcctgtagaggctgaggctgtggtatggaaggagccatccagataacagggacaacaggaggaggacagtcttgtggtgcagagaagacgtgtgggccaggactactggctgcccactggggcccaccatggagccaggcatcatggataggcctgaaggccaaacttcaggagctgaatcctaacctacacacaggagggactaccgaaagagtctgggcagatgagtgacagagacgggctaatatcatcactgctcccccacttccatggcagtgcaaaaggtggattcgaggaagggagagttagaagcagggattggatttgggagccagtgcagcaatacaaaggtgagaaatcttgagtggcaggacagaacacaggttgggcagcactgtggggagggatagaggacctctgttcctctcagaccgttacagacatgcctgtgtctaaggtttctgcatctttttgcaaatgtatgagtatgaaaactgaagacagtttccttttgttaccactgtaagcaagttctcagaactttctaaatgtcccccagcaacttcccagacagtccttgtctgagacattttcaacctctagtaatttcttgacaggtgtattttagtagagttactacaatgcttgctgtgggcttcttcccccaccttaaccccccaaaatgagaatcttttggtgatggtgttttcaagatagtgaaaagcattgataagcctaggtatggtttgtttcgtgcacgtggccactatgttgaatatagagcgataactatggtctagtgctaagccggtgtggttattttgttgtggctcctagttaaagtgccagtgactgagtgtgtaagtgctggctctgaatccaggccactctgcttaccgtctggcagcctaggggctctgcccacagtttccacctccctaaaataaagtgaatattaatacctgccttataaagtggttatgaggatttagtgagatactcccagcacataagtatttataaacatttatgttgtagaacagcgttcaccttcagcttctgtgaccagaggatcatttgatgataataaaaaagacagtaattgaaatcgatgtgatttgacttatttagaagttcatgtctgggatcatttagtgagagagttagatggcaaagctcatttaaaatataaacattatatctaagcgatttcaatagtgagttaaaatattggaccttcactaagaaaatgagataatcgtggccacagatgttatcaagtaagaagctatttcaggagcagtgatgactgtagttctccagaagggagacgggctgggctgggctgggctggtaggtctccaagtgagacagaaggagatggttctgttgttgcaggtttcagagagaagttcataaaactgcctgagtgctttgcctagtaaccagtcatgtacttcattttccccccatagatttcatgtgatttgaaaaataggagtatgcatttcatatgcagaatataaataggatctttgaaatgcatctttccctcttatttgtattattaaaatattctgttggtattcaagaaactggatggtcaatcacatattttaatgttcgaaataatacaaagggctggtagatctctgtcctactgtcttggtcacagcaggaaagtatatgttttatgagcagcatctttcaattaccctaaaatttgaaagatgatttgcattggttgaaaaagtcaattaaagctcaaagctggaaacaagattaaagaaccgttttctaacgttactctttttggttgtttcactgatgacttagcgctcatttccattttataagatatacaaactgactcacagtacagagttgcttcatagtcacagaaaaatttcttgactatggatttttaaaaaacagcatcagcagctaactaatcttgagtgagaatgcattttgcacacaaatatacttactttttcaccaggctgtatgaattatgatgctggatgtttctggagatttccctttcttctgaggcaagggatttttccaactaatctctttgacaggtttctgaactcgaaatattgttgcagggaatatagaaaaaaaatgacttgatggagacaggttctcctttcatgtgtgctgatgggttactgtctctgccatcctatttatagcctctgggtttggcaggggaccaactgcaaagaaaacacacgatccttccttaatcatgtttatgtatctgagatagaaagtaatcactgccttctcttttctgcacaaaaatatctggcagatggtggtttgagattttcaggctttgggatttctttttaaatcagtcattccagcctatctttctccccaactttggttttctcttcactgacaccacagatttgatcttcaattggaaagaaaccatttaatctattagttcatcttttggaaacatcttttttaggtgacagtaacatatgagagtggaactctgttttatgttacttcctgccttatttttctcactagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggtatgttctggtgacaagatgagctgtaaatgtgagagcagctacaaaattcatgaaactcttcttttgattaataaatatatggcttgtaaaatcattaacagctgagccctagtctccagtttcttggcatatttgagtactcctgttttgtgaccattctttttcagcaggaggcaagctcattaattagtcattgattagggaaggtaaattttcagaaaggccagcaattttagttgtaccttacaacactagtagggttaatgtctctcatttctaagagagttctctatatcctgagcaacaaaaaatcttaatctccctttccaatttttggactgctacctgctaattcaccaacactaccatactctaaataaaaaatcacatgaatgttttgtagctttcccctctcacattggtataaatctttatcccagagaagaaccactgtcccaacatcatttccacccgggcaggggcaggactagggtgagctaagcaaggcgccaaaggcacaacattttaggaggcctttactctcaggtttgtacaaggtagggttggcacatgcacaaaccaaacagtgaggacctctgtacgctccgcaccccaggcagcttgcttgcctctgcggcattgccacatcctaggcaggatgcgggctaaagaagacatcagggacccccataaacctgagcttcgttcccaggatgtgctgctgactggccatgcaacctggggtatcctatataaccccgttcaggctccgtaattctatctagattggaaatgaaaggaaactcctcatctctgaaggggagctgttgatgcctgctgtcctaactgggtttgctgtaaagaggaaatgagagagctccatgccaagtcccacagctggtgacaggtcaggggagaaggaggggaaatgggacaagatcttatgtggattcatgtgaatctatagtaaacttaaaatacacctgccatgagagaaggagagagaaacaagggcgatgatgtttaccataaagaattgctgtaaggattaaacgtgatgacttacaatggaagcccttcacacagtgcctgacagaattgctattttgaattgttgcccagattaacctgctcttaacacaccattcctttaagccaaatcatccccctacggagaggaaaggaagttcctcctcaccctgttcatggtccagctcatgcctgattcttgtagatgtgccatatctctcagttcccacacttcctttacagaaatccttcaggtccctaaagagagatattctttaaagttatttttcttacgtctgtattgtttggatttcttataagaagcatgtataatttgggcatttttaatgctaaaaaataaatggttgacacgtatatcctgtggcctgtcatatttcacaacgcaaagacacaggtagacaggagtccttgagctggtactgtgaagtgctaagacctttggcaagaggaatgtgtgttccaagtcttggcttcctctcagtgcatttctgtgttttctgtgaataaccctttttaacttccactggccttctgcctctccagtgatgagctttttttttttttttttaacctggctggagcactcttgaactgttccatcagtctgtttttttgtttccctattcccgtcttcctgtgagatctgcctcactcttggattcagtatttggctctaatttacccagtacttcagttcctaggaaccttccccttctctgacctcttccctcttttttcacattcatcatcagcactagcaaaggactttcttttcagagccatttttcacaaagaagcaaagttttatcacttcataaaagttactacatactcaactgagtgggacccaccctgctgtctggagctgcaagttctgaggggaccgccaggctcactcattcataggcagagtgagctgcctcggcctaacccccaggagtgcaatttaaagttatgccttagcaaaatgacaaattacatgtcatgggccttttggtcattcatgagtattcaaaatcaccagagctaacttatcatctgctctgaaaaccacatttatcttgtggccttacagtgtcagcactgtttttccactcttcatagcagtgtttgtcgtgagcaagccagagccttccctctgacgtgctgtacatcacacagcatgtagctgagacctgtcttcttctgcttaccactgtaaataaacaggcctttataaaaagcgattgcacatccactcaattattagcataggggagaactaagaagatgtttacttgcactttagttcatttcttttgtttgtagtgcacttacagtttgtcagttggtaatcgaagttgaaaaagctagaggtaatctctttttggagaggaataagaaaaaatcagtatctataaagaaatacctcaataactgtgaaactccccttgccttgtcttagcaagaatttcattattattgcattattcctgggagataacatacctataattttaataccagaacttttacttgtgtcatcttttaaagaaactaacatgttgccaccgttgtcagatgagttgctgtacacctcagctctatacacaaaaatgtgtaactgtacccagttcatacattaagatccagaaagatctaacgaaaagtattgtttggcagcctgacttggtccagattcaaaggtaagttttaaaaagctctaagaggaaattgaggtatttgtgatgcataggaattccattgagaataaaatttactattataattccttcattactcaatgttactgaaaatacttgaacgaaagtaacttgatttgtctacccaattttacgcattgatttacatttgctttcagcaattgacagtaatgttttataaatgaatcatttctgcaagtgacgttgcaataaatgttagctttccccttataatgacatttgtccttttcttctttgccatgggttttgattttttcccctattattgtctctttgggggttttatttttaagagattgcatgccaccagaatctgaacaacaataacaaaaacctagtaccttctggaagtagaatttactcttttgccgttggcaggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacaggcaagtctgcggcaaggaggtgcaagcagtgctcttattcctgagattgtcctgtgatgaggcctttgttgaggatacctttcctattggaaaggatttatttttgcatttcttacatgccgataagctaagcagtctccagcacttacaacctgctatgctgggagaagtgttttctgttatggggcctatttttggttttcactttattgtaacaccctcactcctacattggtatttgtctctgtcttagtctgtttgttctgctgtaacaaaatgttgtgaactgggtggcttataaacaacagaaatttatttctcacagttctagaggccgggaaatccaagatcagggcaccaacagatttggtgtctggtgagggccccgattctggttcatagatggtgcctttcagctgtccttgcacggtagaaggagggagaggtctcaggcctgtttttataagggtgctaatgccattcatgagggctctaccctcatgatctaatcacctctcaaaggctccacctcctaataccatcaccttgggggttggaatttcaacatatgaactttggaagggacacagaccttcagaccatagcagtccctaaagccacaactggtcatgccaactcctggaagaattggaaatgccaggatgagaaaaatctagggggcaccatttcccttgtgcccttgtctctctgctccaggcctgagtgcctgttctgcaggaacgtcttcttgaatccccagttctggaattgagttttctgccacatacccagaaagtattaaaattactgctctgcagcagggctgctgtgtggcctcaggatgtgccccaggcttggatggcgcatttccctttgcttctgcatgacacctcactgattaagcaggaaggaaggactagagaatcagtggtaaaaattgaaggctgcttgtcatggagctgtagcagtgactataagtttgccttagtatcagatcagagaaatggtaagtaggatgcctggtgccatctcagaacagcaggacagcaacctccctgagccacagtagcatggcagccctctcccccaaaccccctgctttgctctctccatagcgctgatttccccttgctgtggaagttatgtcttcctcttatacctgactcttccattgcagagatttttattttggttcactgctatatccttggcatctagaataagcctggcctgctcataacaggtgtttggtgaatatttattaattggccaaatgacagtgctggaactcacattacatctcatctttatacttttgaaggagtttctaaaatataagaataatctaaaaccatattctcatctcccagaaaccacacctatcagcagtaatgatatttcctttcagtctttttttaaaatgtatttttttctatttaattagtaataaatggttatagggggtggggagggctgggaaggggagtgagtggaaccataatcacttacgctcttaaaatgtcgctggacagcctgcacttgtgagcagcataagaagaggctgagatgctgagccagtgccagaacctttccatattaagaaaattgctacccagtctaatctgtttttcaaaaccagagattcggaaagtcctggaccaaatcaaattgtctcctagctccacacacttaacttctttcacaagtacttactgcctgcctgctgtgtgccagacgctcttctctatgctgggcttgcagcagcagacaggtcgcatgacagccccacccgaggtagcttacgttccatgggtgaggtagacgcagacaaggtgccaaacgaacagaaacgcgtggagcgtggtgggtggtgctgaggggcagggcgcataataatgtcagggtgggtggtgggccatgctggggagaggaatgctagtcaatgaaggccttgcagagacagtgccttttgagcacagagctggaggaggcagggaaggaacagtgcagctccctgggggaagagcatttcggttagagggggacatcaagtgagagagccctgagaagctagaggaccttgtgtgcttgaggaacagagggaagccggtggggctggagcagagccagtgaggggtataggaggcccaccccagcgtggtgatctgacggccttagccaaggcagggcaccgcatcccctctgcacttatccgtgaagctactgacttagagcagcagctcccaaggtgaaatacagtgactcaggatgaggactgcaacttgaccttcggatgtaacaatatggaggtcctatatttaagagaagatgggatggtggaaattagagatgcaagtacataactctttcaaggagttttgctgcaaaggagagcaaagaatcttccttgcttttctcatgggtcaggtttctgctcatggaatttgtgtctgaaaatatgtagtctgtttttgtcaaggcatatcctgggcacagtcctgcctggtcgagtgtttcagttgtcatcctaccaggcagctgtggaatctgccttttgagcctcatcctgctgcctagcacttaaagacagacgggtgaacaaagcagcaatggccgggcccagctgagaacagggtggctatgtggggcaagtgccctgctcccccaaatctgtcttccagaggctgtcttgggtgcctgaaatttcatctgtgtttatttctttggggtatttagctattgcctgttccatagtccaatttggaaataaaaaggttagaaaggctttgagtgggttggctttacctggctctgctcacctaaaccctcagaatcattagcaacgcatgttctgttaggggctgaggaagtagctcaccacctgctcccctcccttgtcctcctccacttcatgagagtttaattgggaagatacggagtagaagagaaaaccagattttagatcgggtatatacatttgaagtcaaactgtcaaaggagccttaagattgaagtgttcagttgtccttagggctaactctgcaagcactggtccatgagtaccacccaaatgtagagatctgagggccttagctgaggcaggaagtcccctcttcagttactggtgaggccactgacttaacagcagcagctcccaaggtgaatccagtgactcggaatccagttggctatgcttaagcagagcaccagcatttgcaaaatgtcctcagagaggggaaataatatctgtgaccatgttttccaaattcaacattagaacgcacattagtctacttagaggtatgaatgataaggcaatggaggtatttagatgaaggcttaataaagaaggagggataaaacatactcacttgggagggtctccagacactcagaatgtagagtcatggttgcatgaatcccaaagccccagtgagatcagtggccctcagtaaagatacggagggaggttgggactgacacctacagagatcctcagctcaggttcgtcccggccacagctgctccacagagctcactgcctgatggcctcacttcagttcttgccacctcttgccagttccgaacctgatcgactcccaggcacacctggtccctttgtggtgtgtcctgcagtagcctccatccctgtggccctgagagcgatggcctgttggccactgattttcatcctgcacccctctgagtggggctgaggctgtgtcacccacattcattaatatccttgctctctacctagatcatctctgaaagtggtgaaggcagcagcccaggtcttgaatacattatggcaatatcgggacctccggagcatttataaaaaggtaacctacaagaatagctctggcataattagcattcatcagagcacacactcataatcatttattgtaatgaaatgtcattattcattttgagaggtttctttttctcttaactctgcaggatgggtggaatcagaaccattttattacacctgtgtcgacattggagcgagaccgattcaaatcacatccttccttgtctaccaccaaccaacagatgtcacccatcattcagtcaggtcagtgggaaaatgccactccttggcgagaacctttgtgtgacagaacattgttccccagccagagaagatcaaacataagctggttaagcctgtcatctccaacactacccatgcagcagagaaccttctgtaggattcacacaccattataaaccacaagcccactttcttcctttttaaaagtgtatacaattttacatcagcaacagcgccccaggccctgccctcaagtctgcctcactaagtgtgagaaggggccctgaaacctgcagttgacagactggacaggggatcggggtgcctgagagtggagggccacacttcgagacgcactgggttatgcctgaaagtggctgccctgtatgccagctggccataaggttggaatctcctccaaagtgaatttttttaagttttcttagtgaaaccttttagaagcagggtcctttaccagaggacctttaaggtcttcagatccgcaacctgggagagctgcctgctttccagttaaacctccttcctctgcagacccccagcatctgctgctaatggaagcaggccttacagtgtgggtctgtaggaattccttttgatttttaagttgggaatcctggcaaccatactacctacttctttgtaatgtttaacttgatggaaagaatgttttgagattcagacttaatttttttacatgtaagggcagattattactgccaagccaatcagtcctataaatctaattctttccaaaatgagaaaggaaaaataataagtatcttatttttatttggctttaagtcacccatttggacttttaaatattatctattttattcagcagtgctactgctggcagtcttatttctcatgtggacaaatgtggccaaaaagacgaatatacatggccagtggttcttgccacataattggatgtccccacttgaactagaattttttttaattgtctgtgcttgttgtgtatggtatatatcttagtttttaaattatgggttgctttcttgaaagaaacctacgtgtctggtttttaacatccttgctaagctcccaggtatagcctgaaactgctttcttttagaaaaatgctcagaaccttttagggtcttgggaatagaggtgccagggaaattaagatgtgtggctctataacaaaaggcacatagacaagcaaaggataattttagattagtacgagcttgtccaatctgcggcccatgggttttatgcgtcccaggatggctttgcggcccaacacaaatttgtaaattttcttaaaacattatgagatttttttggtgattttttttttttagttcctcagttattgttaatgttagtgtattttatgtgtggcccaagataattattactcttcgatgtggcccaaggacgccaaaagattgcacacccctggatcattagcacatagttactgaatagtgaccttgttttcaggaccccttaaatatacctgctggacagtgttggctagccccattcaaattcctaggtgccttttgggattctagtcagtggtagggaatactccacttctgcttctccagttattctaagggctgataatgcatcccttcacactagtgtgggatctgcttccgggcatgtctgatgccttgctgatgtcattggaggcaggcgggtatgctttctgtcctactactttctggaaagtaagcaaggtgagcagcacatagacattgtccatacatgcttacatgtttaacactgaacaatcctatgtcagtgaggtgactttttaggaaaagtatttcattgtcagtcttcctctgaaagcgtcaatttatgcaaaaccactggtgtcaaggtttggggggctgttgctttcgagtgtatcaagtgaataagtggccactcttatttgaaattaactttaggggaagcaagatgatttttttaataagaaaaagaaaaaatgtgaaatatttctctcttctttctgtgccacagtgtccaaaaagagtcctaaggatagatacggtgttattagatgttggctgaagctggggtaaaacagtcctcagtcctctgggcctttctgaggtcagggcttagcaccatgtgcgcttcctaatgagccaggcttactgggtttaaattgtttccttgatcaccataaaaagaattataaattttatagaatgggtgcttttattcaaacatgtttagagatgtggatattttggaaataattagaaatcaaaacatgccataaaacttctgttggctgaagagctatacataaaggataataggtgggtattttgcaagcaactgaactgggatcataaaataacaagtataactcttgcatggctagtaagttattatcactcagtttcaaacgcctagtcaagacattgagacagactagtggggaaagctgcatgatctctacactgtgcctctttagccgggcagcttgccctccagcttgagagtgagccccggtgttgactttgctgatttgtgcagtggcaggcctgcatgcaggtagcacttgcagtacttgggtctagctgctcttccactcccagcacctctgagatattttcagcaccagctgtgtgtcatttctagttactgagctttgtgtttctggagaggattttccacagatactgatgctgatttctctttctacccctctttctctcctcctttgcctctcccttcagtcggcagcacctcttcctcaccagcactgttaggaatcagagaccctcgctctgaatacgataggacccagccacctatgcagtattacaatagccaaggggatgccacacataaaggcctgtaccctggtaagacgccagttgggtgtgtgatacagtctcttgaaaagccgcatttccaggcgcttggccagtggcctgggaagtagcctgtgcttgtattgagacagtcccccagcagcaaaccatgttccagtcattccctttcctactttggggattgttgccttttctgcttgtttaaagtaaaacaagcatgtacttgtttgtatgtatgtatgtatgtagttgtacggtgggcacaaataaaaagagggctgtatccaaataaatcatttctggctgctcactggcacagtccctttgctccgtcccctcctggctcgagcagtctctgtgttttccacatgcatcagaaccgtcagcccagtgtcactttgcaggggccacatcttctagactggctcatctcttaaattcaaaccagagaatggagatcaatttcatttacattttcatggagaagagtttgaataaatagcaaaaggtataatgtgattcttctcaacgtgattattttttaagaataacaaacaaaaataatgttacatagtgttaatatttttatatcctattcagaaagctgtgcatacaatttatttaaaggataccagcccaaagggttactaagatttcatactgttcccattctcaaccgtctggcgattataactactttagatgttccaaataagtcagtgtgagctaccccacaaaaagtactcttttctcaaacctgtctattaaaaataaataaaagctggtggcagctttactcctgctgggggggcagtctccattgtactgttgtctttgaaattgtgatttcacaggactatttactaatcgactgttgttactatggcaattaatagctcagaaaattgcagatgctacatttcaacaccaagctctgggcaaaaggaaatgcacataccaactgaagtgcatggttgcttccgatttgcagcagcctgctttatcttacagatcacctctttagcatgcatgcccttctgtatcttcttcgcttgcttcaataaactaatttgcctcaactacgtttcattttcctcattaaaaaaataaaaatctttgctagccttaataataatggaagggtaacatcatcaggagtctactatggacttttgaagacaattatctcattattaccaagttccttttgtattaaaacatacttaaatatgccaggtacaagactgtgcctccattgttgctccttccttgacctgagattttgaatcccagttgtttgtttggaaggcatggggcttgttcgaatattgtgtttcgcttctcctctctgacccactgctgtagctcagagccctggaaaaggagtgttcctcagctcaggatcccgtgctgctgtccaaagccagctggagaaaccctcccacatgtgagcagagcttgagcaggaacctttgcgcatgggctctgcactggcattgctttttggggaaacacacgcagcctgtttttgccatagttttgctattagcccccaccagccctgaggtaagcagcagccaggccagatccagggaccctgagctgctacctctcccagcccgcattggcactggggaagacaggccctgtcggggacagtgctagccctagtgcaggggagaccacccagcctaatggaccagagtaataagcactagttttaatttcataaaatattttcttacaggctccagcaaaccttcaccaatttacatcagttcctattcctcaccagcaagagaacaaaatagacggctacaggtgaatttgcaatatcatttttacagaaggctgattagcagttaacacagtaaggggtccacgtcgattgacttcccagagctgggccaacatggcagggtcctagatgctttccctggggatcttcactccttggaaactcaacgtgtggtttaagcaaagcatttccacggtagcctcacgttcttgagtatccacatcggtactgctgagaccaccgtgccactgatggggacagccgagaagtctttagttcatgtcttttgcccagcagtgtcctcttcccactctttttctgttaagctctaaaatctcttccagcctctgagtgagggaaggttggtaagcacacttcatgccctcatcacattgttctcttttgtgtatacctcgttctccatctcgcccctccctgtccaagctccacaatttaaaaacactgagtccatcaccaggtctgtttgtctcagtggtcaaggtggactcagcccctgccgggatggacctcactgtgggagagtgggactggcggttataacacacccaggctttgctttcatgaagggcctgcagtcagtctcaggtccttaccagtgccatggcgaacttggaccatctggtctctcctcttccctttcaatgacacagagcagctggagtttcctaaaacaagactgtatcctgtccttcagataaggatgtgttctaagacctctccttctcgtcatcttttctctgtaggtggaagaaaaagaactttccaagttattcataatttatgctatggttttttagtcaggaaaaatagaccagaatcataactctggcttgaaaggagaatttagctctgaaatccttataatgttagaatgcattgagttccaggacatgacattggtttctatgtggtaaatttgttacatcttactaagtagggggatttgggcataatcaagaacatagacataataaccatcacaatttgaagaaattagtgtgaggtcaaagctaagactgaacaaaaggaaatggagagcagtgtgccctgtgtgggtgcccacgtgtgcctggtcttgcccacttacagatggacttagccctggcttggggaagccttttcctctagaaccatatttgctcacgtgtgtctcctaattttactattcttctgccttgagattgcttattcctttaatattacaacttacagcagagtttccaaagtgtgactgttgttcacctagccacatacatcttttaaaatgtaggggtggactccatcttcatatctgaagtaaatgttctaaaagatggttcggtaattatacaattatccaaggcccagaaacccagtccttgactaaattagtgatgtgctaataattcccctgtgtcaaaccaaatatcaagaccatcctctcattcggcatgcccaggtaacaggtgcctccacagctgagcacacagcagggcctccagtaaagaggggaggtttctggggccacctgccctgagatctcaggctttcttgaggcacctgcttctctagaggtcttaggacaggaaactcagcagcctgcctgagaatgcagcttaaaatccttagagtccaatagtaaacgcatagtgtgcaccagaaacagcttttaaccttaaactgcaaatattgaatattgctttaaaaatatgaagcaggaagcccacattaattttcctaacacatgtatttttaaaaaattgcttttatttatttgccttttcattttgtcaacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcctggccataactaaattgatataactaaattgataccttttttaggcatcatttttaagaactcagtaacttcataagaacagtggttgggcatttatttggttggcaccaatataataaaacaaattctaaattatgatcttgttgagtaattcctggattaggaatggggtaggggaaagaagccccacagtagggtaggcagaggtccccatagcaccacacagcattacttgggagcttttctccatctgtggaggcaatgagggacaccaggcccaaagtctgaggccttctcaggtcttgcagtttccacccttcagtcctagctcctggatctttgttggtgtaaatatggaaatgccacattggttaagtgccatcatggaaaactaggaactagtttacctgtagctgtactaggaaaactaggaactaacgcccatggcaagtcaaacccagaagtgttgtcttagctcaatataccctgcaagtgtaatacaaatcgcagattaaaacatttgtacttatatttgtgagtatatggaaagacacccaagagaaaactgcgttttcttgccgaatggacagcagcccaagatgagcatccaaagtgaaatggaaataccagtgcgagcatgaaagttcctaagatctgcaagccgggagcccttctggggtgccttctgaagaacactcgagccagcttgcggagtcgactgcccagctactgagccctggctgcctcatacctggcggagctcagcagacagcccttgttagatggcagaggtcgccagatgttcctgaggaactggcatcaggacttctgggacgtaaccacttcagtttccaatcactgacttccctgaacctggtatcttcagatctgggttgaagctgaaggctcagttggggaatcaggaaaacaagggaatcggagccagcccaagccaactgacaataactttcttttagtgactgcattagtttggggtaatgctgtaacaggcagcatttcaaaaacggatccaaatttgggttgaaaataactcacctgggtctccaatcagacctaacagagccagaaagaggcctgtacacggggactgggcagaagatctaatgccgtt

SEQ ID NO: 17176 - DNA, 44479 bp, Human
  misc_feature (1)...(44479): n = A,T,C or G
acgaccacggccagagcagcgctcggaggcgagtttgtcaacaatcgcctcgcctttggcggcctgacccgtaggcgccgcccccaccgcggctgccgattggctgcggcgcggagcgaccgcgcgcggaccaattgggaacgcgggcacccggcgccagcggcgcggggaggtcggcggtgccggcggcggcgggcgcagagcgcgaggggaggagcgggaggaggcggaggatgttcccggcggctgcggccggggcagcgcgggccagaggcgcggcgtgcggagccctcggctgcccggcggagcgcggcggcgggctggcgggaaggcgcgggctttgcgctgcgccggggactctgaacccgagtcccgggctttgtctcctgcgctgctttcgtggtgacggtcagggggcgcccggtcggcgaagggcgcgggccggacgccgcggggcttggtccctggcccggacgctgcgctctgaagggaaggcgcggacgtgagtttcggtgtgattgccttctgaggggagggtctgtgggatgaaggcggcgcggcgcgcaccggtgtcgcctagcctgcggacctagttgtagaccttgcaggcgttcgcttcgtcgccctccgccggcccctccccatttagagatgtgcacctcacggtgtgcacctcagagaagttctgtctgattcggggcggggtgcggtacgggagcgggaggggagggagcacgggcgggggagagcgccggagccgggcccgggccccgccgggagtaccaaacttctattgagacggccctgactagcgacggagcggggactggcagaccttgcccgggagtggggtgccctcagactgttctggaagacagggggggcgggggcgggggaaggcggggcaggcggggtgcaatagataggaatatggccccgatcattggcgtcccgcnnnnnnnnnnnnnnnnnnnnaagtctagacttgcatccctgcttgtggactctagaagatcccccgctgcgccggggactctgaacccgagtcccgggctttgtctcctgcgctgctttcgtggtgacggtcagggggcgcccggtcggcgaagggcgcgggccggacgccgcggggcttggtccctggcccggacgctgcgctctgaagggaaggcgcggacgtgagtttcggtgtgattgccttctgaggggagggtctgtgggatgaaggcggcgcggcgcgcaccggtgtcgcctagcctgcggacctagttgtagaccttgcaggcgttcgcttcgtcgccctccgccgccccctccccatttagagatgtgcacctcacggtgtgcacctcagagaagttctgtctgattcggtgcggcgtgcggtacgggagcgggagggagggagcacgggcggagagagcgccagagccgggccgagccgcgctggagttacaaactctattgtgacgcacttactacgactgacggccgctgccagaccttccccagacttgctgccctcagcattttcggcaaacaatggggccggagcagggaacgcggccagccgcctgcaatcgctgcatctgcgcccgctcctgtgctccggcgtcctacctaaccccgggaagtcagagccgctgggagtttctgacttactcgaagaagtctgtcctgggcaaagagcacacacgaatagacttcagattagctgcttctctggaaacgcatgtgtgtgtgcaccagttccgcaagctgttgacattgttactgtattttgtttgggggtaccctctaccaaaaaaaaattacacctttattattttaggtgcaatttttttatttgggagattgtcagaaaagtatagaacaaagtatttgggattaaccctaagaatttttaatcgctaggtgagagctaatttgtttattcatcgatttttttttttgcttaaaataatcttagtttttattttacttgcagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatgggtaagcaatgcctgggtaagaggcagttgacgtgtggatggttgaatctgcttgaaggctgtgtgtggcatttaaaatccccttttaaaaccccgtaactgatttattccatctttagatgggaatggaggatgtgtcaaactatcaaaccaacttttttttttttttttgagatgagtcttgctctgtcgcccaggctggagtgcagtggtgcaatctcagctcaccgcaagctccacctcccgggttcaagcaattctcctacctcagcctccagagtagctgggactacaggcgcgtgccaccacgcccagctaattttttctatttttggtagagatggggtttcaccgtgttagccaggatggtctcaatctcctgaccttgtaatctgcctgtctcagcctcccaaagtgctgggattacaggcgtgagccaccgcgcatggcccacatcaacatttttacaaagttactaacttttgtggcagtgatgagttgaggtccaaacattagctttcaggtctgtcttcattaagctaaagtgtgttttaaccaccaggctttacatagtaatgacattttgcttgaaagggaactgatcatttacagaaaatagcttaataatcaaaagtgtaaagaaagatgacaatcatttttgaaaataacacttttaaaaaaatgaactagttcatgaaagcagtaccaacatagaaccatgaaaatggtttgttttctgcctaaattcctctttgtgcttattgctcagagggtttggacatagtactaatcagattaggttgtaggtttttatttcagggattaaaggcagtagtagggtttgaaccaagagtggctaacataaataccacagaggcccacagcaaaatcatggaaggaactgacctggtggagactggtaaattggagagtatttgccccttctatgtttgggccacacctaattgtggctgtgagggcatgtggtctcagggtgggttttcctatattgcaagataacctaggaatgcaaaattgatgccagataccctgtttcaacattgacagctgattcagattttgaaaacattgtacaagctgaaaagaaacatctgcagacttgatttggcccttgaacctacagcatgtgactttgggtacatactttgggtaaccttggtgaggggctgagtctgtgttgatcgacttgctgttccccaccaatggaaaaggttcatgtcttgatcagtagtcaatcacattgaccatttgtccagattagcttgccatacatgaacaagatagaagtaagttggtagagttatcaattaggaaacccagtacagagtctattataatttagattgtacctcatgatgaaggctaactcaacaaacccatcagaacagacactggaacaaaatgacatttctaaataccatccagctctgtcttcataggcttcagtgaggtaaatcaggcaggcctttgcccatgttatagaattggaaagaacctcagagtggtggtcacttgtcagaggttgggcacacctgtgaggtggtggggagaaatgacagacatcccagcagctacacatgctggctgcacgtctcttgccaaatgccaggaggtaattttttagggtccctccttagggaaaggggctggaagttttattattgctgttactactgctcgtgaactcatttcagccttagaagttcttggcttgtagtttttgttgtactcatgaaaatgctcccccatatatatgatcattctcgcttactataacatccttgcttactaaatgagttaacagggctttatggtgtgtatcgtgaaacacacgtgcattaaagaccctctggaaggtattagcttttcacactttcacaacaaaagcttcacacttgtggttattaagctattttctctaaccagttccctttcaagcaaaatgcatacattggtctctgtaggtgatgggttaatgcatggaaatagtttctccttccctggaactgggaatagtgggtgagatagtgtattttttaatgtaaagacaggcacaaatgctttttttgttgataaatactattttacaagctaattataagttaagcactgttacttgagatgaaatatacagggcttcaaagatcataatctaaataattatgcacagctaatggttatacctgtgaagtaaagtagtggatcctgaggtgtaattttatagtattagctgcatttcagtagatggtgtgatgaagagtttaatgcataggattaaatgagaagttacgaggagtttgtttaaagttaatgtaccgaggtaagttttcagtgttaagtttttgggagatttgttttgggagaggatgagttggggttgggggaggaaaggacttagccagatgtgagtttcttaaattgaagcataaaatttacaatttatgtagtccataattttctctggacattctacagtcttagttcatgcctgaagaccactgaaataatgctgagttgataagtggttctcttgactttgtttagtattctttactcaaccctatccatgaagttcttcaatgaagcttttgataatttattgcaaaatacattttccacaaagaagtcattatgattggtttgaactagtggaacacaaatgtgaggttataaagaggttcgccttagccaggggctcctttagctgcaaagcagttttttgctcagcaacttggggtagagatcagtgtgtcttgaagttttgttttgcaaaactttgttctaatgagaaagtcaagtcttaggaggaatgtatagtagttgagtgtttgtattaacactgttttcatattttcctttatgtctctgatttttctgaagacaagttcaaggaatatatttctctgtggggcaacagatacagttttttcacttttcctcaattttagtctccttacactctgggaggattaacttgacaaatgataccttagtgaataactgattatttttatcaaaatcactcacatgtgttggtttactgagtgcctttttggatgagtgttttatgccatatgtgtttttaatggaaattaaagtgtagtcagtacactaaagtgtagtcagtacaattggaaataagagttgagaaaagtcaggatatggaggaatgctccctagtgtcatgttagtaaatgtcttaaattttatacttgttccctggcacattggaattcacagatgggagttaatggctttctttttttttttttttttttcctcagcgtcttgtgggtacttctcttatagctggtacttgtctgacccctcctttagtttgtgagctccctgggcggggaataatggcctgcagatgctagcgagtgcctgacaaagaggagaagcccaggagatgttgagagtcagtccagctctgcctgttagcctttcagacaaataaagttgaagaaggcaggtagcaagaaaaagatcctgacctctgctctgccaaagtgtttttaattacctggatctagctgtaaggtttgccacgtagtggtgacagctgaggtctagctcagcactactcagcagggaagccacacatgcattaagcacttgacataggactagtctgaactgagttgtgctgtcattattgatacacactggattttgaggagacaaaaaagaatgcaaaatagtttaattgttttcatatgggttacatgttgaaatggtgttttaaatatataggttaaataaaatataaacttgtattgcagttaaacacaaagcgtaaaatttaccatctgaaccatttatttctaagtgtactgttcagtagtgttaagtgcacttattttgttgtgcggccaatctccagaacttcttcaccttgcaaaacagaaattctgtactcattaaacaactccccatttccccctccccccagcttctgacaaccaccattctattttctgtctattaatttgacaacttcagataccttatataagtgaaatttatatagtatttgctcttccatgacaggcttatttcacttagcgtaatgtcgtcagggttcatttatcttgcaacatgtcagaatttccttcctttttaaggctgaaggttgttccagtgtgtgtatatcacatacttcatttatccattcatccatcaggagatacttgggttgcttccactttttggctattgtgagtagtgctgctatgaacatgggtatgcaaatatcttttgggggattctgctttgaatttttttggatatatacttggaagtggaattgctggatcatatggtaattctatttttaattttttggggaaccatcatgctgttctccatagaggctgtgccattttacattcccaccaacagggcacaagggttccagtttctccacatacttaccaacacttttttttttttttttttaacagtagtcatcctagaggatataggtgatctttcactgtgctttggatttatatttactggcttagatttgtatggccaccaccatagtcaagatacagaacaactcaaccacaaggatttctcatgatacctttttatagccacagccacctctctccctcttccttgagcattttgtcatatggtcattggtgattaaataaaatgtattttaatattgactttctctgtttctttctacctttttaaacatggctactagaaaaatgcacaattagatttgtggctggtgttctgtttcatctaaacaggctggcctcacagaggagctggagtgtgcagtgctgctctagcaagccaggcttgactcttcccactcagggcacatcacttccatgaagcttactccttgggttgtttggttgacttaggagaatggaagtgattagcagaatcttgtaagcattttaaacattaaatgagcattgtaaacagcggcattcttcaggcaaatacagttttgttttacctctttaaattccatggtatattcggacttcaaaaagtagatggtagagcacatgctttctcagcaccttcaggctgcctggagcctcccaatagaggtgtcttcgagggagtcccagctctgtctctgaaaccccaaagttacttgtttgacaccaagagaaataaggaaactttttaggtcctaagtggggagagaaagtgctagaagagaaagatatttttctttactagttccaaacacatttattaattgttagttacccaattttaaatttacatcttaaaaaaattttttttcagataattacagattcacatgcatttataggaaataatacaaagaaattgtatatgccattcacccagtttcctacgatggtaacatcttgcctaattatagtatactgtcacaaccagcagttgacattaacagaatccatctactgtattgagatttcatcagtttcacatgcagtccatttcatgtgtctgtgagtgtttacttctattcaggtttatcaaatgtgtagatttgtatggccgccaccacagtcaagatgcagaacaactccaccacaaggatttctcatggtacctttttatagccacagccacctttctgtctcttccttacccatgataaccactcatctgatctacatatctgtacttttgtcatttcaaggatgctgtataagtgtaatcatactgtatgtgaccttttgagattggcttttttcacttagcataattcccttgaaattaatcggagatgttgtgtaacaatagtgccttgtttttttattgctgaatagtattccatagatgatgcaccacagtttgcttagctattcacctgttgaaggacactgtgtttgcatgttctggcaaggccctggcacagctggaactcagggaggattaaaagaagtatttattgtacttttacttctctttttttttttttttgtgacagtctcactctgtcacccaggctggagtgcactggtgcgatcttggctcactgcaacctccaactcccaagttcaagcggttctcctgcctcagcctcccaagtagctgggattacaggcacgtaccaccacacccagctaatttttgtatttttattagagatgggtttcaccatgttggccaggctggtctcgaactcctgacctcaggtgatctgcccgccttggcctcccaaagtgttgggattacaggcgtgagccaccacacctggccctacttttagcatctatgtgttcacttgtagtatatagaaatacaattgatttttgtgtgttggtcttctgttgtgcagtttgctgaactccttaattctaagagtttttcatagatttcctgggaggtctatatagttatgtgatctgcaaatagggacagttttatgtcttctttctgatctgtgtacatttctttttcttgcccagttgcaccagctagaatttctagtgtttatgttgactaggagtggtgagagcaaacatccatacctagtccccaatcttagggggaaagctttctgtttttaatcattaaatatgatgctaagtgtaggttttatatgggtcgtctttaaaagaatgaggaagttttaacctgtattcccagaatgctgagagtttttgtcgtaaatggatggatgttagattttataaaatgtttctgtaccagttgatatgatcccatgatgttaatttatattaacctgttgatatggtacgttccattgatttgcaatgttaagtctctcttggatgtctgagacaaatcctgcgtgggtagggtctgtaattctttttgtgcactgctggattgaatttgtcgatattttgttgagagtatttgcgcctaagttcttgagaggggtctgtcgtcttcttttaagactggtttttatatcagaaccttaattaggaagggttccctcttttattttcaggacgatattgtgtaaaattggtattgattcttttctcaatgtagaattctgtagtgaaaccatctaggccaggagattttttttttggcgggggatgggggcgggggtgggggggatggggggcgggcgggcatttagattatagattttttttttcttagtttttgtaggattgttcaggttgtctgtttcttcccagttgagttttgatagtttgtagcttttgaagaattggtccctttcttctaagttgttgaatttatgaatgtgaaaagtatttgtagcattccaatatttttaatggatgcaggatctgttgtgataacccctgcttcatttctaatactggtaatttgtgtcttttttatctctgtcagtctttccaaaagtttatcagttttgatttttttaatcagctttttgttccactgatttttctctactttcctattattaaatttattgtttattatttccttttgcttgctttgtgctaggttcttttcctagtttcttgagacagacacttggaataatgttttgagacctttcctctcttttcttcttattgttttctcagaaagaaacatttaataggtatttacaaacagaaaccctatctcgggcagcctcaagatgagatggtagatccgtgcatggttacactccagacccagggcttatgagccatagggaaagtgtatatatgcttcagaagggatgtataggacagttggcttaagttcaggatttatggaaagataatatcaaactaaggacaggattgatggtaagtacatgctcatacccaaggaacagtagataaaatagaaatcttggaggcattcgcaaaaccagggttaatcagaagttaacacagcagattagcatacaagatggagttgtttggcctccacactccagctcccaatctggctcttacagtctcatgtgccttgctcttctgccatggtccctgaaccttcagtgggtgtgcttcattttgtatagctttaccagtagtgccttggcaatggaaaataaatcgggcacagtggaattccaaatgagggagattctcaggctttgttgaatcatttgtagtcctcagaataccatgattctggttttctgggaagaagtaaaacgagataaatactgttaatatgcacacaaagattataatgaaaaagaacatgaagaaaattagaactcggttcttctttagagacttgtagctaggaagtaattcaggatgcagtttgagttgtaggcaaataataaaaactcaaaaataatggttagggctagaatctgttaacaggtattgtagttttctttggagcacatttttttctccagtttccccattcctaccaaggaccaatttatttgcaaaatacattttagtctcattatacttagcctgattatttgcataaagtgcaacaagaatagtgattggccatataggctctttttaagttggctttgctggaattttttcataaggaatctcagattagacttttagaagcctccaggcttgaaagccaagctgaaaatttgccagcaaacattgcctgtaatacctacagatcgggtgaattccattctcctcgaggtcccaaagtatcttgaggttcctgggcctgtcggaaaatgacattctttgcttatcgaagatcaggaaccttgtaagggaactgtgtagacaaggtaccaggcctgtcttttttcaaggggctttttattctttaaagcagtctggtcatatctgaaaatacgctattcagtcaaagccttggtaaaataacccatgtctccaattgcatatagaacatactctatacaatttcagttcttttaaatgtgtcaaggtttgttttgtagctcaggatatggtctattttggtgactgaacaaaagaaaacagattcttaactgaacttatgcaaataactatattgccataaaataagaatactcatgagtagtttccaaattttggagaactcagaaaggtaaattttgctcatgaaagtatactttactcaatcataagctataaataactcaaaagcaaaaggattttcttcaattagaatggcagcctgccaaacagcgtgctgtgcattcaccttggaactgccatccacaaaccaagcagccatgtctcaggagcagagatggtggagtcttaccccctttcgcttttctaatgtacgcatttattcagcgctagaaatttcctttccaccactgcttagctgcatcccacgtgttttggtatgttgtgttttcattttcattgagttctgtctatatatttttaaatttcctttgagacctcctctttgaccctaggttatttagaagtgtgttttatttccaaaaatacctaagtgtgttttctgttactgttttctttctgattctgttatggtcagagagcatattttattctatttcggtttacaaatgtgtcgagaatttgttctgtagctcaggatatggtctcttttggtgactgatctatgctgcttgggtacttgaaaacatctgtattctgctgctattgggtagagtgttcgttatatatacatctttcagatcttactggttgattgtgttgttcagttcttctctgtccttgctgattttactgtcttgttctgtcagttgctgagaatgtggtgctgaaatccccagctgtttcctttcagctctattagagtttgcttcatgtcttttgaggtgctgctgtttggagtttacacatttaaaatgtcttcaggttggatccaatcttctatcattgctgtaaaatgtactttatctggtattaatagcacttctgcttttttaacattaatgtattaatgttaacatagtattatctttttccatcctttcactttccatctgcatatgttgtatttgagataagttttttatatatggcatgtctttagataaacctgttttatctagtctgcccaatctgtctcttaaatggtctagaccatttacatttaagataatatatgtaagtctaaatgcctttttgttatttgttttttgtttcctctgttccttgtttctttttttgttttttaaccttactgtgggttatacgaacattttctaggatttcgttttgatatgtttatggtgttttaaaatatattgctctgtatcattttcttagtggttgttccaggtattacagtatgtgtgtgaaatatatattctaagtctactggtatcaatggtcacagcattttatgatgggagctgaagagtagaaaccttacttttctttaggctccgttagccccatttttccaatataattgtctgaagtatttcctccatgtacattgagcactgaatgagttggtattgttatttttgcttcaaccatcaaatatgatttaagaaagtactgttagtctaccaatagtcgcttccatttttccccttccaatgttctttcctttctgaagttctaagctttcttcttttgtcatttcctttctgtttagagaacttccttagttctttaatgataggtctgttagtaacaactcctctgagttctccttctgggaatgtctttatttccccttcagtccagaaggatatcttcacggaagatagaattcgcagttgatgtatctctttcagtacttggaaaacatgccactttcttagggcctctatggttttagatgagaaatcccttgtcatctgaattggtgttctcaactaagttatgtgtcattcctatgtggctgctttcaagattgtcttttagtattaagaagtttaattgtgatgtgtcttgtcatgggttctttgggtttatcctttttggggtgcactcagcatcttgaatctggagtttcacgttttatgccaggtttgggaagttttcagccattatgtctttaaatacttttccagtcccttcctctcttttggaactctgatgataagaatgttagtgcttttgttagtcctgtaagttcctgagactgttcatttttttccagtagattttctctctcttcagattgagtaaattctattgattttgcctcatattcactgattgtttttaaaattatgtttaattatatttttcaattctaagatttctgcctgtttctactaggtaagttggaagttcagatttctccttggctttgctggtactttccaaacaaaagaggggccccagtgcacactgctttattgtgtccagttgttgggggagatgtgtaagcttggctccctcagccactgctgacaccaggaagcagggagaccatagagggctgcctcataccttgtttctgcagagtagaggtcagaactcagcttccctctgagggaagctgaccccaccaggggtgggggggtcaggtacaacatgccaaccaggcccactttctactacctgattctccctctttgatgctagatgggagagttctcttttgttctctttaattagccagatggggcgaagactcagtacccactgggtgcccagacacccaaggctggggctgggagagccgatgggcccatgaaccctgttttgcactgtctggttcagtgggtgtgtgtaatgtcatgtcaactaactaaccccaccttgtacccacccgttgctgtttagtagaggtggaggcttagctcactgctcactgctcagccccactaatgtaaccctgggaggggatgttagataactgccctactaacactgctttggcagggcagccggatcacctctgcctgcttctgccagggagggtctgggagatcggcctgctgacaccatctggtggtggaatcagagcacctcctgcttcccctgggctggggatgggctggaagatcaactccccactctggccacgcggtgctgtggggctgctgccaggggcgttgtggttttcccgttgctgtttggctagagtagggcaggagtcatggagtggttttctgttgttaggtcaccctcttttcagtcccttggcgatggagaacaggcctcccatggagctgttatctacgcctcttggaaaggcccagttggaggtttcttctgcagcatgctgtccaggatacatgggagtgaggaaaacggcatactccctgtccgtcatccctcaagtcctgaggtccccagcagcctgtcctatttcccgcttcagttttcctgggcctgcttgctgtgttctctctagggttgtctgaggttctgtctcgggttttcagttgggagaggaaggacctggggagatggctcctccaccttagtggaactagagatctgcagcttcctttaggtgtttatggtggctatttgtcttagtccctttgagctgctctaatggaatacctgagactgggtggcttacaaacaacagaagtttatttctcacaattctggagggtgataagtacaagacaaaagcaggtttggtgtgcggtgagggccacttagacggcaccttcgagctgtgtcctcgagtgatagaaaatgtgagggtttctctggggtctcttttgtgagagcactaatcccattccaatggccccacctcctaacacccatcactttcaaggtcaggtttcagcgagagttttgggggcatgtaacgtttataccatagcagtatcagttggctctggctgcaaagactactctgaattgtagaagttacttcttcactcctttttactctccatgtggaataacagacttacaatgatggaaagagatttagctgtgatccaggccacctttttcagatgataaccgtaatatctattgctgtaactccactgtgtgtgactctcatggtgtgaccatagggcgtgctctgtgctgctttcgaacatcactcctgaaaatggctgggtaacccaattccgattttatatgccttaggggggacttcttactaaagattcagacttgttttatatttagagtacttgtagtaggtttagagatacacacctaattgccagttgaatgctgtacattctgatgccttgctgcttcacttactttaaaaccattaaatctgatcattggcccagtctccacacacctcatgtctgtggtcatcctgcctgtcacaggactcgctatgaaccaccacctctccctgcccatctccacctcccgcaccagaattaagttgtctccattccttctttgttagaccagcctcagtctcttggtgtattcctcatgtggtgacatttctagcctaatccacttctggtccctgctcggtcaatggctgagacttgtgctggggcatctgacctcagactgctttccttctctgcaagtctcatcacacctgtccttggagacctcacaggcttggtcctgtgctgactgtaagctctgtgccacccacatctcagaccctgcactgcaggcatagagcagaagatgtaacattcctccccacttttttttttttttttttttcaggaaatgctagcagaaacatatatgcaagggggttcatcacagcattgtttatacagccaaacgactgtccttggtcctctaatgggaggggagaatctacattattctgccctttttttggcagactggtgctgtcttcatggtgttaaaaagaataatggcataggggaaatgcctgttggcctgatgttaagttttaaaaagctgcaagattatttatgatagtctagtttaatattaaagaagttcattggcatatcaaaaatataagaatacattaaactgtcagtagtgggtattgttgtattttggttacaggtgggcttttctcccttttttctttctttctttctttcttttttttttttttttgagatagaatcttactgtcacccaggctggaatgcagtgccatgatctcagctcactgcaccctccacctcccaggttcaagtgattgtcctgcctcagccttctgagtagctgggattacaggcacccaccacgacgcctggctaatttttgtatttttagtagagacagggtttcactatgttggccaggctggtctcgaactcctgacctgaagtgatccgcctacctcggcctcccaaagtgctgagattacaggcgttgagccactgctcctggccacaggtggtcttttctgtgtgcctttgtgtatgtacacaattgtcataactagtattatgtttataatcagaacagatttaatagataatacttactaaaacttttgctctttataattttaatctttgtttttggcattcccagcagcctgtcactgggcatgcataccttgtttgtgtgattcagtgttaaccgttgtgtcttttgcattgttgaagattttgtccaggctgatcaagctttggtcccatcaggaccatcaccgaaagtactcggggtgaacattagccccctaatttactcttttggggtctgcctttttattttttgcaaagtgagtaatctctcagggaacatctccatcggacaggatcatggatggatttggtgttggcaggttgctcttggtagctgtctcccccacaggctgctcttgggtctggagcaggttttgggtcgggtcctgcctgccctccatggaacctgggcggagcagtgagtctgtctgagcttcagcttcctcagccatcaagtgaggacatagtgctcacctctgagggtcatggggagtttttccataagcaaatcgacagaaagcccctggtagaaactcgcacaggaatctttccttgcccctcaatgagccctcagccctggcaggttagtgagcatgactgtaatgaagtgctctctactgctttccgtggaaaggagctgtcgttccaggagtataggaaactcctagggaagtgaattcatctggaaatgctactataattctaatcccctgggtcccagaacaaacaagcaagcaaaaaagaacatcttttctagaaagtggcctggaggggggcgtgggaagaggaggtctgaatcacccctaacctgccagtgaaccaaacatcacctgagaagaacctcagcttcttgggtaaatcatggagagacatctggaaacctgccccaccccagcgctgtctgaattgggggtgagttggggacacctgctggagacggcccatttgatttggcagaaacttgactataattcaaaatgtgtcttgagacatgagacatagactcaagtactttttcttgcaatccaaacttacgtactttttcccaaaataagggatacattggttgctcgtggatttaacattaggagtgttcattgtgtgaatgaaatcaagacttctacaactgcgttttccttcttttccctgaggtaattaaactcctttagtgagaagacaatttagacagactgttggccattgataatcaaaattttgatatttctaagtgagtgagttatggatccttcttcttggtaaccttttttcacacactatgaggtagcggaagtaaaccgtcagtataaacaacatgtacccggtttaacccgtttgtaagaggccaggccttcgtggttttaagtatttgcttagaatgaatttgtctccccagtgtcctctgggaaaccaaaatgtgctttgtattttctcttctctgccttggaccagatccacatgattcgtgagtagagttgccaagacaggtgtggcaagaaatagccctgagacagggctgctggcacgcagctctcctcctgttctgcctttctgtgtggaccacgaggcagcagtgagggcttcccatggagcatgtctccctttcagtcacacatcttgcgctcacagtcactgccagccagttgactgcaagtgctgtgtctgtaaaccttgcagtggggacttgacattgctttcagagtgaggaaaccgaacttggggatttggacatgagtctgggctgtgcttagtgttggagccccgggttgaacttgggtctttggtactggcagactgccctctgcacagtacataatgcttggtttagtttggacttccctttcttaggagtgagatggttttgaagctaaaatttaaaaaaaaaatcatttcaagctgataagagtgtgtgtgttaaatggaaacacgttcaatataaggatttcagctatttgaaataccttggggccttttccccccaaaatatattgtattcctgggtcataacatgcttcccattccagttcctaaaacattttactattagcagtttatagaagacttacggagtggtttgatacttttttcaaagaaggcagcttaagtggatggaatctgattttctcttaggcacgtgcatctgcgaaggtgtctgaggtgagccaagctcgataacctgatttgttgagtgagttacttttctgtgggatgtgtggtggagaaaagactagaagtgtattttcttgttgatttgtctgttatttggtcccttgagaaaggcattaacctgaagtagtctatagtgaattctgaatagatacaatgttagtatatatgtgagtttacacctcatttttgctgatacttgatcataaattctactaaattagtcaaaacaacaacttaagaaaaagtttgatacatagcaggagtgcaatatttgttgatttaaagagactctcattagcgtttaatgcaatatacgagtgccaccagttccttctcttttcacttggatttcaccagggtgctcatttgaagcttagaactctgtcctcggcaaagaaagcctggcatacactgtacaaggtgttgactcatctttgtgttcctctgctcctctagtgtgaggtgtggagtaggaggttccagcaggtgacccagcccagccttggtcctcccataggcctattaacaaccctggggcaaatgccttagcctgcctggaaatctcagtgttagggccatggcccttccgcagtggtcatagcagtgtagggagttggtgcctatggggaactggcctacattgagttagaacaatccacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacactgcatattctcactcataggtgggaattgaacaatgagatcacatggacacaggaaggggaatatcacactctggggactgttgtggggtggggggaggggggagggagagcattgggagatatacctaatgctagatgacgagttagtgggtgcagcacaccagcatggcacatgtatacctatgtaactaacctgcacattgtgcacatgtaccctaaaacttaaagtatataaaaaataataataataataatcccaattcttgtgagtttttttttttttttgagacggagtttcgctcttgtcacccaggctggagtgcaatggtgccatctgagctcactgcaatctccgcctcccaggttcacgcgattctcctgcctcagcctcctgagtagctgggattacaagcaggtgccaccatgcctggtgaatttttgtatttttttagtagagacaggttttcaccatgttggccaggctggtcttgaactcctgacctcaagtgatgtgcccacctcagcctcccaaagtgctaggattacaggcgtgagccactgcacccgaccagaacaatcccaattctatctgtatcacacagtgtgtttctcatctaggatacagactcactgggcagcagccgtgtctgccctggaaagtgggggcatcagggaggaggaggaatgtgtgaacctaaacacatggaagaccttcaaaagcaccagaacacagtctttcagcacagaattctttacatccttaacttgcacttgtgctaatgaagactctacctcctgttcttttccttctgtgacaaaacaagttatctgtctgggaagacatggcacaatttatttatacaacatttttatggcttgcagatgactccgctggatcctccctcagaattgcccttcatagggaagttcagtggccactcaagtggttagcaaaatcaaggtgaaaagtttttctttttattcaaaatgggataaaaagaagcagctgccttttgtgacttttaagtgagaagctttcattatgtcttagccctacagtgtgttatcaataatcatatctgtgttaaattgtacttcactttgtatatcaccattgtaagttttaaccgtatacattataggctttttccatttttattttaaaaactgtttaaggtgtagctttttaaggattctgtttttgctcttattttttacctgtgtcttggtctttcttatcatggaggtgaaaacagtaatactgaagaccttaatgtgagtttaggagaaaagatgttaatcaccagtttcctgctactggttttaaatttcatagaggaagccacacttattttgtcatcagaaattcttatattttttgtttaaattctcatctccctcccctcttgcccagatctggttttttggctagaaacaacttacagtaacttcaaattaagcattttaattctaaggaatggtcttaagtgaaccaatgtatatagagttttatctttacttttaaaaggtctctaaagcatttttcttcttatggggaaataaattgggtagtttacctcgtcagtagaaaaaatatagggatttgtgtctttgcactaaagtaatttcagggttggtcttcttttagctgtccttagttttgggattatttttgtttttcagaataaaatggcacaggtcagatacttttaatcccctgaaagtaatctaaagctatagaaatggagctgtggctgtcgcagagacttactaggatgaaggttggtgtagaaaaactaaggagtagtagcagtattcagtgtcccgtgtctttccccagaagaacactggcagaacaccaggggcagaacactgtcacacactattcagagcagcgatttcaggagcacaccaaggcgggccaggtggtcaaggggcttcccaggggatgtcatacaaggcacatggaaagaactggtttaggaccaggtttggcacaggttcactgacaaaaagtggggtgatgattgagagggatcatagatttcctttatagtcccaggggcagaatcaagattgaagtggggcttagaagggaacatttcaattccctacgaggaatagcatcgtagcactcagtgttcttcagcgaggacagcagtgccttaggaaatgtgcatctgtcccaggaagcgggcacacaggctgggagtcttagagggctcctgctcaggtctcccacatggtgcaagatgctgggcttctgtcgtgactcagctggggatgtccttgagtatagggatcacagctcagtctgggtttgctcctggcttgtccccagctgctagtaaatatgttaatatgtgtgtcggggacagctctggtgacatggataattagtttttctgatgttgaatgagaaatgagtaaaaaggcataacacattaatcttaatgtctttagacttgtatttttattataagggacagataatagtgaatgagggaaaaaatctcatgaacactagtttccagacttctgtccaacttcacagccttggtttactggcagtttccaaatggtcaggctggaaattgatgaaagctgtttcttttgaccatggctccataaaggcaatgggcagtgcacgttgaaagagtaagtatgaaaacactggcctcatctcataaactttattattgatagtattttatcctagcagctgtttttgaagcactgtcttgaattcatgtgactgcccaggcttttgacacaaatgtgttccagggagacagattgaggaatctttgagtactaatgctgtcatcgtatttctcatagcttttgttttcatccagtggctcagcggaattgattgggattgccaaaaaataaaatgatacaagtgagaaatagacctggagggaggtgtgtgtgtgtgttgttggttacttgcttattttatttctgagaaccgtcagagttgaggatttcaaacatgattctgatagcatttaccgcaaacgctgatggcagttgctctcctttgccttatagctaactgggactagaaacagctccatcacccaggtgagttttataaggaaacataagggggctggtctgttgcttccctcctcttgtaagctttggataactctgaatttagaaagatatttctgaagatatttaaagaaggagacttacagagttgaataaacatcctggaatttttctttctctaaatgaatgtcagcttcagagagcccacctgcagacagaggcagtgactcccctaaacattttcggagtatctcttggaattggtttaaagctggtttcagagtccacaaagaaatggccctttacaggatcctttattgcttttggtggttaaagcagaatctctctggagagtaaaggtagacagccctgcaatgtctgaaggacaggccttctttctcctcacacccctgcagtccctggctgtgcctggctgtttcccgcaagtgccagacagaatgtgcactttttggctaagtatgttctattatgtgtgtaaaatcctctctcagttctgagttgaatatcgattcaaagcttaattcacgctgatgacttgaaaatctaatcttgattctactcgagtgtttgtagatatctgaacatctgaaaacagtacagagtgcagcgttcctgtgaattttaatttggtttctggtactacacttgaaattccagtaatgataagatgggaactaaaacagcagctgcccctcggaaatgagggtcgcaccacctcgttcccagactgaggctgcagttgagaatgcttgtgtgtgacatgcccctgccacccagtacacacacctgagtcattagatgtcactttatggcatcgtcacagagaacaactgggttttggagagagaatgtcatgatgtgacttcatttccttggagcactgggatagaggctcttgggttagaagctcttggacattaaagagaaatcagaaggtttagcctgactgatactgagctcattatagattgacaatctctctttttttaaaaaaaaaagtttcctgccgtggctgctgctacagaaagtcctttgtgaaagccccagcctgatttcactatcaaccacttaaccacggtattaatttttcagttgttgaacttttaagattttaaattacttaagactttaaaaatagtctgttgctgagccagaatagtttgttaagaaacatgcatctttgagtagaactaaagtcccttggtgttggaaaatgccctccacactcctccaaaaatggattaagaatacttcatggtattttcccataggtagtaatgttaccagtaagttccgggcttcaaaaaatgatttctaagaagtttgaagattcagtggacacacttttggcaaaaattgcttatatctgacatattgcattataaaagttttgattagtggctttcttttttttttttttttttttgtaacaagtaaagagaaagaaaacatggatctgcctaggaagtcacctctgcctgagtctgctacttgcaggattggagcttttgctgcagattacagctttgaagtcactttacctcaagagcagtttatattttattgtgctttaaaaaaaaaatttagtgccaggtttatggagtgaagtgctttcataaatgctgaaactacattttctgtgggtaaaaatgcagctcatcagaatttcccctttgaagaattttttatgttcacataaaattgccaagttaaaaatttgatctccctacagagtaagagctttcatttcaaataaaaccattttatagaccaggtatcaacatttacggcggtcagacacattgcagatagcaaaataaaatatttatgcttggttcttacttttcttataaactagaaatgtcaacctaagttatctttttgatagctcgagtatgttaggataggaggaattgggttgagtatccaggtaagattacaggagtgagggtggagcagcgtgtgtttggagatttctgtatgccaaaccccacgggctccaggcacgcttttggaagaccataccggtggatccctttgtcatcgtggtggcaaagcaaactgatgctaaaggaaataacaaaacttaattctcgtgctgatcggtgccactgtggggcttacagaccccattcatttgttctggttgatttcatgtggtgtgagactcactaacattgaattagtgatgaagttaaagagaggctttctctatccccatagaagatattttgtcacttaagaaataattgaactttatgttgcactgtactaacagattaaaactacccttttaaaatacaggaataaataagagttaaaataagagtttttatcatatagtctttatagccatgtactactgtgtgcatactagctaggtcttattgcaggatgagtgtttgccattacttttaggtttataaattcaggaaataactgtatttgcatctcaaaaaaacaaactggtttttaaaaaaatagtgataggtgctagttagagtagcccttacagatcagtcttttttgcaaaatgtaatttatagtatctatttccataataactttttaaaactacacctaagtacagttgatagctcttactaatgtagttattgccaattccagtataagcctagtctctaaaccattatctttgcttaatacaactctcctaactctgaaatgctaaagacacatctcagggctccagagcattgccatggtttcttgccttttgcccaccagggtctggttgggaaaccgtctgcaccagagttgcttagggacttgaaagagtacagcctcctgtatctctctctctctctctctcacacacacacacacacacacacacacacacacacacacccgccatttctccctgccagagcttagggatgtgtttatatccatgaatttatttaggctaattaatgttaactactgaacttttctttttgtacaagaaacaggccattcgtttatttgcttctgccaaagccagcagggcatttatctcttaagatgagtaagttgaaattggctaatttgttaaaagctcctacctgctggctaggttgaatgcattcactaagtgctagttttgataggttggcttctgacagagactgccccttgatagtatttggtggtatttgcaattgccagcccaagcacgagccatgtggaagcttctaaaccacagacacaagtcaaagtgttaaagagaatccagtggacttaatttacgagttaggggaaattgacagggggaattatttttgttttgtcttataaaaagtataaaatatgtctccttgtcccaaagaaatttagcagttagttgaaatcaagtggttaatctacaagaaggtaagccccgtgggagcagggcatggcctcctttgttgctatacccagagcacctcctagaacaatgtcaggcatgtgagtgtttgtgtttgttgagtggatttgtgaatatcattgatgtattaagtattgggtaacttggcctgcaatttttaccagtctgccaactttataaaacatcaatctgtagttcacagatgtccttttgataattggtgttttcttcacttctgactccggggctgaaggcagttttctctctcagtcatgtgtagtgagaaacaggtggagcttgaagctcaggagaggtgggtgatggtgtcttgctggctggacgttcacttgtgcatatgggtaggcacacctcctttaggaggactgcatgagacccttgtgcagtgggtgcccaaacaaaacacacttttcttcttcccctaagggcgaactaacttgttaaaagcttctaaatcagggaaagaacacttaaaaagagtagctctttaaggggcagtaagcccaggaaaaggaactatgacatcagcatcacctcatatcacatctacccagaaattttgttttctcccagtttagttcaaaaattaattttaagactttttacagatttgttagaaatatttgtgtgacacaggtacaatcaaagtaaattttgtatgattggatgtattcagaggccatgcctgacatcctgaaagtttccccttcatcagcctttgtgcttctccaccagggcttcctacagcagttcctccctctggtttattcacagactgcagataactctggaggggatcggtgtgtgtccctcttaccccactgccacccccacaggggtggtgtgatattctgcctctcctaggccctcagtctttgtgggattattgttaaattcacttgggtataagatgaggcaagagattgtagaggaattggcaaaaactcttcaaagtgttcacttttaagtgtttttatagagctctgaatcagtatcagttttactggccttttacaaaaataaagacaggaagttatgttccttcgtatggcaaaatcctattatcgtaggtttttacctattttgttctggtgaaaacgtaatatgtgtgtttaattgtgagtacggtgtgcccatttttacagtaagttaacgtaagtcacacgtgaatagcggtggaaatccaagaattttatctcatttcctgtacacgttactgaactgttcacctctgagtgtaatgctttcctggtggcacatggagaatataatcttcctaatgcataatgggatcttttgacaactcacatttttgttctccttcatttttggctgtcacatggcttttaatggtttcattagtaaacagatgaatgtactgggtgtgaatgttagtgacagcttaatgaaagggcagtcctccctctttcttctcctttcaaaaatgcctttgctcttagacccaaaaacatgttttctctccatgtggtgtttgcagacttgagctcatcttgattggctgcattaatattgagacaaaacatgcaattatgctttcatttggccctggggtagccattctgaagacagctgtctgtatcattgtacctgctttcatagaaaccaacttattcaggtttctcagggtttcgcttattttgctttgaatgggacagccatttcacctcatatttttggatgatgtttgaaagttatataggaatatttgccttgtaataagatcagaatgattattttactgaaaaactaaattgttatgttataattatgtttcaagcatatttctttggcagtattttccattttcttgtgagtaacttctggaaatggaagtgtgtatgaatgggttggaatgttttcagttcttgcaattctgaatctccagttttaaaaaaggaaattttattctatatctcttattctttaaccagagttatgtagaagactctgccactctaatctttagtacatggctgtagttgttgaagtcagggagctcccagaaatgtgaaagagtgtgtgagatgggcttgcctctagagacttatctttggaactttcccagtgatctgtggaccacaatgtgatttttgttttgttttgttctgatgcagcttccatgaggcaggctgaacctgcagatatgcgcccagagatatggatcgcccaagagttgcggcgtatcggagacgagtttaacgcttactatgcaaggagggtaatgatgttttctttacccgcttttctgctcacaccctccccttccacactatatttttttaaaaagacagtgacttcttgtaactacatgctaattctggaaatgattactgttgcctagttgtgacctttcattgtttctcctttcccatttttcatttgttttatgactaagtaatggcacttaaataaaataatacagtaggaggcagcaaaggaattttatgagcacagactttaaaacaatgctaaaaaagggattatttatagactttgagatagtctagaaatactattaacataggtttcaatccatgtagtgtgtttctgtactccccttgtgcattttaggtcaaagttaaaggtaatttttaaacaacatcttttgtcacttagcgcatgggagcgatgccagcactcatgtaaaagactctcctgcaatttgcagggtggcccgaggaagcagggagccattgcccttgcagagcccattgctgtctttggacatttaattgttgaaatgtattaggaggccgctaatcaatagcctgtaatttgggctgtaaaaactttatattatagataattgccacttattttgagctatgttcttgattttttaaaaattttagcctatgtcatcttctgtagttagtagaagcggtgttttttgtttgttttacctgggggcaatgtaggtgaccatttggacacctttttcacatgggacacttttgtttgtttgtttgtttgtttgtttgtgtgtttgtttttgagacggagtcttgctctgtcaccaggctgaagtgcagtggcgcaatcccagctcactgcaacctccgcctcccaggttcaagtgattctcctgcctcagcctcttgagtagctgggattacaggcgcctgcaaccacacccagctagttttgtatttttagttgagatggggtttcaccatattgtccaggatgatctcgatttcctgactctgtgatctgcctgcctcggcctcccaaagtgctgggattacaggtgtgagcctctgcgcctggccgcatgggagacatttttaaatgtgtagactttgactccaggagttagtaccattgggaacacctgtgactgcttccgctaaagggtacactagcaaatgtgtgatatagtgtatttacttgttcacagagttttaaacacctcatataaaggtattaattcagttgatttatccaaaaggaagacactaattcttattttgtggaaaatgttatagttgttaatatcatttattcttaccccttctcttttagctcttttttttctgaacgttgttgttttatataagtacctcttaaaagtttttttttaatctgttttctaggggaggtcatgcttggttaattgttgctaagtaaatggattttacctttgattattatttttctgcctttatacaatgtgttttaggcttcttttagacaaatagacattttcccattacaaaggacactatcagttcttcagtatggaatttctgtaagagtcaagaaaacacacatcggatcttcctacctttctgtgggggtgtttgaggagagtgctgtagtaatgattctgttgtaaaatgggaagtgtgacattgatggacttaagaatttcttaaaatactgtcttaagctggcaaaactcctggcatcctccacctgacataaaccagttcacagaacattccagcctagatctgaaatggtaatttttttggaactttggttggttttataacttgtcactgaagtaaccattccctccagttcctctgccttggtttacctaaagggattttggtgttcctgtgtgtgactggaagtggctgtctctattgactaggaagaactggtgagaagtgggaccacagtgtattcaggatcaaagtggggaggacatgagtccctttaagagggtaggtgaatacactcaagtcccgattctggtattgtgtccagaatccaacaggacagatcatttctgatgggtatggagacatctctgaacctaggcaatgaactgaccatcccctgggcctgtctccttcccgtctggaaggggctttgtagacaccctcggggcaagatctgccttagatggggctgcctgagagaaagaggtggcagtaggccttgcctggtgcccacagtgtctccctgctgccaagagctctgggtactgagataagcttgcacattctcaaggattctgttagagattttgaccgcagagctggttgtgttaaaggatattatacaagtttctctttaaagcatgcaatatgaatgcatgactccacaaggctttcctgtgggcctgcccagatggacctggtggatgcacctccatggctgccatgagtggtcagtgacaagacataggctaaggctggcatggggactggagtgcatcccagtccccggccatcctcttgtgaaggctgtcaaggtggggaatagtttgagtcatatgcagatgaaacctaggctgctgggttgtctttgttaccttgcctctctgttgaggatgtgatagcagcacctaacaggttcatagcctgcctcccctcctcttctcccaatgtcatttcacagtttaatgtttaagcgtatgtttaagatggtcatgtctgtgtttccaataagatgcaacctattgttcccatgcttttggtaaattaaatttgtctgattgcagtatttacaaggttttgtcattgtgcatcttttgcatatcttaaaaataattcagtgcaaaaatacagtcacaaatcattaaaggactttagctttgttagtaggctgggatattagggggaaggagtagggatagattctaggttataacccaatttttctaaaacaaaggtaaatatattcagattttataaatagcgcaaaacacaaggctgggtacggtggctcacacctgtaatcccagcactttgggaggctgaggcgggtggatcaccagaggtcacgagtttaagaccagcctggctaagatggtgaagccccgtctctactaaaagtacaaaaaattagctgggtgtggtggtgggtgcctgtaatcccagctactcgggaggctgaggcaggagaattgcttgaacctggaaggcgcaggttgcagtgaactgagattgcaccattgcactctagcctccacaagagcgaaactccatctaaaaaaaaaaatagttcaaaacactggatgatgctgtggatagtgacaccgtgatcttcaaagccacagacacccgtcttgatacttgttagattaaaaacagtccattgtctggaatcacacttaatggtccattgttaaatattgggggcagaaatctgggaaggtaatgggaggccgttttgggaaataatgaattcaaattacctgctgtcttcacaagggaattatcctctcttggcaagcgagtgtatctcactgtgctgctttaggatggatattaaccttttaaatgttgagtgtctttatttgcttaatgctattacaatgccttgtctaaagtgttagtcttttattgccacgagccttgcaaagcctgacaggatattttcccgtttttccagttagagaaatagaggaagttgtcgtgtagttgtcatgtattcagtccacttaagggcagtggggaagcgtttgagacggagctgtggaggctgaatccttgaaggaggaggtgagagaggcacaggtgagcgcaaagtcccagtgcatgtcccctcttctctcccgatgcagtgtcattcccaggtgaacctgccgggctgaacggcctggcccctctattcagtcggagttttactactccagtggattttggtaacttcatttggaaataatttcagacttacaaaaatgttgcaagaatgacacaaagaaccacccttttatatctgccccacttgttttcatgttttccctctttgcacacatgtacaatttatttcagaaaaaactacagacatgatactgcttttcctacactaaaaatacttcagtgtatatttcccaaaaataggagtaatcccttatgtaaccacagtgtaattatcaaaattcacaaatagtgttacaaaactattatctgatctatggaccttattcagattttaccacttgtcccaacaatgcccttctcagaaaaaaaaaaaaaaaagaaaaaatgtattttctggcctaagagccaatgtaggataatgcattgaattcacgtgttttacctctggttccgttaatttggaaccgttcctctgtctttgtcttttatgacagtgacatttttgaaggatcagggcagttgtaatttgcagactccctgagtttgatttatctgatatttctgcatgatgagactcaggttttgcatttctgatgggagcactccagaggtgatgtgtcagtgtggcacagcaggaagcacatgatgtccatttgtcctgttactgatgaggttcactttgatccaaggtggatcttggatcaaagatcttccacagtcttccactgtgaagttagtacttttccatttgtaataggacagagattataaaggacaaagagctttcctttctctcttatatagttatttagtataacaacttggattcatagattcctgttttattcaatgggctgcaatgcgttactgtcaatatttattttgatgctcagattcttaatgatttggcgggaggcaccagtagtgcaggcacagggagaaccagttgtgggacaaagcccaggggctgtgaaggtcacggagctcttaaaagtcatttgttgcggaatgaactttggccagagggctactgaccctcacagctcttcctatgcaggtctgctgtgcagggcactcttaaaagactccaagcttgtgagactccttagtggcgagtagggaggctattggtaaaggctaggtagcgtaaggatgttagtaggcatggagggaagagaagttctctgagaaactaaatattttggaatttgtgagaaagtgagcagcttgcctttacctgagtggtgcagtgtttgtatttctgcagcctgcaccttctcttcctggtgagtgtgtcagcccaagacagccagactgttcttcagtagcggttgccagtttctttcatcacccaaactgtgtgagcgcatgtaccggttcatctgctggacgcagtgccagcaagtgtagattgcgaccctctgtagatgtgggccggaggtactggaaggatagtgtctacttgggtgggagtcttgaccatgggctggggctgcagtcagaagcccttagaatgtaaaaatgcttactcttggaataactggacccattctgcaaccaacatgcctccctctttcccctccataacccctaatactgaagctggagttgtttaccttctgtggcttctaggttcttcacagtcaggttgtccagctcaagtcactccatgtgcaggaacactgctcttggctaactgtgacctgggcatgtcctggtggtgggctgcagtggacagcagcacatgaagctgctctccagatgaggccagcagtgaataaaaaccctttcattgtttgatcacaagaaacagtgatcttttgtttacactgcctacttcctactctgtccagggcatgtgcagacaggaattgattgaagtgcatgtagaccaaaatctagccctgaatgagacaaagtagagttgagaaggtgacttgcagactgattttgatggaaagaatttaacgtgtcattacattagcattttcctgtgctctgtatgaatttgaaatacttatatgctctccttcttgagaagtgaaatccccagtgctatctcattcttgtttttataaatggtagtcactcttctgtgaataatgtacaaaggcaaggactaaagtttagcctgcttggtaattgcacaaactgaacacaaacccaaacgtgtgttctcagcgtactttggaggtcttcattaattgaatgttggagtttagtaaaagaagttgctttctgttactggctgtgaaaagagtcgtggaaatctgcacatcagatattaaattcaaattagacctaactcatgcaatgataggttgccccacacttcactcacatgagttgatagaatgtcagttttcataacaaaagcagtcatgaggagcttagataaattggtacctgccattgatcagtggcacggttttcattcaggttcagcaagagttttccttaaagctggaggaggcagctcagtgtttgggtttaggagcctttctttcctgtcttagactaccccgtttccgtcccagaagtacaatggccagaggtgatgagctccttggttcttcccctcagacttttgggagaacatgtggctgggattatgtggactatggattgctggttttccaaacaagcgcgttctgttactcgttgaagccagagtgtgatctcgtaggaaaacacgactcacagagaagtgtggggactttggggtcagacctagagccctgactctacccttaacctttaggaggccaattgtctggtctatcccttaggcatgtagtggagattaagtaagaacatttagagatggagctagaaaattcttattatcatctgttatcgtaattctgtttcctctcactttgaactgtaattgaaacatttttcaatgggtcttcggcgtttagaaagggagatgccaggaactctgttcacctgtctatcttttaaatactctggaactgctttttaaacaagttgtgtgtttgaccctactgcacatgctgtgtctgggtgtaggcaaatatgagatgaggctgaggcactggtgtgtgtttaaatggctggatgggcatcgggctaaaggacttgtgcttgtttgcaccacgtgtgagtgctcatctgtttggcaggtgcctacacctgcagggctgccttgcagctctggatcaaggccattaacacataaccatgaggaaggagatgcaggtgcctggaaggggacttcaggaggtctaactggggttttttttaaatctcttgaggaggaaatgaagatgcacacaaactaaggcttggccctgctgcagacgttcaaaaataataagcttctcatatcatccttcactagacttctaccacctgaaacaaagtggagaggttttagttgtggttaaactatgttacgtctcacttagcttttttctgaggctgaaacattttggaacagtgtgtttcttctctgaatctaatattccaactactggtgcctcacacagatgtcagaacaatctgtctcttctctgtggttggccatagaacagtgacgatttcagaagtggcaggtgggagttgttccccagtttagccagcaccaggtctggagtctgacaggctagagacctaccaagtggagggctgtgctgtgctgcctgaagagcctcagtgcacagcctcacctggacattcactggagaagagatttgtgtcacaataagccttaactatcataatttctttgaaatagtgtgtcaaaaataggataaaagtttggtttatgcaaatgtagtttttatctgacttctgaagaccacattgtcaccatagcagatcagctgcagcacccatagctttgcaacgctaggggagagtgctctcctggtttggggtgaaggtaccatgcatctgggagggaacttcctagtgccctttccccagctgtggtgacatcaaagtgcagcaggcacaagctatgcaaatatccatgttgccttggtgatgaatagaaagtggatttggtgttgggcagtattgtagcaatctcctctgacacctgaaaacagcatgcatatggaaccagtgctgaaataccagctcagctgccgtttgactgtggttgttggtctgaaagtggagagagaccagatcttcctgaagagctccacatcatgctcaactgtgtgctgggcctttttctctctgacttctgtgtcacttagttgccagttaaaatgctgtttagactgctgggttatgaacgagtcgtggagtggtagttctaacagaatcaggggggtgactcctagttccatgtcccaccctgccacctcagtgtccctaaagatgccgtgacagcccctgggtattctcaggctcctggatgtccatcccaggccctctcttctgcagcctgtggggatcagacaccaaccagagagactgcttcctcagttgcctgagcctggagcagagattccctctgtccttcctggtctcacagtccaaaattcagcctcctattatatataatgtataataatttatagtatatatataaacacttaaatatatataaaaaataagtttcaggacatcctatacatttactgttgaaattctgtaagaaacaagtttttgagtaagttaaattcctctgcatctcagagttctataggtataccttgtttttgaatgcctcttagaattaggaattgagcttgctttgatatgacaatgaaattgtcgtttttccctcgttgctctgactgccaggaaactcttaactaaactgtggctctcttacagcacatctcacccctggttcccaggataactccttgatgtcatgtctgatctcaacctttttttttaaattgtgttacacacatttgcgctttcttaatttaagtcccctttgagccatgctatgtctaggtctgtgttgtacttaccgagtcctttggcccagtgggtgtcagccctgcctttggagcatggatgagtgggctgtattctgagctgcattgtaggaatcacttagtgattctcaattcgcactccagaacctctgtggcctcagctcagcctgaaacaaggcccctttcaggtctgaggagcaacgggcccttcccagcagaggcacaggcacaggcacagggtgtgcgaggagggaaggtgctggcctgaaagccctcgtttaacttctttcctgcttctggcattccatcttcatgtgggccaagagtacccatcctgtcctgccactgtcttcagctgcactttgagtcacttgcttgacctctgtagtcactggctgcaaaacagcatagggaatgctaccctggcactcagggttgttgtggggactgaaaagcatgggctaggttatttcatttagtggtggccatggcaattcttccatccccaagcttgggcacacaaagtccaaaggcctggagtgccctaggcagcttttcaaaggttcgactcctctcactgttggagagtgaagctgaatccaaagctgcattctatagttgtctgctgttcaacctgaccagttccctggggccagggcctctattgttttccaagcatctgcttccctggactgagcaagagagtggtgttctgtgattattttggcattagaatgtcattaaattccctgacacttaattggtcgtcccaagtgtaaattgaagatgcttctgccctgcacttaatgttcctcgctgcagtggcagctccagcccctggcaaggcagcaggaaccccacgctagggcattcctgtggtacagctcctcccaggttgccacccagatgagcttgtgccatctggtgtcatggggacatgtgaagaactatttaggaattccctgttgaatgctcgacaccgtctcaaagggcattgttcatatcttcagagaaagactgcttaagtctatgctgaggaacttgtagacacataatcctatgcctttacacttagagggcacagtctgtgggggagcaatcctgcaacttggcataatctttccttctggtttatgataaatacttatccactactgagattatctttactgaactgctggccccttctgcctgttggccttgctgcctctgcccagcttctctctccacctgcactgcccattctcctcttgtccttccaagaaattctcctcttcctttggggcttgatgtggggattcaccctggtgccttcctgccctggctcccccacttcctctctggccagtggtttttttccctctcattttatttgcctctgtattgtccttactttattatcttgtttactgttttgtgctggcgacacagctattaccatcagacctagtgggtacacagacacgtgccttgaagtcaggccccccacctgatgctggtcagcaacagggccactggagccccttaccctgagaggggcaggggctgtcaggaactggttcctggagggacacacaaggttgtgaatgttgaaggagtcatcttctggacacatgggatggccacaaaaggcagttacctccaggtaacccagtcctcatatagctcttgatttaggctatggagattacagtacccaactgggtggggccctcctctttgtgcacttgtgattgtgtgtatgtgtgtctgcgtagagaaagtgagagaggagagaactgtagtatatggtcacttcagttgtaacttactagcaaatttggtctttaaaaataatctccttcacccaaatgagttgttatacctttctaaagtatttttgcaatttagactaaaacagagttacccaactctgtaagaaggattgttttcacttaaagagtgacagactgagagcatcagtgaaagtgtgtattagtcagctagggctgctgtgcagagttccagagactgggtggctcacacaacaggaatttatttttcttagttctggaggccggaagtctgtgatcatggtgcagacttagcctccagacctgtagatgctgtcatcccctgtgtcttcacgtggtctccctccgtgggtttctgtgtcctgattgtctcttaccagaacaccgtggattagagcccaccccacagtgacctcattttaacttaatcaccttattgatgaccctgtctccacttacagtcacagcctgaggtccggggggttaggactgcaacagatgaattgaggggacacagtgtacagttcagcccataaagaggaagatacccagaagtttcaggagggagtggagcatcttccctgattgtatttattttaatagttttttaaaaaacgcttgtaatcaggaaagacagtctgtcttttttatattacccagtttgggagtggcagaacttaaatgcacttttgattcacagatgcctcttccacctgattaagaaccactgtagcagacgcagacttattggacactaggcgggaggccagctctgcagacagcaggtctcaggaagacggtcaaggcatggctgctgatgatccgcttatgggtgtgtttattgtcttagcccatgttagatgcgaggaaccactcacactgcaaatgacagctcctggctcagtcttagtgtcatacttgcctttaactggcaactcccctgcaatacagggattgtcatctttagtcctgactttccaattccatcttggatgtgctaccctggccagaagccactgggtgtgcccttactttgacctttcaccagtacattccatcttagggggctttctctaattgcttcagactccctcctgaccctttataccaccccaaaaccaaaggccctggtttaggagctgaattgtagcagccgttcctcagtatctagatcgcagggagatttcactggagctggctgaagctgttggcgctttgagcagcgttgagccatcagtcctagttctgcgtctttgccccactgcagcttttggccacttgccccagtttagtgtcaccaggccccgactataagccacagtaatttttatggctgcaggtattagagggcagccagtctacagaggtaggggctgcccatcctccagctgtcttttgcaatacgggcatacacttcgagccaacagcagctccagccggccgtgccagctgtcaaatgctttctgggctggcacggctctttgaatccgtggtaatggcttcctctgttgaatgtcgtccaaaagcaattgcttgtcagcttaaaagcgtgtgccatgttgtcatgcccgccgtctgagagggcaggcatccccgcacacttgcagactgggatgctgtagcatcttctcatgagtcagggattgggtgtaacttttgccaaaatttcctgcattttccccaccctctccaacatgtctttgaataccccatatcctttacatttgagatgaaagtggaactctaaaaaccttggaaagattctcttgtgaggtgacttctacttaagcttggtcacagcctcctgctgtcctcaaagagtgggcaggagatttcttcccttggacgctgccagtgctggaatatgaaacttaccaagtgtcagcagttggggtctgtccttcacgttgacccagccccctcattggtgtcctgatgattgtggacacccagtcagccccattttctggccacaccaagcatggcaatgacaccaggttggcacaaaacaactctgcctggattgattacttagcccatcatagcgtacactttcttcattttagtaagttgtggttttattttgaataagtctctttcaacctattaatattagtctacactaaaattaaccttcccctaaattattctcacacagaggcagcaaagtaattttgaaagttaaatcaaaacaaagcaatcttgtgtgtaaaacagataaaaatcacagactgtggttacagagtgcctctacaggaatcgcttacataaagctgatttcctccaatcttgttatggaaggaaaaggggaaatgccctggccttatcacaatcccattctgtcaaacaagcgcggcagagcttgtgtaaacagtggagctgcagctgcggctggtgtctgtgggggccattcggggtctgaggggacagttgtctcagcctgatgcatggcaggtggttcccgcgacggtgtgttggaggtatcccccacccaatgagaagggggtttgtggagagacagtcatgtagcccggtctcgtgtggattagtcattaagaaatgtccagggcagatttcagacttgaacagtgaaccaggttgtagctcatggcgtcgaggttgaggtgttgtgttgccgctgcctttggtgactgtgaatttataccttgcacatactcacaaaatggattagaacctgaaagtgggcgctgtggaagacctgaggaccctgaaagcattggataagctggtgatttccttttgaacagtttctcagtttgtaacaaacatatgctggtcactgacacagagacttttttatgttctggattgctctttccttcccataccgagaaggtgggaggatgggggttgacattgcctgtgtctgtgaccatgggcacccctctgggtcacggtgtttatcatagccaagcagccagaggcacaatggcgcatcactgcgagactttatttagcttcttagggcagattactccaaatcactggtttttcaaataaattacagctaccagaaattcacccctgggggaatctgcagcatatttgaatgtcagttaacttgggtggtaagatagttgctttacatcctctttgagtttttcaaacatttttttgagtgctttttttttttttttttttttcctattttaaggagtaaatcattggtatgcctgccctttttgtagggatgtcttcccctttgcagggaaatgaaaacaagttttcttcacaatctctgggaggcatcgtgctttgtgacacagtgctcttgaagaggtgcctttcatggtgattaagatgggattggttgttcacttaaatatgggctcccacccctccccacccccaaattagggagaaactaagaagctttccttttgttgtttcaggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagca

SEQ ID NO: 17177 - DNA, 15593 bp, Human
tacaccattttgggaagggagaggcaccaccatcatcacaccttgcagcatctctggagaagaattcgacttcaaagttgtagcagaaaaaggaatcagcagcttcaagtggtttttggaattggggagggcagtgaattaggcacacatgaaatataaggggaaaaagtcagaaggcaatgctcttaacctcctccttctctaacactggtgcaaaggggagtgaggcctgagctttaggcttggctctgcccctaaactggctggtggcttcgggtaagtcagtgaacctctctgggcctcagtttctccatctgacaaatgggccaagagactcaaatctgctgacttcacaggtttgttgggtgagcaaatgagatagagtgatagaatgagtaactgccatgtcaagggtggaagggattgttataattattgctaaagagtgtggtagcggtgagttgggtctgctgcacccagcagtcgctttttgtctgtacatttccttttattgaggtataatttacacagagtgaagtgcataggtcccaagtcttaggattctgcctcctggagcaatgacaatcctttaactccatttccacttctgtccccctcttgcccctcacatggggcaggcagatcaagaacgaccattcccactgcaccatggcaagctgaggctcagagaggttaagtcaccagctccaggtcacacagccagttaggagcagaagtggctttgaacctggatctctcaggtagccaagcccatgctctttctgctctatctcatgaactacttgacccaaatgcaaagaaggggatcgttcctgctgatgttactttgtttagaaggctttatctttgccttctctgtgctgggcctgatgcagagttgaatccactggctgacaggtgaggtgggccaagcagggacccacagggggaagagatgggcagggagaagccacctacatcaagctacactgagacagcagcatggctgagagccgggcctggggctctatcctggcaataacacttcttagctgtgtaacttcagacaagttattttacctctctgttctttaacagtagctgctttaaaaagttgtcaagaggattaactgagaaacctcatctaactcctttgctccttgaatcaaccctaggaggcgctattaccatccctagtttccagatgagcaatctgagacatgagaggtgaagtcacttgcccatggtcacacaggtggtttgctggtatagcaaacccaggtaacctggctcccaagtctgtgctcttaaccatggtctccactgccctgcccatactaacagtgaaggtacatgttagccctaattatgaccttgaaagattctacaaggcagagagttagtgagaggaaaggattctgggcagatggccctgcatgtgtgatggcctggaggccttcgaggagaatccaggggtagctggagagcagggcgtgtgcggagagcagggcacagtgaggctggggaaggggaagtgaatttaatgagaaacttggggttgtgagtgggggaaggatttgggtgtgggatgaaggtgcaggacagggctgggccgggccattggactcaggtatgcctaggcttggggtggagcttcaaggcagcgcgggctccagcccctggaagagccaccccccacccacctgagatttcccaaattccagctgccgctctagttgcttctgcaagcaaaggagcccttgtggtcagaggggcctctgaagcctgggccaggctctcccgccctctcagggcacacacacctccattcagcccaagccccgccctttgggggggctgggggccagggcgggctgcccccacgtcagtcgtcagttgggggccacctgacccaaaggctgggcgggcagtggggttgataagacctggaccccactggtcccacaaccgtgccggctgctgcccgtgctgccagaactatgagggtcctctctggcactagcctcatgctctgcagcctgctgctgctgctccaggccctgtgcagccctggcctcgccccccagtccagaggtgagggggcttgcgtgagatgggggctactgagctagtgggccctgaccctcagcactgggggctgggtaccgatatggcagggagcacacgggatccaggatggggaagggagcagggcggcagtggtgggcagtgggctggtgcaggagcagacagggaccatggtgcttataagggtcagggcaggggtgctcctcagccctcagggaccatgcatgaggcagggaccttggtcttccaggtctctggggagcagaagctactcagagagctggctgacgtctggagctgcaccaagcccagggctgagcccatggctctttgatgacagcagacctgggatgccaagagctcatgccccctttgcaggtccttccagccttgggctccctgggggcaataacaccccccagagtttcaggtttgggcactgagtcctggaatgcccattcttcctgtacagatggggaaactgaggtcagtgagggcctaagaccacacagtgagatagcgccagagcctctaggttattgatctactgctgtacggtgtggccaattccctttccctctttgggtctcagtttacccatttgtagccttagcgagtagacagcagggagcctgctgcatggtgatttctaaggtctcctgaggaactctgatgtccagagccccagtctagggcactgtgagttactgtgacttgggggttgggacggccctgcacgtttcccctttcctctttgggattggctctgctcagttcagactccgcatgggatggggagggaagggcctttgtagtgagaccttcctgactgcaggcccaggccagtgacagtagccttattctctccactggacatgtgagatcacggaggctcagaaaggtgcaatgatctgcccagggccccacagagtggctgagccaggatttgaacccaggcctgaactcactctgaccctgcatacttcccagcacagggtgctgccttcttgggtctctggaggacattgctcctcgggggtgtgtcttggtgtgcacctgatcaggctgccgaggtggccaccaggaattcctgctccttttccctgtctttggcaacccgccagcaggcgctgccaggctgagggaaactggttccactttggtgatttgctttgatgctcagatgaaagaggccatgttgacgggcactgctttggctctcaagcctgtgcccatgcctggagggcccatccttggtgccctcctgcccagctagaagaaatagctgcccttgtttctggcagcaagtctgggctgaaacctaaatgtgttttcaaggccgcagggtcctttgccacccctggaatactcattgcttgcctggccccctgctggctcctcaaaacatcctgtaaggagggattgctagctcactgctcagatgaggaaactgaggctcagagaagtgaagcaaatggcccaaggccaggcttggccctctgtgttccccatgggctgagcagggggcctttggcaagttgcttgctggtgtctgcatgttgataaaagggctcagctgcccagctgaagtttgcagcctactgggcccgaggcctcgcacctggatctaagaagccgcactctgtgtgttcaggcccagtccctgacctgtgtctctgctctctgccttacccctcctgccccactcccaggccatctctgccggacgcggcccacagacctggtgtttgttgtcgacagctctcgcagcgttcggcctgttgaatttgagaaagtgaaggtattcctgtcccaggtcatcgagtcgctggacgtggggcccaatgccacccgggtgggcatggtcaactatgccagcaccgtgaagcaggagttctcgctgcgggctcatgtctccaaggccgcactgctgcaggctgtgcgccgtatccagccgctgtccacaggcaccatgaccggcctggccatccagttcgctatcaccaaagccttcggcgatgcagagggtggtcgttccaggtcccctgacatcagcaaggtacgtgcacgccaccctgctaggatgctgctgtttggaggctcccgctcggagttatgagctttgcctgcagacactttgattcccatgatgccccgtgaggtggccatttcatagctggggaaacagggtcagagaggggcggtcattagacagaggtcaccagttgcaagtgacagagctgggatttgaagccacctttacccaacctttccatcctaggagcttacaatcatttcagtttagttgaccttggttcccgaccagtctgagccccttgaagacattgcagacaggccagatgcttatgggaggagtgaaggtgtggcctccgccaccagcctgcctgggttcacgccctgctccaccatactagctgtgccaccccgagcaagtgacgtcatgtcactggtgctcggtttcctcacctgtaaaatgggagtaatgataacaccttctccaagtgctgctgaggactgagttcaaaagcataaggcttcccatcatggcatttgataatttttaatttcataattctccgagggcaggggctcagaaatggaagggctgtgctgccacctgtgctgtcagtgagggctccaggcagagggctgagcgtttcccaggacttgtatcctcactgtcatgttcagggctcagcacagaacctgaggctaagccaggtgtcctctgttcctgtggcacccccacaggctccagcacttccccactgcagccttcgttagcccgagtcgccacttccctgctcagggccccagctcaggggaggttctttcttatccctcctccataccccactctctagcacacagtggataaatgaacatgattctgctcggaggtggtatccccattttacagatggtgaaactgaggcataagaagcttaagcaacttgctcagccaataagtgggaaaagcattcacagagacaacagcatataatcccagccattaccaccccttagagaaatgacgtatcaggcagcctgtcggtcttggggccaactacaagtttcagcacggggtgctgtagatgaagctgatggttgaggtggtggagagggtgaaggagatgggggtggtggcgtggggtgggcaagtgaggagagagctcctccagcaggtgacacagcggcgctgggggagctggcaccagactccaggtgttcagcctggagttcacctgtgggaggacccagcaaggtggacaatctgaaagctgggttgcagggaggggagtagggactcgaggaggcagtgggcctcgggatggcagcgaatagtcacagctagattttcagagccaggagcccaggcccctggagaggaagagattgtacaaagtcactccccaggtagcccagggtaatgatggtaaaaataatagttgccccttctggcttctaaccaggagtcatctcactcaacctcaccacaaccctttttacagttgaagacactgaggctcaggaaggtgacctgtagcttgtggagctgcatttctaaacacggcctgtctcaactgcctgtcatcaggacagggtgtcaggacctggggctaaggatgggacccaggaatcagaaacagacccaagtcagaagcagagaagcagcaaagcgggactggatgcctaacccagactgggcagagctgggagcgccctagcctcagggcgggtgcagacagggggtcacgaagccggatctcagtgacagagtccgccacctctttctttccagggtacagaccagaggagcctagtgggaggggagcaggcagattctttccctctctggcaggggcatgtatcataccggggagtggaggaggataagggcggcatctttcttgggttggtcccttgggcatccacatgggagtggccctccgtcggttccctggtccagggtccccggtcttaccgggacaaggacagcaagacgggagacggcagccccatcccttagcttcggctgccatctggtggccaaagcgcagaactgcaccatgtggaaccaccggatccccccacccagccccggccgggcctcccgggggcacgaggggcgtggcacgactcccacagccatcagcctgaggaccctgccctcagccgcctcagtctgaggggaaggcatggccctgaccttagagaccccaatttggcgatggggcatcacatccctccgggcatctcagagctgcctgcccgagggaggcgaagcagatggaaagccccccagccacgtctctcagtcagaggaaacgggtctcctcttcggccagccgggtcctcttcccccgggtgccgcctggctgtgcgacccggcagtcctcccgcctctccgggcctcagcctcctctcctggacagtcccgtgggcttccgggagcccggtgtcacaccgccccgcgtgtcgcaggtggtcatcgtggtgacagacgggaggccccaggacagcgtgcaggacgtgtctgcgcgggcccgggccagcggcgtcgagctgttcgccatcggagtgggcagcgtggacaaggccacgctgcggcagatcgccagcgagccgcaggacgaacacgtcgattacgtggagagctacagcgtcatcgagaagctgtccaggaagttccaggaggccttctgcggtgcgcgggcaggcgggggcggagccagggcaggggcggagaaggggagagcggcggggcggggccagggctggaggcgggaccgaggctgaggcgcagacggagccagcgccggggcagggcaggggcggggccggggggggggcagaggcggagacgggagagagatagaatgtcagtgccggggcggggccggggaggagccgggggcggagccggagacggagagagtcagcgccggggcggggcaagggtggggccagggcaggggcggagacggagagagcggcggggcggggccagagcaggcagggggcggggccagggcaggggcgaagacggagacagtcagtgccagggcgggaccggggcggaggcggagagagtcggctccaggggcagggccagggctgagcgggacgaggccgtggcaggcgcagagactgagagtccgcgctgaggcgggccaaggctaggggcggagccagcgctaaagtgaagacagaaaaagtcagcgtcggggggcggggccacatcagagggcggggcctggctggggcggtagcctataaaacggcgggaactgagttacacggcaacatcagggcggggccagggctagggacacggcttaggtggattgggggtggaacctggattagactgaggtggtgccagcaccaggggtggggccgtagctggggcggagcctgataacggaggagggtctccagccccaggttaagggagttggggagaggcgatgttaagagtccttttatggccgggcgcggtggctcacgcctgtaatcccagcactttgagaggccgaggcgggcggatcacgaagtcaggagatcgagaccatcctggccaacatggtgaaaccggtctctactaaaaatacaaaaaattagccgggcgttgttgcgggcgcctgtagtcccagctactcgggaggctgcgccaggaaaacggcgtgaacccgggaagcggagcttgcagtgagccgagatcgtgccactgcactccagcctgggcgacagagcgagacgactccgtctcaaaaaaaaaacaaaacaaaaaaaaaaaccgcacacaaaaaaaacaacagagcccttttatgtggcagaatcctggcagggaccaaggagggcccagagctcaggaaggagagctcccagaaaacctacacatgtttctgtgtcgtgagttttgggtgccagagttttctgtgatgcgggagagtctgagaggcctgggcactggcaggagaaggttcagagcccttctcggaggggaggtgtgtgtgtgggtctttgggatgtgacccgcaggggcagggtgtccagtaggacaggatcagggttagggcagggactttacccatttgtaaaatgggtctaagaagagcatgcacgttattgagaggatccagtgagataatgcaaaatgtaaccctcattatatggtatttgacagataggtgctgtgttcattgtatgctgttctagacacttgggtgtcttgatacagcagtgaactaaacagactaaaggccctaacccttggcctttacctttttagtgagacttttcattcttatcatcagcattataaccttcttcagggatctaggcactggtgcaatgattccagacgtgggctgagagtcgggggcctgggccccagtatgttggagatcttagtttccctgagtctggatggggcctggtatccacagtcagggagggacaacctgtctgtagtgcccaaggcactatgactgtgagatctgagctacttattgtccccgcagtggtgtcagacctgtgcgccacaggggaccatgactgtgagcaggtgtgcatcagctcccccggttcctacacctgcgcctgccacgagggcttcactctgaacagcgacggcaagacctgcaatggtcagtggggtggacacaggctcgccctggagagggtgtggaggggaggtgatggggcctccccaggaaacccattcaagcctccctgcaccatacctctgaaccaatcttcaaagcagacagatgccttttagagtttggtatctgcagaagttctcacctgacttctgtccctgttttcaacacaatgggcggtgggtttagtgtggtagaaggactcacatagtctcaaaatcaaatcctggtgctaccacttctgagctgtgtgatctcacagctattggagtttcagtttccaatactgtacagtgggaccagtcaccttggctttatagaggcagttctgagggcacaatgtaatgatcctcagcacagagcttggtgtgtggtgggtgtccagccggggagcaggatggttgactatgtccttcagcttcagcccgttgccttcctgtcctccacagtctgcagtggtggtggtggcagctcggccactgacctggtcttcctcattgacggatccaagagtgtgaggccagagaactttgagctggtgaagaagttcatcagtcagatcgtggatacgctggacgtgtcagacaagctggcccaggtggggctggtgcagtactcaagctctgtgcgccaggagttccccctgggtcgcttccacaccaagaaggacatcaaggcggctgtgcggaatatgtcctacatggagaagggcacaatgactggggctgctctcaagtacctcattgacaattccttcactgtgtccagtggggctaggcccggggcccagaaggtgggcattgtcttcactgatggccggagccaggactacattaatgatgctgccaagaaggccaaagacctcggtaggtgttgcctgcctggaccctggacaccactgatggccaggggtacacacgggtatagcccaactgtagtttatcttggtgtcgtctgattagtgccctaaacccaggtgagtttgaatgaggaggattggttagtccaattctctcttataccaatgacaaaattgaggccccagaaaagtaagtggcttgttttgatggtccttttgtaagtgaggcttggaacttttccagctggatattcccaagaacacatcaactattggaaggcaactctactttggaacaagcccgagtctgttttgtaacctattaaatgaggaaaaaataaccaccagatggatgattattagggttaaatgaagcttgctgtacaaagcttccagtacaggaagtcactatagggtctgacacagagcagaacctcagtaaatatggattttctcattgtccttgttccaggcattgtgcttgcaattccagcagctgccagcaggaggtgtctggtgttggctgcctaagccttccccaggaggctcagccatatggttgcccatccccatgtccagccttacttctcctgttcctcctggcaggctttaagatgtttgctgtgggtgtgggcaatgccgtggaggatgagctgagggaaatagcctcagaacctgtggcagagcactacttctacacggctgacttcaagaccatcaaccagataggcaagaagttgcagaagaagatctgtgtgggtgagtgaggccagggctggcattgatgggatttgcaggtggggcactgtggaggtggagccatcctggaactgggtgtgggtggggaaaagcaggggccgaggtggcaccaagagttggcagaaccagaaggtgggctggcgcttacagctcttactaccagcaaacatgttgaatgctcgttacgtggctggcactgttctcagtgctctccggatattacatcatccgatcctatttggtaagaatgtcattaaccccattttatagatgggataaacaaggccaaaggggtggaacaactgttaatagctgggagagccaagatttgaaccctactgcctctctggtcctctctggtgacctcaccagctggttcttagtggtaaggagtgtgggtttcagagccagacgtgcctgggcctgtgtctttgctctgacgctgttggccatgggcaagttttttcacttcttggattcttcacctgtaagatgggattaatgacttcaaacccaaagggctgaggtgaactcactgaggtgacataggggcccctactagtgttcttcatgcagcaggtacagggatgctctcctagttcattctcagggctccaagggaccaggaagacgttcaggggtcacccctctatcactcctaagggtgctgtctcaaggactatctatatctttctgcctcctcaggtcccttaagcccctcacctccccgggaatcctgagtcctggccctgggcagtgactgtcctccctcctcctgggcagccactcaacagttcctttctctttccctcctccttgtcccctgcagaggaagacccgtgtgcctgcgagtccctggtgaaattccaagccaaagtggaggggctgctgcaggccctgaccaggaaacatatcccttcccagagggggctggggctggggaggggcgcaggccagtgttgggggaggcgggggcatggcccaagtgtggtcagttgggcaggcttctcttggcctgcttactgctgatgggctgcattctggcagaataagctgaagccagcttgggtgcacaccctgtcaaaagcagagactcctagaaggtaaacaagaaaatgaggcagaagccaggatctagggactggacacacaccagagtcctggacatgctctgaagaacatggagcccatggatgccccatttctcaggctcatggtgacgtgcctgaccccagtacccactcagaggtggggctgggccccagacagttcccctggctcagccaggactaggtggggaacccagcaggtctaaatctgcaactgagcagggctgggcactcgtggctcacagtaactggctgtgttttttggaaagcaccattctgaggacagtggatggataagttctgacagaggggagaatgcacgctgtagtggggtgttgcaggggcctgagtgcagggccacagccatccctgccctgctctggccaacctgcacctctccttaactctgagtccactggaagctgtgagtaagcggctggccatcctggagaacacagttgtctaaggctgcctgtcaccactgtggcctctccaagcgtcctgcacgtgtccgccgtagctttaccattttagtgagggaagccagcccgggggtgggagggggtgtgtctgggtgtgcctattgagagcgtgtaatggcgtttgggagctcgtgtgtgtatgtgtgcgtgtgtgtatgcgtgcatgtgtgtgtgtgtgtgtgtgtgtgcacgtgcgcctgagggtgggcatgagtcttgccagaatgtgagtgtgagagtgataatgcaggggtgagtgtgagagggactgcgtttgcatttttataatcaaaagcttaatatattcccatcttttttagttaaccctttcttgactctgagtgctgtgaatttctttactgatttctctattctccggtgagaaacaattaaatgtgatttaacgtaagcagtgaatggggctagaggcagtgtggttatttggggaccagggaaaaggatggatgaagatgtggtgggaggggatggttggaaggatggtaacagtggtggtgacagtgatgacagtgaccacaccaaaaccagctggtgtttgtcctgccttttcagttacatattcatttagttgacctcatttcacttccagtaaccttacccagaaaagactcaaattatccccattacaaatgggaaagctgagagtctaaatgatgaaatgacttgctcagcagtgggtcgctgagagacaggacttgaatctaggactgaagaacatcaaaagaaaaaggcttcagagaaaaagggcaatgacaccagataggactcatttgttcattcattcattcgttcactcattcgttcaggtatcatgtacttacagggcaatggcggtgggggggatggtgctgtatgagacagacgtagttcctgccctaagagacatacagttgagcagggtgctcatgtcacccccaccagccagagggaccagccagaggaaaagagagtgggtttaggtcgtaccaggggtttgtgcctcctcttgatacctgggagcccacggggtgagtgtgtgtgtgagatgatgggaagggctccagcctgggcctgggctgccctaggtgcctctcccctcccgcccccaacatgccctgttggagttctgtttgtttcctgtgcacaggcggcatcacccccaacccaaagtccccaacgcagatggcagcagccccacctcagagactgcacaagagaaagactcctggccccatgttcccttcctccagccctatgtggggtctgcaggtcacaccctgagatctcggtcacctcccccaggcccctattggaccagtgctgctccggaatctccatctctgtcctctcagagggggagctttggtgattttctgaacctattcttgtttaatggagcatttttagtgttactactagattcacacttgagagcatgtctaaaaggcttttacaagaagctcagaccacaccgaaagatcttcctcggaggcagttcaaagaggcagaataacaacacgaacggtacccaagagctacatcagtacaacagcacaaatacacaagcgcgacttaactggggcacagccaccctcgcccccatgacctgactccacctcctacacagttcaccaaaccctttctctctgtccgtccctggggcaggagtttttctgctgtccaaggaggctccttgacacagccacctgagaagttatgactctgctcattcttcctttcttctgagattatccactcccctctcctccccacacaggtggggagggggagaggcagccatgttgatatggactgagaaggctcagcagtgtgtccccaaggaggaggagagggtcattagcggacgccatggcctgggagctggcgggcagaagcaacagatgtccctgatgagtggagtcagagatggggtggaagccctgcctgggaataggacctcgttcttccctgcccggtgggtggagtagtggcaggaccttgtcaccaggctctgatgaaggcagggaccagcttcttgggatctttcaatcccaaactcttgcccttcactcatcgcagttctccccacggctactccaggtcctcttgaaatccgtcctctccatggacttcccacatccctctctgctctaggtttgattaacagaaggttgtaaatgaaaaccagcatctcccgagggcagccatggtctactgacagatggcaagttactttgtaacctgtaattttgtttttttgaattttgtataaataaacaggactaaactaattaggattgttcttttctttctttcctcaggccttgggctataatgggagtctcttggccccgtagtgcattggttaccaggtttcaataaagggtttgtctttgcaattacagttcattaatggatttacaagggagagaagatggcacagtccgctaaggggattgttttgcatttctcctcttttaattacatggttttctcctggaccagtgctctttgaaaaaagggggcgggggtggagagtcccaatgccccatctgttccagatgtgaatgcaattaatccaggagaagacaggagctgctcagggacttcctgatacctgaggctgggcctgcatcctcttcagagccgcctgtgaggctgggggttggggggccctgctactcaaccctggttggcatcaaggtatgttgacaaggggaggggaccactctgcttatgggggcgtcgcagccttggagtatttggggtcagaatcaagtttgggtcacctattgagttaccatttttgggtgatccctatgtgccgggtgatatatacacaatttccaattcacacttctcagtgatccttttaataaacttatttcacagacagggacaccaaggctgccagatgtaaagtgtcacgtggacaggaagtggctgggctgagatttaaatcctgaaatctctgcctcccaaatcagggctctttccagaacatggcctctctgaagttcaggctcactatggtgaaaggggttcctattcctttcttcaaaggttgggaccatcactggttaactggccttcctgcctttgggctgttgttctttagcccattctgcacactgataccagagtgatgatcctactgtgcccatctgatcagttcacacctctgctcaagaactttctttggctccctactgcctcctgaataaaattcaaacgtagcctgacaccttaggtgctgtatggtctggctgctgcttacttccgtctcacttcgcctcactgtgatctcacagaggttgcattctagaaatgtagaactatatgaggttgccatcaatacttccattgtggagatggagagacaggcacagagaactaaagtcacttgtgcaagatagaacttccagggctggaggtcctgaaagggtggcactttctaggctgcgaaacagggtgaggacgagggtaaggggtgtagatatctctccatttgggtcttgctcacccattggtgctccaggagtcccaggcattgccatggaagtcagattgagaagtcttgggtggttttttaattctccaaatgcttcct

SEQ ID NO: 17178 - DNA, 9096 bp, Human
tccaggcgcgatgatctctgctgccagtagagggcacacttactttactttcgcaaacctgaacgcgggtgctgcccagagagggggcggagggaaagacgctttgcagcaaaatccagcatagcgattggttgctccccgcgtttgcggcaaaggcctggaggcaggagtaatttgcaatccttaaagctgaattgtgcagtgcatcggatttggaagctactatattcacttaacacttgaacgctgagctgcaaactcaacgggtaataacccatcttgaacagcgtacatgctatacacgcacccctttcccccgaattgttttctcttttggaggtggtggagggagagaaaagtttacttaaaatgcctttgggtgagggaccaaggatgagaagaatgttttttgtttttcatgccgtggaataacacaaaataaaaaatcccgagggaatatacattatatattaaatatagatcatttcagggagcaaacaaatcatgtgtggggctgggcaactagctaagtcgaagcgtaaataaaatgtgaatacacgtttgcgggttacatacagtgcactttcactagtattcagaaaaaattgtgagtcagtgaactaggaaattaatgcctggaaggcagccaaattttaattagctcaagactcccccccccccccaaaaaaaggcacggaagtaatactcctctcctcttctttgatcagaatcgatgcattttttgtgcatgaccgcatttccaataataaaaggggaaagaggacctggaaaggaattaaacgtccggtttgtccggggaggaaagagttaacggtttttttcacaagggtctctgctgactcccccggctcggtccacaagctctccacttgccccttttaggaagtccggtcccgcggttcgggtaccccctgcccctcccatattctcccgtctagcacctttgatttctcccaaacccggcagcccgagactgttgcaaaccggcgccacagggcgcaaaggggatttgtctcttctgaaacctggctgagaaattgggaactccgtgtgggaggcgtgggggtgggacggtggggtacagactggcagagagcaggcaacctccctctcgccctagcccagctctggaacaggcagacacatctcagggctaaacagacgcctcccgcacggggccccacggaagcctgagcaggcggggcaggaggggcggtatctgctgctttggcagcaaattgggggactcagtctgggtggaaggtatccaatccagatagctgtgcatacataatgcataatacatgactccccccaacaaatgcaatgggagtttattcataacgcgctctccaagtatacgtggcaatgcgttgctgggttattttaatcattctaggcatcgttttcctccttatgcctctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccaggtaagcaccgaagtccacttgccttttaatttacttttttatcagtttaatgctgagatgagtcgaatgcctaaatagggtgtctttttctcccaatcctgcgttattgacacctttctcggggtgggggttattccagaattggatcggggtacagtgacttgtcaagatgggggaggagaagacagagggaaaacgggaatggtttttacgattatcctttcgagatttctgccttatgaatatattcacgtcgactcccggccggtcggacattcctactttattgtgttaattgttctctgggttttggggggcggggggttgctttgcggtgggcagaaagtcccttgcatcttgagctccttggagaagggaccgcatatcgcctgtgtgagccagatcgctccgcagccgctgacttgtccccgtctccgggagggcatttaaatttcggctcaccgcatttctgacagccggagacggacactgcggcgcgtcccgcccgcctgtccccgcggcgattccaacccgccctgatccttttaagaagttggcatttggctttttaaaaagcaataatacaatttaaaacctgggtctctagaggtgttaggacgtggtgttgggtaggcgcaggcaggggaaaagggaggcgaggatgtgtccgattctcctggaatcgttgacttggaaaaaccagggcgaatctccgcacccagccctgactcccctgccgcggccgccctcgggtgtcctcgcgcccgagatgcggaggaactgcgaggagcggggctctgggcggttccagaacagctgctacccttggtggggtggctccgggggaggtatcgcagcggggtctctggcgcagttgcatctccgtattgagtgcgaagggaggtgcccctattattatttgacaccccccttgtatttatggaggggtgttaaagcccgcggctgagctcgccactccagccggcgagagaaagaagaaaagctggcaaaaggagtgttggacgggggcggtactgggggtggggacgggggcggtggagagggaaggttgggaggggctgcggtgccggcgggggtaggagagcggctagggcgcgagtgggaacagccgcagcggaggggccccggcgcggagcggggttcacgcagccgctagcgcccaggcgcctctcgccttctccttcaggtggcgcaaaactttgtgccttggattttggcaaattgttttcctcaccgccacctcccgcggcttcttaagggcgccagggccgatttcgattcctctgccgctgcggggccgactcccgggctttgcgctccgggctcccgggggagcgggggctcggcgggcaccaagccgctggttcactaagtgcgtctccgagatagcaggggactgtccaaagggggtgaaagggtgctccctttattcccccaccaagaccacccagccgctttaggggatagctctgcaaggggagaggttcgggactgtggcgcgcactgcgcgctgcgccaggtttccgcaccaagacccctttaactcaagactgcctcccgctttgtgtgccccgctccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctggtaagcgaagcccgcccaggcctgtcaaaagtgggcggctggatacctttcccattttcattggcagcttatttaacgggccactcttattaggaaggagagatagcagatctggagagatttgggagctcatcacctctgaaaccttgggctttagcgtttcctcccatcccttccccttagactgcccatgtttgcagcccccctccccgtttgtctcccacccctcaggaatttcatttaggtttttaaaccttctggcttatcttacaactcaatccacttcttcttacctcccgttaacattttaattgccctggggcggggtggcagggagtgtatgaatgaggataagagaggattgatctctgagagtgaatgaattgcttccctcttaacttccgagaagtggtgggatttaatgaactatctacaaaaatgaggggctgtgtttagaggctaggcagggcctgcctgagtgcgggagccagtgaactgcctcaagagtgggtgggctgaggagctgggatcttctcagcctattttgaacactgaaaagcaaatccttgccaaagttggacttttttttttcttttattccttcccccgccctcttggacttttggcaaaactgcaatttttttttttttatttttcatttccagtaaaatagggagttgctaaagtcataccaagcaatttgcagctatcatttgcaacacctgaagtgttcttggtaaagtccctcaaaaataggaggtgcttgggaatgtgctttgctttgggtgtgtccaaagcctcattaagtcttaggtaagaattggcatcaatgtcctatcctgggaagttgcacttttcttgtccatgccataacccagctgtctttccctttatgagactcttaccttcatggtgagaggagtaagggtggctggctagattggttctttttttttttttttccttttttaagacggagtctcactctgtcactaggctggagtgcagtggcgcaatcaacctccaaccccctggttcaagagattctcctgcctcagcctcccaagtagctgggactacaggtgcacaccaccatgccaggctaatttttgtaattttagtagagatggggtttcatcgtgttggccaggatggtctctcctgacctcacgatccgcccacctcggcctcccaaagtgctgggattacaggtgtgagccagggcaccaggcttagatgtggctctttggggagataattttgtccagagacctttctaacgtattcatgccttgtatttgtacagcattaatctggtaattgattattttaatgtaaccttgctaaaggagtgatttctatttcctttcttaaagaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaagttgtgaatgttttgtttcgtttcttccccctcccaaccaccaccatccctgtttgttttcatcaattgccccttcagagggtggtcttaagaaaggcaagagttttcctctgttgaaatgggtctgggggccttaaggtctttaagttcttggaggttctaagatgcttcctggagactatgataacagccagagttgacagttagaaggaatggcagaaggcaggtgagaaggtgagaggtaggcaaaggagatacaagaggtcaaaggtagcagttaagtacacaaagaggcataaggactggggagttgggaggaaggtgaggaagaaactcctgttactttagttaaccagtgccagtcccctgctcactccaaacccaggaattctgcccagttgatggggacacggtgggaaccagcttctgctgccttcacaaccaggcgccagtcctgtccatgggttatctcgcaaaccccagaggatctctgggaggaatgctactattaaccctatttcacaaacaaggaaatagaagagctcaaagaggttatgtaacttatctgtagccacgcagataatacaaagcagcaatctggacccattctgttcaaaacacttaacccttcgctatcatgccttggttcatctgggtctaatgtgctgagatcaagaaggtttaggacctaatggacagactcaagtcataacaatgctaagctctatttgtgtcccaagcactcctaagcattttatccctaactctacatcaaccccatgaaggagatactgttgatttccccatattagaagtagagagggaagctgaggcacacaaagactcatccacatgcccaagattcactgatagggaaaagtggaagcgagatttgaacccaggctgtttactcctaacctgtccaagccacctctcagacgacggtaggaatcagctggctgcttgtgagtacaggagttacagtccagtgggttatgttttttaagtctcaacatctaagcctggtcaggcatcagttcccctttttttgtgatttattttgtttttattttgttgttcattgtttaatttttccttttacaatgagaaggtcaccatcttgactcctaccttagccatttgttgaatcagactcatgacggctcctgggaagaagccagttcagatcataaaataaaacatatttattctttgtcatgggagtcattattttagaaactacaaactctccttgcttccatccttttttacatactcatgacacatgctcatcctgagtccttgaaaaggtatttttgaacatgtgtattaattataagcctctgaaaacctatggcccaaaccagaaatgatgttgattatataggtaaatgaaggatgctattgctgttctaattacctcattgtctcagtctcaaagtaggtcttcagctccctgtactttgggattttaatctaccaccacccataaatcaataaataattactttctttgactctgactcctagaataatctattcaaaaccttaatgtctttttcttgatccttcttttgagtcctaagtaccgccattacagcttcaaattggcacgtcatataggcgaatttcaaagggagatgcaatccacagaagtatagtagttcaaagggttacaaaagcaaggcgctcttaaacagctcagtctttgcccctttgtggcctagggctggagtgcagctctggggtgactcacttgggaatcggg

SEQ ID NO: 17179 - DNA, 6286 bp, Human
gaacagccacgtaggcattctcttctctctggaggaaaaggcccagcagctgtccgaggaaaagacccaccagctgtcagcaaagggacatgtcgcagctaagtaagaatctgggtgactcgagtcctccggcggaggccccgaagccgcctgtctatagccgccctacggttctgatgcgggccccgcccgcttcctcccgggctccgccagtcccttgggatccacctccaattgacttgcaggcttcattggccgcttggcaggcacctcagcctgcctgggaggccccacagggccagctgcccgccccggtggttccgatgacccagcctcctgccctagggggcccgatagtcccggctcccccgctggggggcccgatgggtaagcctccgactcccggggtcctgatggtgcatcctccacctccgggagccccgatggcccagcctccgaccccgggagtcctgatggtgcatccttcagctcccggagctcccatggcccatcctcctcctccggggaccccaatgtcccaccctccccctccggggaccccaatggcccatcctcctcctccggggaccccgatggcccatcctcctcctccggggaccccgatggtgcatcctcctcctccggggaccccgatggctcatcctccccctccggggacaccgatggctcatcctccccctccggggacaccgatggctcatcctccacctccggggacaccgatggctcatcctccccctccgggtacaccgatggcccagcctccagctccgggagtcctgatggcccagcctctgactccgggagtcctgatggtccagcctgctgctccgggagcaccgatggtccagccgcctccagcagccatgatgacccagcctcagccttcaggagcaccgatggccaagcctccaggtccaggagtcctgatgattcatcctccaggtgcgagagctccgatgacccagcctccagcttcaggagcaccgatggcacagccggcggccccacctgcacagccgatggccccacctgcacagccgatggcttcttgggccccgcaggctcagcctctgatcctgcaaatccagtctcaagttataagggctcctccgcaggttccccagggcccgcaggcacccccagcgcagctagccacacccccgggctggcaggcgacctcgccaggatggcaggccacgcagcaaggctggcaggccactcccctgacttggcagaccacgcaggtcacctggcaggcaccagccgttacctggcaggtgccgccgcccatgcgccaggggcccccgcccatccgccctggcccaccacccatccgccctggcccaccaccggtgcgacaggccccaccgctgatccgccaggccccaccggtgatccgccaggccccacccgtgatccgccaggccccacccgtgatccgccaggcccccgctgtgatccgccaggccccacctgtgatccgccaggccccacctgtgatccgccaggctccacctgtgatccgccaggccccgccgctgatccgccaggcgccgccgcccatccgacctgccccacaggtcctggccacccagccaccgctctggcaggccctgccacccccacctccactgcggcaggccccgcaggctaggctgccggccccgcaggtgcaggcggcgccgcaggtgccatacggccccacctgctacgcaggtacccgcggcgccgcccgctggcccgcaggtgccccagcctgtgctgccggccccgctgtctgccccactgtctgccccgcaggctgtgcactgcccttccatcatctggcaggcccccaaaggtcagcccccggtgccacacgagattccaacgtcaatggaattccaggaggtgcagcagacacaggcgctggcctggcaggcccagaaggcccccactcacatctggcagcccctgcctgcccaggaggcccagaggcaggctccccccttggtccagctggagcagccctttcagggagccccgccctcccaaaaagccgtgcaaatccagctacccccccagcaggcccaggcatcgggtccgcaagcggaggtgcccacactgccgctccagccttcctggcaggcaccgcctgcagtcttgcaggcccagcccggacccccggtagcagcggcaaattttcccctgggctccgctaaatcattgatgactccatcaggagaatgcagggcctcttctatagaccgcaggggctcctctaaagagcgcaggacctcctcgaaggagcgcagggccccttcaaaagaccgcatgatctttgctgccaccttctgtgctcccaaggcagtgtcagctgcgcgagcacacctgccagctgcctggaaaaacctgcctgccacaccggagacctttgctccctcctcaagtgtcttcccagctacctcccagtttcagcctgcctctctgaatgcctttaaaggcccctctgctgcctcagagaccccaaagtcactgccatatgctctgcaggatccctttgcctgtgtagaggccctgcctgcagttccatgggtcccacagcccaatatgaatgcctcaaaggcatcgcaggcagtgcccaccttcctgatggctacagcagctgccccccaggcaactgccaccactcaagaggcctccaagacctccgtcgagccgccacgccgctccggcaaggccacccggaagaagaagcatctggaagcccaagaggacagccgtggccacacgctagcctttcatgactggcagggcccaaggccctgggagaatctaaatctgagtgactgggaggtccaaagccctatccaggtctcgggtgactgggagcacccaaacaccccccgtggcctgagtggttgggagggccctagcacctccaggatcctgagtggctgggaagggcccagcgcatcctgggccctgagtgcctgggagggcccgagcacctccagggccctgggtctctctgaaagcccagggagctctctgcccgtagttgtgtctgaggtcgcaagtgtctctccgggatccagtgccacccaggataattccaaggtggaggcacagcccttgtctcccttggatgagagggcaaatgcgttggtgcagttcctcttagtcaaggaccaagccaaggtgcctgtccagcgctcggagatggtgaaagtcatcctccgagagtataaagatgagtgcttagatatcatcaaccgtgccaacaataagctggagtgtgcctttggttatcaattgaaagaaattgataccaaaaaccacgcctatattatcatcaacaagctgggctaccatacagggaatttggtggcatcctatttagacaggcccaagtttggccttctgatggtggtcttgagcctcatctttatgaaaggcaactgtgtcagggaggatctgatctttaattttctgttcaagttagggttggatgtccgggagacaaacggtctctttggaaatactaagaagctcatcaccgaagtgtttgtcaggcagaagtacctagagtacaggcgaatcccttacactgagcccgcagagtatgagttcctctggggccctcgagcattcctggaaaccagcaagatgcttgtcctgaggtttttggccaagctccataagaaagatccacagagctggccattccattaccttgaagcgctcgcagagtgtgagtgggaagacacagatgaggatgaacctgacaccggtgacagtgcccacggccccaccagcaggccccctccccgctaataggtgtagcagagatctcgctcctgtgtttccctggccagaggccactgacagggtggggggacatttttgttcctggtgtttgtgttccagttccacgagtgtacgtttggattttcaacttggtttcgtatctgccaaagctttgtacattttttatgtggtgttgatttcaatcggctactgttctgttctgtattttggcatctgtgtttttaagtgagatctgtggttctctgttttgtgttttaattgttatgttttggtatcagctttgtgctggctttgtgaaatgaattgagaagctatccatctcatttctggtatagttcatgtagcattgtaatcggttgttctttgaacgttcaaatgactcatcagtaaaaactgtctacagagaagtaaatatctatatctatatatataaatatactttcagcataacagaagtgtttgtctttattctaatttttacactagatggtggaagccaagttttgccgtattctctgaatagacatgaatagcaagactactctcagttatagtaaaaaccacggtgatggaattgttttccaaggagagtactccattcatctttataaggatgcagtgatttcagtgggtggttatacataagatttctccaggagattaattaaagcacacacgttagtgcccagctggtaacgttgttattagaagcagaaatgtccttaagggtatgtggagaagaagggccatctgcctgcaggactacaaataaccaggtggtcccgcttcatggagaatttggccaaaagggtatttgtcaatcatgtggcccgtggcggggtgtccagcagttcaaatttgggtttcatcaacacactgctaccgggatggaaacgtgctccctgcaggatatccaggcttataacagggaaaaggaaaaaacagtcttcatttaattagaaaccctgcagattgccagcagtagtggctgggttaggggagggcgtggcagggtgcattcctatcaacatagagttctaggggaaggtcctggggggaagggtcattctaacttgtaggggaaggcagccggcaacgcctgaagttgctgaacaaccgcggtcagcccttggctatgaacctggtctaggcaggaaagggacaagggaatgaactggcctgagtgttttgaggaaggatattcaagcacacaccaggctggtgtacacaaaaggacgttcttgtggtcatactctcttcctgtggacaggggaccatcagccctacttgccaccgcatactgtcttatcagaaggaagaaatccaatcccatatcccgcttctagggtgaagccaaagtcccagatgcggttagtggcgatggtggaattctcctgccacctagcggcagattagaggtgccaccgcagctgccgcagcaacagcccctcccacagtgcttaacttcacaaccatgtatatacttggattgcagctactccttgcttcaccacttttgctcataattttatctatatctgtgcccagagattccttcttttctcttataggccaaggtagcatctgttttcaagtccaatccgctcttcactcaacaatttctatccttggtcctgcagcgctgccacttaggaagctgactaggagaggagcccacaagatgcagactctactcctagcacccgcagaactgagctttccaggacgatgatccccgccccaggacctgccaggccgcaggagctctttctcaagttgtctaagtggtcaggtagtccaaaaactgggaggcagtttcctataaactccttgggtcagagagtcctgcgcatttgtccgcaagcaatgtttacttatttttacaacaacagcaaatgtccattgaaggagacagcaatgccccagctgagaactgtccccaaaggaggttttgctgggccagtaaagtggcatattggtctagtatttcttgtttgtgtttagtttatttatgattgcttataaagttttctccagaccattaactcatggcgtgcctgagcaagatgctctttgtggaacaaaatttgggactttgttccaaatttgggactttgtcccatcatgggactttggtgccatacttaaggtgggggctggctctgctccatggtagagaggcttacttcccagctgcaaacctcactctcacacgtgacatatatctaatggccttctttaagtaatgccaaggacttaaagcctaaatttgtttatattgtaatgagatataaattgcaacaatgaaaaatgtgttcattaccaatgagtaaactagttagatattcaactgaaaagtttaagaaagtgcagctaacatgacagtgaaaagcagaaaacaaagaccaggaatatagaaaaatacaggttaaaaaacagcgggaactggccg

SEQ ID NO: 17180 - DNA, 27589 bp, Human
tgctcctagaagaagtagtactctaacatttggtgaagttctaagagccaacatttttacccagcttatactaggacctgttctaaatagtattttagctcatttaattgttaagccattgtataaagtaaacagaatcccttcttttgttacagattaggaatttaatgcacagagggttagataacttgctcaaagtaacattgtggtcaagagtcaaagctagaatttgaatcaaaagagcctgagtccaaaggcatggttttcatcactggactataatggtgtgtattctttcataattttttcagtgtaaaactgaacatacagtatgcttttattttatttatttttttgagatggagtcttgccctgtcaccaggctggagtgcagtggtgtgatctcagctcactgcaacctccgcctcccacgttcaagcaattctcctgcctcagcctcccgagtagctaagattacaggcatgtgccatcacgcccagctaatttttctgttttttgtagagatgggtttcaccatgttggccaggatggtctcgatctcctgacctcgtgatctgcccacctcggcctcccaaagtgctgggaatacaggcgtaagccactgtgcccagcctacattttatttttcgattgactcccgtgatcagagtcaacttcccatgttattttatgtgaatatgtatcaatgaactattagaaattgcaatgtttttgtaggtcaaaacaattcaatattgacaattttatatgattcagcctaatacatcattttttccatcagccatattgcatgttattatttatatatacgtttatttatttagcctatctgttctctgtgaggaacattacacagtttctgagattttgttacgatagaagtcagcattgataagcctctgcgcacctgttttaatgtaggatcattgggaactgagcagtagcttacagggcttgggaggggatttaaccatttagtcaacctccactcacatcaccctcccttcttcgataatgggcaattgagaaagggcaaatgtgtgtaaaaactatgcagatgcagtttcaggattattttcttcttttctgcagtgtcttttcccaagctacatcagcgtctaaattttggagttactgatgcttccgttatttctgcagatagaatattatgtcgtaaataatgtttacttgtccattagtattatataaaagtgcctgtttctccccactccagctatcattgattattggtaaaaattttaatgtatccaattctaataggcaaagaaaggctctcctacttagatcttaggtgggggtctaagttcatatttttgttttacaaaaattgaatagccagtgtttttgagttgaatgatctatccattccgtataggagagtttaattatattgtgattttgggggagataattttcacaatttaccccctcaaaatgtagaaagtagaaaaagggtagaaaaatcgcaccaaatttgaacaatgtagcatgcttttagagttagggatattttcttttggaaggatttcaagtctggcgtatttgcattgattgtggttatggcgcatttaacttttccaaaccagcttttttgtaccgcacataggaagacctgagggtgagtgtaaattaggattgtttggccagtggtgtgtgcaaaaatttattgtagaaccaagaattatttctttagtattttacacattttaaaaaacaggtagacatgtccattgatcccaggttgcttatggtttctagaggccccctctcattgcaacagtgctgtggggccctaggggtccagtagccccctccccccaggtcattccggtgagggagggagctgggacccctgcactgcggcaaacaagcacgcctgcgcggccgcagaggcaggctggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactgaataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtgcatagggattttaggcggaggtaggtatattggagtgattgtggcggggcgaaggtacgtgaagtgatcggtatttagggggtgttgagcgcaggtaggtgtataatagtgaccactgcgtggtggagcagggtacgtggggcgactggggggggaattcgtcgcagtgaccgaggcgaggaggctatggcagtggaccagggggatgagtcggtgtgacagtggtgggggttgtgttggtggtcgcggcgcggggagagtccgtaggaagtggctgggaggtagggggaaggcggcgacagtgggtattggcggcggtgggcattggcagcgggtaggcatggcggtggtggactttggcggcggtaggcatggcggcggtgggcatggcatggaggcggtgggcatggcggccgcggggcctgtcgctgtccggagtgactaagggacgctgaatgattgctgtgtagaggagggggcatcagaaggggcagtagcacagtccgcagcctttaattttcctgtgacctgcgatggtcatctggtttgcctactgtggtggtggtgcttttttattaaaactgcgcaatgcctacactgccgcaggggctgcagaaatgcgtggaatccttgcgtaccctttaggaaccctcgctttagaggctatggcataagaagactggaatgatgtgcagaacttgcatttacagatcttttgactgataggccaggtgatgcctgggggttacttttttttcattgtttctctctgttgggaaccaggtcttggaaggctatgtcgaaataacctgggggtctgtgttgcgtcactgccattgtgcagctccttcaagatggccgccgctgcagcggcttagatctgcgcaagcgcttcagcgggggggtggccgcttcctccctgtagagccgccagtggggagggggcaggtggtgtgtgttcagcttctgctgtttcggagtttcagccgtaccctctttagggtgcagtggtaaggagaggaagccggccaaggtgggcggctgccccctccccaaagtgctgcttgggaaaggatgcaggttgcgcagacgcagcagaggtgacagtcgcctccgcttgcagtggggcgagacgtggggcaggggagcgagggcttacgcagcttttgcctggaaggaatggcagccctccccttcacctggctgatacagcagctgttcctttccggttgtggcgcagtagaggggggaggagggagatgggttggcgcaggctccgcctagcaagcttggcagccaccccttacccacggtgcagcagtagaggactggaggggaatgtggctagaggccaggcatttgtaccacctccgcctgtgtgggatggcagctgcactgggctactgcttttcagctctgcagtaaactagagtggtgggggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataaatgtcaccatttaagattcagttatccttcttaatctctggatagtccattctgatgcactgcatactttccttaaatgggttgggggagagggcatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggagtctgggattttatatgatatttataatttacccttttttttctgcttgcatgaagatagcagttcacatacatatatttcttggtttaacttctggtcatttggctatttgcaagctgagtatttagtctgatccgccattttgtagtcttgcattcaggcccgggatcctaatatggcagatccctttggaaaggcctcttgaagtttcaaggtctgtgtcctactcagtgaattggctctgtgctagggctttttggaggcagggagtggcagcccttcctgtgatgcagaggaaggaagcttggttgagagacccttatgttgttgtctaaggcagggtactaactgatttggatttattcacagaccttgccttatcttgatttcactattctatctgaccagtgtgtcattgccgaaatgttttccacatttatagttactctgtatctttatgtttcccttaccctgttccttttcctaataaacatctttgttttacaaaaaattttgtttataaagtgtcaaggatgccaagataacctcctttgtttatcagcgccctctgtttagctattttttaggaagaatcatttaagcaggttgtgagtactgccctcaattacttggacaatgaagttttaaaaatcttatttagacctgtcactggtcctgtctcctttttttttttttttgtggcccagggccagaaagcttgagtgagaattgttactacttaaggtagcctctctccatttctggatgctagctggctcaaagtttttttttttttttttttttttttaaatagaccagggtctccctatgttgtccaggctgaactcgaactgctagactcaagctatatcctctccctcctcagtctctctctggccactgtggctggcccaaattctctttttgttaattctcctcagatttgttttggaggcaatgaggtttcttatattcatggggtacagattagcagcctatcattaaccttatttttttgtttttaggagacagggtctggctatgttgcccaggttggagtgcagtgatgcagttatagctccctgtaacctcaaactcctggatcaatctagactcctgcctcagcctcccaagtgcctgttagtacaggcttgaggtactgtgcccagctaactttttatttttttgtagagaggggtctccttatgttgcccagactggtctcgaactcctggactcaagcagtgcccctgcctaggcctcccaaagtgctggcattgcagccatgagccgctatacctggccaactttgtttatttttattcttgagatcttagttaaattttatggaaaatttaggccgtaataaaattgggattccattgctttttgcttttcaatatatttccggattattactttcagtgtaagtgatctgagggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcagcctggccaacatggtgaaaccctgtctctactataaatacaaaaattagctgggtgtggtggtgcatgcctgtaatcccagctactttggaggctgagtttgggtcttgtaatattacttcatctagcagtagagttagtgtcatatgttactttcatgattaacatttttaggaagttggcaaagtctatatataacactttatgtttccaccagcagtttccccacatcctttacaaatattgtggtgtcagatggtggcatttcagtgggggttttttcattttgaggcagggtctggctctgtcacccaggctggtgtgccagtggcatgatctcaggtcactgcaacctctgcctcctaggctcaagcgccctctcaccttagcctcctgagtagctggtaccacaggcatgcaccaccacacccagctaatttttgtatttttttgtatagatgttgcccaagctggtctcctgagctcaagtgatcgctggcctcagccttccatgaaccattgcgccctgcctcattgggattttgatttgcattttttagtgactaatgttcagcatcatttcatatagattagccacttgtatgtgtttggaggactgtctattcaagtgttttacccatcgtagcaatagaatttgcccttttattgttgagttgtgagagttccttacatattctggataccaaacttgaaaaaatacttttttgaggtgtgagtgacatacaaaagctgtagatagttaatgttaaaagttgatatgctaagagataagtacatgcctttgaaatcattcttatcaaaattagtggcataaatgtgtctgtcacctgaaaaagtttctttgcctctccctaccttcttttttttcattgtttggattttctttttgtttgttttggatactagaaacttagctgtatgttaagcaaatattttttcctattctggttatcctttcactttctttagtgttttcggaactttattttttgatgaagtccactttattttttatactgcttgtaattcaggtgttatatttaatagaccattgtgtaatcaaaagtaataaacattatcagtgtataaaattttaccatttagaaatcaaatatgtgtgtatggcttgattagaacatttaaactcttgaaagaataaaacagctgtgcgttattggtaagctattttaccaatctaaaagtctaacatgacttaaaaacatctagggttcagagaattattaatagcttttggcatgtatctttgaattttgcttttgagatattacttgtgttactttagtgaaaggtcctgctgacctttctgatttatcatctttaaaggttcataggtggtttctgcagtccctaatatggctagtctggtgtgggatttcatgttctgttcccttgagcagccattttatgaggggttctgcagacgtaacatggcgggttttttgtttgtttgtttgtttttgctatgtggatagtttttagcttgagcagctcttctattgctttgcaaatcctaaagaaagcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcctaaaaatacaaaaattaaccgagtgtggtggcacgtgcctgtaatcccagctacttgggaggctgaggcaggagaattgtttgagcccaggagacggaggttgcaatgagctaagatggcaccactgcactctagcctgggtgacagagcaagactccatctcaggaaaaaaaaaaaaagaaaatgcagtgtatgaatactaatttattttatttttttcaaattaaaggtttttcctcatagtaaaaactgagtagtagtttgtgtgtcttttgttatttcctcattttatatgtgaaaagttgagctggatgtggtggctcatgcctctaatcccagcatgttgggaggctgaggtggatcacttgagcccaggaggtggagaccagcctgggcaacatagagagacctcctctctacagaaaaataaattagccaggcgtggtgttgtctacctgtagtctcagctacctgggaggctgaagtggaagggtcacttgatcccaggaggttgaggctgcagtgagccatgtttgtgccactgtactccagtctaggtgacagaatgagatctagtctcaaaaagaaaaaaaaagttgtaaaacatctgttagcaagttttaaattatggtgagggtaaagattttttttttattttttcctatttattttgccgatttttactatagtgagtatatttaagtacattttcattttttaaaattgctttggaagacgtattttatgtacgttttgtttgtatattggtaaatattttgaaagtattttgtgtaatataatttgtcctttatatataataggttattcgatcattcattttatttgatatgaaatctcttttttcatctcttcattctttttgagacggagttttgctcttgttgcccaggatggagtgcaacctccgcctaccaagttcaagtgattctcctgcctcagtctcccaagtaactgggattataggtgtgtgccaccatgcctggctaattttgtatttttttagtagagacagggtttctccatgttggtcaggctgggctcgaactcccgacctcagatgatccgcccgccttggtttctttcccaaagtgctaggattacaggtgtgagccactgcgcccagcctctcccttcattcttttgcagctctgacgtttttttaaagtgccattactattccctgagtttctagaggtagttcagagatggtggtggaggtagggctgaggtttaggactcttaggtttaggactgttaagtgggtgaaggttctatcttgctatatttttgttacagtttttttcctatgtaacctcagtgtggactaaataacaggtagtctcatcctcatcttgttgtgggatgacgttagccttctaggcatcttgtccatatttatggaaacattttgatggttttgaagaagaaataacttgagtttttcttatctgcactgcatatatatgtacaaatactgcagggtcttgagttgggggaatgatctgagtaaagtgtagagttagggaaatagtataatttttcccccttgtgcgttttcattttgagagtaattggattatggaatgggtaagcaggattggttaacactgcctcattgtccatgtgtttaggattctcaggattggtatacttagaatgttatactagaagtgttcaatatttacccattcatctcctacttcctaccaaatcataagtagtattgggaggcagtcttcctggaggagttgtgtggttattagccctaaagatcaatgaaggaggctgggtgcggtggctcacgcctgtaatcccagcactttgggaggcgaaggtgggcagatcacctgaggtcaggagttcaagaccagcctggccaacatggtgaaacctcatctctagaaaaataaaaaaatcagccgggtgtggtagtgtgcacctgtaatcccagctactcaggaggctgaggtggaagaatcgcttgaacctgggaggcaaaggttgcagtgagccgagatggtgccattggctgtgcctgggtgacatagcaagactccatctcaaaataaagtaaaaataaaaagttcactgatttattttaaattttttattctgtctttcagtgtatttgtcactaaattagctcttattctttggggctggatgatgtatcgtgagttcgaagggaaattggaaattggagctggagagttgtcttaatatattttatgctaagcttcacatgtcttttcaaattaatattctgcactctatgaattaaattctgtgtaggctgcctcattttctcagtctttaatcttctattgggttacaggttagatctgagggggacattgcaatagagaattatcttacgtttcaagataacattatatatatttttttttactgaaacactttttagacctttatgaataataatcagaaacttagttgtcatttgtaaacaaagaggttagagtggagaatgcccaaattaagatttatttattcagtgattagactatgaattagagtataaagtagactatgaattagagtgtgaagatttagaggtatgtgcagtgcaattctgactacttggagttagtgcaaatttcacagttgtctagatgccctccagaacattcccctcaatgcagacaccaactccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgcttaccagtagatgattggtttacatattttaagagcccttaaatagccctggaagttctatatttcaggtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtaagtatcttaagtatccactagtcccttgtacaatctctgtgtagagattcctgttttgtgttataatttctcataagatagtgtcatcctctgaccctaaagaaagatcttcttccctgggcgtggtggctcacgcttgtaatcccagcactttgggaggccaaagtgggtggatcacctgaggtcatgagttccagatcagcctggccaacatggtgaaaccccatctctactaaaaatacaaaaaaattagccgagagtggtggcaggcacctgtagtctcagctactcgggaggctgacactggagaatggcgtgaacccaggaggcggagcttgcagtgagcccagatcgtgccactgcactccagcctgggcgacagagtgagactctgtcttaaaaaaaaaaaaaaaaattagctgggtgtggtggtaggtgcctgtaatcccagctacttgggaggctgaggcaggagaatcacttgaaccccgaaggcagtgtttgtggtgagcagaaattgcttcattgcactccagcctgggcaacagaatgagaccctgtctggaaaaaaaaaaaaaaaaaaaaggaatatcttcttaaatgtaagggtacctagttttctttcatatggtttcctataaagacaaatgtatttttatcatttatatatattgtgctcttgttgtaggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagttacaacatactttcacagcattattttaattcaaatatggtttatgtcagtgaattataaatacacagcacataattaacaatgagtattagagaatctaaatactttctcatgcttatttactaattcctttttgttttgtctttttctcacttttctgttttaaccaatgtatttcctctttgaatcagcagacaatgtaataaaaatattattcataatttttcaatgtgatgtagatttatttagttctttttatgttgctttcattttttaggaaaaagttattacaaagtcgattttgatttgttttcttgtttttcctctgtgatttttctttttttctactttaagttttagaatgccctcatttctgagagtttactatttactttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccaggaaaaataagaaaataaactattaatgtggccgggtgtggtggctcacgcctgtcatcctagcacttggggaggctgaggcaggtggatcacctgaggtcagaagttcgagaccaacctggccacatggcgaaaccccatctgttctaaaaatacaaatattagccgggtgtagtgggggacacctgtaatcccagctactcgggaggctgaggcaggagaatttcttgaaccctaggggcagaggttgcattgagcagagattgtgccactgcgcttcagcctgcgtgacagagcaagacttctatctcaaaaaaaaattgtgttatgaatattctgtttttctttggtacctaaatatttaccagggtacatatccaattggatacctacctagtagttgggatgcagggtgtaatattagtatgacttttaaacgtttttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtctcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgaccactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggaccgctaagcttgtgggagttatttatatcctattgctcaaggtcattgccaaggtctgatttttcacaaaaaaattccaacctctggcataaatgggttaaaaacggctttagtgatgtagtgctgataaacataaaattcacccaatttaagtgcatgaagcaatgatttaagtaaatttacagaactgtgcaatcattgccatgaactactctggaaacattttcatcaccacagtaagatctgtcttgctcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaaaaaaaaaaaaaaaaggatattgctaatgagtctcatataccatgttttcttggatttagactgctttataaagaatcataagataatattcaaaacttctaagttatagtccttaaactcttactcatatttaggacagaaactacatttaatttttgtggaggtctttgtttgcttatttgaaaagttcttttgagatctttataagttttatttaatacattttttaatgtacagacatcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgttgggattatgggcgtgagccaccacacccagcctcttctctgtttaacattgtattgtgagtgttcatagtatgcaggatagtaacatgatatacaggtttgtagcctaggatctaccatattgcctaagagtatagtagactctgtgtatcctctaggtttgtgtaagtacactgttcatactgtgatgaaatcaccaaatgcatttctcctaatgtgtccccattacgtgacttatttatttattttgagatgaagttttgctcttgtccctccttgttgcccaggctggagtgcagtggcgcgatctcagctcactgcaacctctgcctcccaggttcaagcgattctcctacctcagcctctcaagtagctgggattacaggcacccaccaccatgcctggctaatttttttgtatttctagcagagacgggatttcaccatgttggccaggctggtctcgaactcttgacctcaggtgatccacctgccttggcctcccctggtgctgggattacaggcgtgagccacctcacccggccgttaacgtgatttataactttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtgaggaaccagcagagggttttatattattgggagaatatgactaagccggaggccgaggagatttaaaaacctaagtgtatgtgtcatacaatgtaaacagcatatggtttaggaggaaccaaaacacagatatatgggaggaagggaataaaactagctgcttaaaatggtcattgggtgattaaagttacccaggttactcttggcaagagtaacttgccactagtggtgagtgaacagaatgcatggatataccacagttgaaaagaccaaagggctttttggatgtcagtgtactaagattagtttttaaaatatgggaataggccgggtgcagtggcttacgcctgtaatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggtaaggaaaataaagaggcgaagccttagttgctttaggagatgatataatacaggtgtgacatcagtgttttcagaatttgtaaatgttaaaacaaacttcttgatttaccaaagccacaaccaaagtactttacctggatctttcaagacagagcttctcagttcagacaaattgactgatgataagacaaacacttttcctctacaaaccgtggggtagtatgtagagagacctgtgatttcttcccatactgctctggaactacttctaattatacttttttctttgtttgtttttgaaggggaagcatttctccttgcattggtttgctggtatggatggcccttagattttggcatgagtgattatgcagcctatttgaagaaaacctgttttcaggacctttttaattaaatatggcctgttacatgagttaaaggtaagttataagagctctagattctgcaagatgcttgcttcttgtagttattttgcttggtgataatacattttcttttgtctggagcttcctggactttttgagaatcctgattgtgatgatataataggagaaaacttgggatatagatagtataattgagtgtggtgaatcttttgttatggaatgctagtctaagcttctgtgtgtttccactagggacacacatcaacatatcagtcttaaaacattcttggtagttaatgcttgatgttacttaaaaatcatcctacattcttgcattaaactacatacacgtggctgggcgcggtggctcatgcctgtaatcccagcactttgggaggccgaggcaggcagatcccgaggtcagaagatcgagaccatcctggctaacacggtgaaacctcgtctctacaaaaaattcaaaaaattagccgggcgtggtggcaggcacctgtagtcccagctactcgggagc

SEQ ID NO: 17181 - DNA, 6881 bp, Human
tgatggttgaattgcatcccattgtttggaggtcccttagaccatttcaccatttgtccacttaagtgactgggcttttccaatgttgcttttaccaacaatgctgcaaagaataacattgtacatatacgctaatcctgacatgccataattttaaaaagatagcgacctagaagtgagactaccggctcatagtgcaagtttattttattttatttatttattttttgagacatggtcacactctgttgtccaggatggagtgcagtggcacaaacccagctcactgcagcctcgacctcacaggctcaagcgatcctcccatctcagcctcctaagtagctggggctacaggcgcgcaccaccatgcctgactaattttttcacttttttgtagagaaggggtctcactatgttgccagggctggtctcgaactcctgggctcaagtgaccctcccaccttggcctccgaaagtgctgggattacaggtgtgagccaccacacccagccacaagtttattttccatttcaatagcctccaattattagccactagagactcttaacttccttgagttaggatccttaccaatttttgagcacctaccatacgcctgctatatgtagcaatggggatgaagaaaacaatcaaaacaaaacaaaagaaaaaggtatttccctaccaccgtagagctctatatagaaagaatacaaaaaaaaaaaagcagccagaaaataagaattaaaataatttgtattgcacatagttggtgtttaattcataaataccacttacaaagatttatgactcaaagacaagacaaagtacttccatgggttgacacagggctgtaagcaattctttgaacatgaaagaagctggacacataggtcatattccactccagtactcttcccagtccatcaaactgctctcttccaggccaataagtactttctgaagtcttcctcgagtccaacttctagatttttattccttcctctccctgcatcattccagccatagctcccctttgtgttcatgcaattaatttcgtctgagtcaaaggccttgtgtactctcgctcgttcagagggcaaaggtgtattctagatcctaccagaaataagtttcttaggaatttggttttattttataacaagctaagagatcatgtttttgtgtttcaaacatattactttttctaatttcctcaaacttagatatttccctttttagttctttctgagattaagcatcttagaactattctctcttttgaatcacggcaccacctttagctaagagaaaaacatctaattctcagctacttccaggcataattgcaacaaaatcagacccaatattgaagattcacgtttgctgtgtgttttaccataataaaagttcgaaattctgtgaactctcttaataaaatgttccaatttcttacaccctttcatgatgacgttctcttaaaggactaacttgaaattttcaacattcagttaagcccatttccttcctattaacaatcagtattcaatattgtggcacgtaagtaatactgtagttctgacagattaatttatatttgccttattaagagtcgttgctttttttgctccccgacttaaattttttttgtttttccccaatctatacgaataaaagcgtgaactatatgtgaaatagctgaagctccacttccattataaatagacaatgtcccaaattgccgttttacaaacattctcaatagcatcagccagtgatagcaatccgaatactccagagagaatgcgaccaaaacccacaacaagccccgtggtctagcacagcaaagagaaaaaaagagaacacgaaaatgcccttgctcccctccgggggccccttttgtgcggttcttgccaacgcagcagccctcctgctatatagcccgccgcgccgcagccccacccgctcagcgccgccgccccaccagctcagcaccgccgtgcgcccagccagccatggggaaggtgagcccagcctgcgccccgggaccccggagcttcctccatcgcgggggccagagactggggcaggagcaggcctgtgagacctcgccttgtcccgccttgccttgcagatcaccctctacgaggaccggggcttccagggccgccactatgaatgcagcagcgaccaccccaacctgcagccctacttgagccgctgcaactcggcgcgcgtggacagcggctgctggatgctctatgagcagcccaactactcgggcctccagtacttcctgcgccgcggcgactatgccgaccaccagcagtggatgggcctcagcgactcggtccgctcctgccgcctcatcccccacgtgagtacatcctcaagtcaggacccaggccctcaggacactcactggatggtttcaagcaaaagttaaacattagaagtagtgatcagtcacaataactgagagtggacaaaagatgaactatagtggattaagtcaatagagtttgctccccacataagcaaagtattacccagacaccagttaatcacaattaatccacaaatatgtattgagtaggaatgtgtctcctgccctaggggttgtataagacttaagtcctattctggaatcatttagaatggagttgtagaaaaaccactaatacccaatagaagaataaatgctagagcgtacagcagttactgagcaaacagggtaatttcttttgagactttttcccgtttttgctcctctcttgcatattttgggttttcccaacctatataagtaagactttccttcaaaggagagcaacacacatattttacacatgtgtcccttttatcccatatgtgtgttagaacactaaagtttatgcaaaattcgtccttggacttactgatgtttcttcctccatttttcttcattgcattcacaagttattgacttagaattaattgttctttaatatatgaagatatttaacattttatattttaatatattttaaatatttatattttaatatatttaaaacacttatattttgaatagaaggcttatatatttaacatattttatttatgtcattgatttaaatgatgcattatcatttaattcaatatattaaatgatatatttaatatattttaaatacttatatttaaaatacatatttttatattttaaatatatttacattaaatatatttaatgaatataatgtatttaataatatatttatttaataaatatgtatttaatatatttatataactacataaattatattatattttaaatatatttaacatattttaaatatattttaatatatttttaatatatttcatttacattatatgtgtgtatatatatatttttgttgttgttgttttgtttttgttttttgaaacagagtctcactctgacgcccaggctggagtgcagtggtgcaatctcggctcactgcaacctccgcctcctggattcaaatgattctcgtctctcagtctcctgagtagctggagttacaggagcacgccaccacacccagctaatttttgtatttttatttttattttactttattttattatttattattattattttttttgacgaagtcttgctctgttccccacgctggagtgcagtggcatgatctcggcacactgcaacctctgcttcctgggccctagcaattttcttcccaagtagctgggattacaggcacccgccaccacacctggctaatttttgtatttttagtatagacaaggtttcgccatattcgtcaggctggtcttgaactcctgacctcaagtgatccacctgcctcggcttcccagggtgctgggactacaggcatgagccactgccccaccccttatatttctgtattttaaatatattttatttatattttagtaaagttattttaaaataaaatataatttgtaaaataaatataattttaatttatacttataaaatataatttgaatataattattaaaataaaatatgattaactttaaataaaatataattttatacattttataatatattttaaatatagtatataattaaatatgtattagatatcatatgtatattaaaattatacattatttaaatatatttctttataatttaatgtttattttaatattaaaacatttcttcaaaatggtataaaatagtaataagctgttacaggtttggatttgcatgtggtacaggatactgagcctaggaggcagctcatcctaagaaatagctgaatatattaaagagtgagatttccttctcaatttcttcaccacacttcataatcttgaaaaggtactgaatctctgtgctcggtaatgaggagtttataaatattcagaattaattaaattttaccatgtatttcaaaatggcttgagcgggtcctcaccaagctggactgcctaacaatgcattggaatcatttcacacttgcttttcttctctttttatttctgggtccgccagtctggctctcacaggatcagactctatgagagggaggactacagaggccagatgatagagttcactgaggactgctcctgtcttcaggaccgcttccgcttcaatgaaatccactccctcaacgtgctggagggctcctgggtcctctacgagctgtccaactaccgaggacggcagtacctgctgatgccaggggactataggcgctaccaggactggggggccacgaatgccagagtgggctctctgaggagagtcatagatttctcctgaaatatgtcctcctttgttgtttcttaatttggaaactaataaaatattttctgtgtgttcctggcactgatttgcttgtgtctttctttactttgccctacttctatcttattttatttacacacacgaggcaaatggcaaccaagatgtgtaatacatagataacaaaggaagttctcacaacagaatgacgtcttcatattaagtagaacttaacagtttgcaaaagtttcataattcattatctcatttgattctctggcctttaaacagcttgctgcttcaaaccagattatcagaaatctgtttagatttcagtttttctttgaggagtgaggacctgaaaacgtaggttcagatagtgtgacccactttttcaatcagggattctgaacctgggtaccataacgcgcgtccatttttgaattctctaaaattgtatgcaaaagttgagttcacaaatctctgtccgactcccttactacagaggtggtcatgtggccttcctctggccatcgaatcagaagtgagaaatgatgatagggagggagaagagatggttctggaaaaacttgtgcctttctaatgaaagagagcagatgaccctgatgccaaagttccctcttatttcttacactcaagaaatgacagctgtgagagaaaggccaggagaatttcagaaatgttggcctagatgtggctgagcccctggaccatgctaacaaccttttaccttcagacttcttgtaatggcagtcaaataaaccacattttgtttaagcccctatagctgggtattctgttatctgcagttcaacacacatttctagctgatgtagagtatatgtgaattttccttaggtaactgtatagaattttatttagagacattcttaattttaaaattaaaaaaaaaaacaaagaaaaaagacgggagaacacacacgtggacacaaagaagggaacaacagacactggacctgttggagggtggagggtgggaggagggagagaatcagaagaaataactattggatactaggcctagtagctgggtgatgaaataacctgtacaacaaacccccgtgacacaagtttacctacatagcaaacatgcacatgtaccccgagcctaaaataaaagttgaaaaaaaaaaaaggggaggagagaaaaagaaagaaagggaaggagggggagagagaggcacagagaggggccattacagaacattgtagttataagataagatggttaatatattttaaatccgtagatcatctaacctagataactcattttatgtacagtaaactgaggtctaattccaaggtcacaccaataacagaggtggaatcagaagccagaatcacagctcagaaactgctggttttctattatgaaatcaggaagattttggccaggtgtggtggctcacacctgtaatcccagcactttgggaggccgaggtgggcggatcaccttagatcaggagtttgagaccagcctgggcaacatggtaaaaccccgtctctactaaaaatacaaaaattagctgggcgtggtggcaggtgcctgtaatcccagctacttaggaggctgaggcaggagaactgcttgagctcaggaggtggaggttgcagtgagctgagatcacaccactgcactccagtctgggcgacagagcgagaccccgtctcaaaaaaaaaaaaaaaaatcaggaagattttataaaatctattgtgaaattttgtgaaagtaatgacaacactaaatcatagattcttaccatgaggtcgttgcaaacaaccaaccaggaattgaattaaaaatattgaataatccaaagctgcattctctgaatacacatgggcacacacatacagttatatatatttatataacctcatccaatgtacgtttgtgtgtgtcaatatactatgtataaggctgtcctacaatatattcacttacattggttcttttcctacctcttattctgtcttatttgtactctcattgctagaattttagaaaggaggagtcactatgtaagtgcttagaggc

SEQ ID NO: 17182 - DNA, 192704 bp, Human
cttgtttgcttaactgaaaactgaagataataacacctatttacatggttgttataagggttatatgaataatgtctggcaaatagtaagaactcaagtaactgtttcactctttccagaaggagattggctgaaaaatatttggagtctcctccagccatattccttggtcagcttctatgatcctctttggagcttaattcttaatccctttattttcacttgcttgttgataacaaagaagaactaattattaatttatttcaaaatgcatgtattatatttgatgggccacactaacagttataaaccaaacaacagattgggaatggggaagtggatgtggtgagttcaatcacatgtctgggaaaagtcaatagtgaagacagagtctcacaattttttgtcataatggagagatgaaaacacaggtagaggatttcaaacaacagagtggatggtgagttaaaaatgctgaaattctttcctggtgtctaacttaatgcaatgtggtttatctctttgctcttttctctactattcaaatttaggataataaagattaaatgtttctaaatcttactttacaatatcaagaaaaaaaggtatgcttttgcccacggaagggcaaagcagagctatgaaaacctgctgaacacattctttattttcaacacaggttcttgtctttccatcatgaaatgcacattttatttgtactgtatttgggtgaccacaagtcaacaacaagataattcacaagacccttgccttagatgtgtcggcaataaagtaatcaggccaaaatttttactttcctttgaatttttcaattcaaacacaatgtatgcttgcttttacacagtagggttcagggattagagggttggctctttaaaaaccgtcagagacacaggcaatcctacacaaaattctcagaaggaaggcgcctacgcctgggaatgcccagatgcccctcagagagttgaagatggcgtttctctgagtcaggtcaaagttaacacattaccttcgcttcaaagactgcttggcttcctttcggtggattagtcaagatgttttgctgactgagactaggaaatctataggagggcgggttagtttacattgttccttgtcattatcgctaaaacactccaaagccttccttaaaaatgcgcactgggctaaaaaggatagacaaggaacacatcctgggccggtaattacgcaaagcattatctcctcttacctccttgcagatttttttttctctttcagtacgtgtcctaagatttctgtgccacccttggagttcactcacctaaacctgaaactaataaagcttggttcttttctccgacacgcaaaggaagcgctaaggtaaatgcatcagacccacactgccgcggaacttttcggctctctaaggctgtattttgatatacgaaaggcacattttccttcccttttcaaaatgcaccttgcaaacgtaacaggaacccgactaggatcatcgggaaaaggaggaggaggaggaaggcaggctccggggaagctggtggcagcgggtcctgggtctggcggaccctgacgcgaaggagggtctaggaagctctccggggagccggttctcccgccggtggcttcttctgtcctccagcgttgccaactggacctaaagagaggccgcgactgtcgcccacctgcgggatgggcctggtgctgggcggtaaggacacggacctggaaggagcgcgcgcgagggagggaggctgggagtcagaatcgggaaagggaggtgcggggcggcgagggagcgaaggaggagaggaggaaggagcgggaggggtgctggcgggggtgcgtagtgggtggagaaagccgctagagcaaatttggggccggaccaggcagcactcggcttttaacctgggcagtgaaggcgggggaaagagcaaaaggaaggggtggtgtgcggagtaggggtgggtggggggaattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttgggtttggggtaaaggaataagcagtttttaaaaagatgcgctatcattcattgttttgaaagaaaatgtgggtattgtagaataaaacagaaagcattaagaagagatggaagaatgaactgaagctgattgaatagagagccacatctacttgcaactgaaaagttagaatctcaagactcaagtacgctactatgcacttgttttatttcatttttctaagaaactaaaaatacttgttaataagtacctaagtatggtttattggttttcccccttcatgccttggacacttgattgtcttcttggcacatacaggtgccatgcctgcatatagtaagtgctcagaaaacatttcttgactgaattcagccaacaaaaattttggggtaggtagaaaatatatgcttaaagtatttattgttatgagactggatatatctagtatttgtcacaggtaaatgattcttcaaaaattgaaagcaaatttgttgaaatatttattttgaaaaaagttacttcacaagctataaattttaaaagccataggaatagataccgaagttatatccaactgacatttaataaattgtattcatagcctaatgtgatgagccacagaagcttgcaaactttaatgagattttttaaaatagcatctaagttcggaatcttaggcaaagtgttgttagatgtagcacttcatatttgaagtgttctttggatattgcatctactttgttcctgttattatactggtgtgaatgaatgaataggtactgctctctcttgggacattacttgacacataattacccaatgaataagcatactgaggtatcaaaaaagtcaaatatgttataaatagctcatatatgtgtgtaggggggaaggaatttagctttcacatctctcttatgtttagttctctgcatgtgcagttaatcctggaactccggtgctaaggagagactgttggcccttgaaggagagctcctccctgtggatgagagagaaggactttactctttggaattatctttttgtgttgatgttatccaccttttgttactccacctataaaatcggcttatctattgatctgttttcctagtccttataaagtcaaaatgttaattggcataaattatagactttttttagcagagaactttgaggaacctaaatgccaaccagtctaaaaatgcagttttcagaagaatgaatatttcatggatagttctaaatactaatgaactttaaaatagcttactattgatctgtcaaagtgggtttttatataattttctttttacaaatcacctgacacatttaatataggttaaaaaatgctatcaggctggtttgcaaagaaaatgtattacaaaggctgctaagtgtgttaagagcatactcatttctgttctccaaaatatttcataaggtgctttaagaataggtatgtttttaaaagttaagttcctactatttataggaactgacaatcacctaaaataccaatgattacaaacttccttctggccttctggactgcaattctaaaagtgtaaaaaacatattttctgcattaagttaggcagtattgcttagttttcaaagtggtaggctttggagtcagattattttgattcagatcctacatctactgtttagtagctctgttgcctgaggcaggtcccttaacatctctgtgtgtgacttgacctttaaaatttggagactgtcataggggttaatcccttgagaaaatgaatgtgaaaagttagcctaatgttaactgctattattatggattaccatattttcacattcatcacagtacatgcaccttgttaatataagatgctcaattcatctttgagtataattttgtgactctcaatctggatatgcaatgagtgggcctgtatgagaatttaatttatgaaaaattgtgtttcacatggccttaccagatatacaggaaacacgtcacatgtttctattgtatgttgttaaatgccttagaatttaactttctgaataggatcccttcagtttgagagtcataaaagagtaaaattattatggtatgagttatagattgtattgaatatctctttatatgtctaggttttgtcattggaaaaccaaaaagtttggaaaaaaaatctaagttatttcttactttcttaattttgtgtggatttcacatcaagtataaaatttgaagaacatctgaactatcataatccatatatatatataaaataaacataatctaagagagaatttcaccatgaaaaattcaggtagttcatgactatcagagcaaacaagtacattaaattgaaacttttatgaaaataacatttatgaaataggaagctatttttaaactagaagtgatatattagcatataatttataattcatatacaagtgggattgatttataaatggtcaccaacagagattgtgctatttaatttgggaaaattttttaaatttacattttctcacaacttttaaggtagttattcagtttgttcctctctgtctcttctctcatgccctgaatttttcatatttcgtttagttgtaagagtgtatatcaaaccgtgtgtcacatgacataacttgaattttcgtcgtgatatctgtgctatgtctaggtctatactgaggaactgtgggaaccccacagaatccaagtatacagtgccactgatttcttacaagggatgtggggtctcctgtaaactctgcagttagtctcaagtaagaccaaagagtaaaatattgttaggatctaaggtggaaattcagcaaagaatcacatagtctaagtctcgagtttaacagtaagataatttgagatacttttgtaattattaaacacaaagtaatgagagattttaaaacaaacaaatacacctgaatttatatatcagaataggtatggtggttcaaaatagctatctaataaaaaccacactcctattctaaacatttgcctttgatcaaaataattttgggtctcttattatgaaattgcctttctaaataatacataaatttcttctcataagtatatattagccacattattttattgttattgttttatattcatagcttgctttagattaaaaattatattacccagactggtctcttggacttgcttccaagtgacttttgactgtatcacaaaatcaaattcactctgaaaatataaagatttttcatcataatttcctttgttaacagccaagtgctacctaattttaggtgttttcattaaaaaaaaatgcattgcaaactttaaagacaattcttttgtttgtttgtttttaaaagacagagtctcactctgttgcccaggctagagtgcagtgacacaatcataactcactgcaacctccacctcctgggctcaagtgagccttccatcttgcctcacgagtagctgggtcttcaggtgtacaggtgtgtaccaccatgcctggctaactttttttttttttaagttatatagagacagtatctcactatgttgcccaggctgctcttggagctcctggcctcaagttatcctcccactcagtctcccaaagtgctgggattacaggcgtaagccacctcaccctgtcagcctaaagacagtgcttaatgaagagaaatataagtgctttgagcaatggaagtataattaaaattatactatgaaagatttataaagatgaccattttgaatgggaccacacttatttggttatataaattatgatacactattaaaaattcatcatgatgattttgtatttacattttatttacatgtttgcaatttgtgaggaaagctaaaattatggctaagccataaatatttttgcagtttgttgagggtgtttgtaaaagtgttgccaaggaagaccagttggctacccaaacaagggtttagtctaggtctgatcaatacatacacattatctcaggtttgtctatcagaaaaaccttaggttatccaaatcaaaataaaatagatgcataaaacaaaggccaatatgtgttgaacaattatattgtgatatacaactgccaagcattcccgattaccatgactccatttagtcagtccatgggcaaatgccatcaatgaggacagcccagggtttccatattctctcttggctttacatcctataggaattggaggggcccacctctgggataggagcccttctgtcttgaacaatgttgtctgaacactaacaaatgttgactttctacaccagtccctcaatagtcttttctatttatccttttgctgaccatgttttgttattacacagttgagatttttcagctgggaatctgtgttaattttgtattaattttgattagcttaactctcagagttctaaaagtacctcctgtacctgatatatgacaaaaattataattacatttatttatatataaaatatctttgtatatgtaaaatatctttgtatatataattatataattgtttcttttaattttgcaaattttaaaaagttctcctttgttttgaagtttattcctatagttttttatatgctagttaaattattaatcacttgattcaagtaatattcttatatacttataaggaatagtgtagttttaatatttaattccttgctaaagagagaagtggaatctatttttcttagctacttcatcaatattttatgtttgatgtgacagtcaaaatatccctcagagctaactgttacactagggaaatcacggttttccagttttccatttatgtgttatgggagggagtggaacttagtgtaataatattcaatacataaatgttaacacttgtttaaaggtccttgagtgagtactgctataaaatgcattattattgctagtgtcatttcacaagagcctataatttcagtgtgatagagctacaatataagtatagtattgcaaaaccatcaggaagggtgttaactatttagcatgcagttatgtgttggttgtcaaaacgttaaaaacatctctgactcagcagcaattttggcaattttgatcctgaggcatctgtgtagggcatcttcctggagaaaaacctctgagatgcaatgaggtcaaaaggggaaaacagactatgataaagatcaagttgtttggagatcttgtagaaagattaatttacaaatatgtcaagtgcattatcatggaggaaaacattgctatttctgttggttctcttcagagctctagaatcaatttaccacatagttgtttcagtgtgaaattagcattacagagtggctttacggctttactgtagggcattgtgtcagcaaagagcttaggcttcttttagcaagaagcttgtaaaaatttaatttactcttagattgcttgatgtagagaattacattcctacagagctctgaaaaatcttttttcagagtttttcacagctgtattcaagttgcaaggcttgtcaactttgctatttttctgtgcagctctgttaacttattattatcttttgacataaattatgattccaaattgtaaagctctggatgtcagggccttttctaatttgtttagtatgatattcagaccatttcaagactcttccgtggaacaatttaataaagatttttttgtgatgttaatgagttcatggtgatcaaccctagagacctgtgtctattgtagatcgatgacattcaacagtcctgcagtgctggcatcattttgataaaaaggggtcaaagcaagtgggactgtgggcagatttttaatgcttagaacaattattccatcgaagttttcttgtgtcccttctgccttagcctttgtaggatagcatgcttgctaatttcttgctcatggggtaaggaaatgaagatttttgctaggtccgtaggattattaggactactcaggcctgaagctatgcctggatatagccagaaaactctcccatagcttgctccaaggagctgagatacagcagtacttcctttgtaggtcatgattctgggtaacctggaagatgacctcattcatattctgtattctatgtgagacgttaagaaggtagaggtggccaagaaggaaattgttgctgcctttatggaacaaattatctgaaacccagctttctcgagggcttcattgaagtactcaactggggcacttaacccagtctaaggctggtcaaggaaggcttgctgggggaagtgtcttttgtattcacacctaaaggaggttattcaattagaattatccaaagagggtagggatgggctaggaaaaatttaaacaggtagtgtggaggactgacaggataagtaagcatggcaccttcaaaatatcctgagaagttccctatgacgggaacataaaatatgtgacagagatttgtgggagatgggtctggaaactctagcaggggccagatcgtaagggggctttgtaggctttgtaggctttgtttgggctttatcatactggaagtgaaaagccatggcttttaaacaggagagggacataatcagttcatatactgttgcagttttgtaaaagaaaagatgagctgaaagagtggccatggtggaggtgggtggggtgggggggagggggcggggagagagagagagagagagagatttgaaagacatttaggaggtaaaatcaactggtttggtaatcaattagtagttgaaggtgaaggaaagagaagagttaaggataacatctatatttgttgatttggataatagaggggacagtggtgctgcttattgaatgagaaaatttaatcggagaagaaggcatggagcaggagtgcagacctatgtgactctacttctctcaaaaccagaaacggaaatgatgtatatggctcagggttaggtaatatggttatttgaaaatgtattaaagtgatttagagcttagtcttaggtaagagatataagatgtctgaggtgacagttttataaatatgtagagtgcccacttgtttggccttattgtggcatagtgtgacctgagagtgttaggaagaagcagctgagttctagggacagtactggttaaattctacttagaaattatacttagaactctcctatataacctgctaactgatgtctgaacctcctgataacttcactcctttaggcagtgcttttcacatcacgggacacaacatatgagagatcatagaaattcaatgtggtatgaaaatctgcttgggacttcagatattgtctccagtgattgaataaaaataggagctcacctactatgatgaggtttctgtgtgtgttaaaagaaggttttcattacttttgaaaaggttatgtatccttgttttatgttaaaactttgagctttgttaaatatgcagagttctctttcttagcatggactacagaggtgcaactacctcctacctgacttcacatctactcccaaatgcctagtgaaggcttaataatttcaaaaagggactctagaatttcatttgataccagtcagacaaatgtgtgaaaattaagcataataggcagaatcccaggggtactgacagctgtattaagaggtgattcaagggctaaaccttagagtccagcattggttatgggtgtgacaagaaaatgaagcctatgttggctgggattagcaaccacagttctagaggaagcaaggtggagaaactatatagggggctccctttgtacgttttatttattttaaacatctctataaactctagaaattaaaacaacaataccaacacaaaagcatcactttttcgaccaaagaccattgctatacttttttgtgtaaagggctagatagtaaatattttcagctttgtgggccacataagtctctgcaatagacaatatgcaaacaaataagcatggctgtgtttcaattaaactttattatgaacattaaaatttgaatttcatataacttttacatgttgcaaaatattctttatttaaattctattgcaatatgctttaaaagatacagtttttagtctttcttagtttaaaataaaatctagaaaaaattttaagtcttctataactttttttcggtaactgaataattttaaaagtaagtgaaacatttagacatgcaaaatggacttttcagaagaagaaaatggtagcttaacagttattagattattgtccagaataatttttgacttataagtctctgttgaccatttcattgcctctttttttggaatatgcatcttttaatgtgtccttcaaggcaaaggctctatcttatctatcttgtgtcttgcattttcccagggcaatgtttttcacaatttttttaaaaaacaatactgtaatcaattttcaaataaaattttccatgggaccgcagtgtatacaaatagcagtgacaataaaagataataactctcccataaatacaaagaaacagttaacctagtgctctaaagtaaaggctacagtgattttgtataacatttatatgtaattttcttgatcctacatggttgtgtttttcacagtgttatgtttctgaaatcgagatgccttttataattgatgtcaaaagaaacttgtcagccacaaggcccaggaataagttgtaatatgggaacttagcaatacataaaggtatatatactcctgtgacctcagctgaattatttgcattggttgcatcccacaaggttgactcttaaataaatttagtttgttgcttgaaatttcttgggataaattactttgtgatgtagttttgaaaaaaaaacaggtaatatttagtctgaagtttgtctgacatactaagcaatgtaattaaagtagaagtcgcctaagctcagcactttattatgccttgaaattatactgcctgtcctacaggtgaaggtgttatgaatgcagtttgtcactgtaactctattcatagctctgaaaggctgagagtgactcagaagaatatttttgctctgaatatgaagaacgcttagactaaaactttaattacgatgctgaagaagaaagtggtaggtgattgcatgaataagtatgtaatattgttaatttctaaaaactgtgtatagttaatgtagtgcttctttttggaaaggctattgttaaattgatggtaaattctataaccaatatcaccttaaagcaagtacgcatgataaagtattataaaaccatgataatatcatatgtggcttattattgttccctgagtgttgtacaactctgttatgctgtgatgaaacctcatgcaaacaggtatgtcaaagatatgatgggctgttaactgagcttggcccacatatggtgtagtgacatgctcactaatgcagtgcagagataaccaataacagatcataacaggtttaaatatgtgcaaggagatgtcagcagaagctttcctacatagtgaatactaaacaagcctgacagcccaggatcatgttcggatcaatctagtgtgctaaaattaacatatagtcctacatttgagaatgtgtgattttcttggttcctgtctataaaataatattttaaaatacatacatttcaaatcagaagttggtgaattcactgaaatatttctagagaacactaggtattggggctcatagtgtgaaaaccactgacttaattcttcccccatcttggttgttcctgatcttcccttgtgtccccattccagccatttgtatccttagaaaatgatctcatattctacttcatctttatcttcattgtcaactgtcaggtagcaatatatgatggaagaagcatgtactttggaatcagacagacctggctggaatcctaactctgtcacttattaacaatgtgatcttaggcaatttacttaatctctctgaacctcagctactctcgtcagtacaatgagttatccttatctttacatggcacagtattattatgatatcaaaaattcattgagtatttactctgcatattagtcaaggttctccagagaagtagaaccaatgatacacacacacacacacacacacacacacacacacacacacacacacaatttattataaggaattgacttacatgattatgatggctaacaagtccaaaatctgcagtatgggtcagctggcaggaaacccaggagagtcaatgttccagtttgagtctgaaggcagtctgttggggaatttcgtccttctctgggaggccagcctttttgttctatacaggccttcaaccgattggatgaagttcacctttattagtgagggcaatctgctttaaccaaagtttactgatttaaatgttaatctcatccaaaaacacccacccagttgacacataaaattaaccatcactctctgtaagcactttctatgcattaagtgatagcaaataatgccagacatagggcgtctttaataaatggtaagcactgttatcagcaacaacaggattattataattagcaccttttcatctttctgtctgggctctgagaaagtacctctcttctctaaatttatccctcctttcctatgaattagacccagtgctttctctgaattatgaaggtcacactcctacaaatgccccttcccaattgcacatctgtcggctttctttgccattgacttttatctctagcttttaaatttacaggcatatgtcagttaacaatgggaatgcgttctgggtaatatgtccttaggcaattttatcgttgtgagaatactatagagtatacctacacaagcctagatgtcgtatagcctactacacacctaggcaatatgacatagtcttttgcttctaggctacaaacctgtacggcttgttactatactgaatactgcaggcagttgtgacacagtggtatttgcatatcggaacatgtctaaacacagaaaaggtgcactaaaaatactatgtagtgatctcatgggaccaccattgtatatgcagtctgctgtagactgaaatgtcatgcagtgcataactgtatcttaaatactcaaagtatcacctttgtttgtttgtccccttgtgtgcatcatcctaacgtggaatttctctgttgattagggccagcgtattagtttgctagggctaccataacaaaataccacaaatttggtggcttaaataacaggaatttattatcttatggttttgaagactagaagtacaagatcaaggtgttggcaggtttttcttctaagggccatgaggaagagtctattccatgcctttcccctaccttctggtggtttgctagaaatccttggcattccttgacttacagaggcatcaccctgatctctgttttcatcttcacatggcattctccctgtgagcctgtctctgtgtccaaacttctttactattaatataaggacaccagtcatattggattagggtctactttagtgacctcattggaatgttattacctctgtaaagatcctatctctaaataaggtcacatccttaggtaccgggggttaggactcaaacatacctttttttggggaaacacaattcaacctataacaattgataacactctttaggagcagaatgcgatatggaagtaatttgagaccataaagtatatacatgtagggagttaatctatgaaacctattgaaagccatatatacctcatgtatagtggtccataaatagcatggagacattgcagaggatgttaagtgatatgatacaggaacaatccaagaaggtcataagaaaaaggaccttttgctcttgagaggactgaagaatgactttccatttatgaaattttggtacatgtccactaaaaataggatgaaggccaaacttaggaagaatattttgataatggagaaggttgcatataaaaacattttattgaggacaattaaataatgttggctggaagttttaggatgatcatctttaggactcagaaaaagagaagaaacattattaaagaattgtccctgaacaagtataggcaccctcacatttgcattgcatttactatagaattgaaaaatgttttgaccttttttttttggcttttaatatatttgaccaagagtaacagctaagcaatacctatttgcaatcagtgtcatcatgtgggctccaaacatatcatgtttgtgtaattaattgattgacccattaatttgttcaatttctgctctgttccaggcactgaacaacatgatggagataaaagataaatattacacctgccttgtcctcaagaagttagtcttctgagggaaagaaattagcaaacaaattgtaatctcagttatgtgccatgttccatgctgggcacaggggatacagtagtttaaaaaaaacacaagatctataaggtgtttcttcttgtggaccttacagtctagggtgcttggaaacatggggcgttggcagacaagtaaatacacattttgtggtaaaggctcaggtagaagaagtacaggatagaatagagcacaccatggggaattaatctagacttcagagaggctcacacatacataatttatgtgtgactatttcaatgcatttgaggtttcttggaaatagaggttaggttttattttaaggaagttaccattttttttttcagtgtgatgtggttgaaccaaagaatgccatgcccagtgatggtaataggataatctttttaaaaattaagagccacctaataaatcaatagtttcattcagcgggagctcctgcagagttcaaaaagaagagaatctggcacagcgtttcctttaaagttcattttcctagagtgtgaatggaagcaagagattataacattttgaggtcaaaaaaattctgaaatgcctataaaaattattttctccaaattatcatcatttgtgcttttaatgacctgattgcaaagatgaacattttgaattcttaaattgcttattaggattggttaatgaatcaattatctattactgtatgttttgctattggaaaaaatagcaacttaagtgttttgcagacctttacttaggtatatgttgcttttatgaaaaaaaagatgtaaatattaagtaaaagggatttaaagcaaggcttttgaggtagagtcttattaattccttggtaaaccttgagccaattgttgtctatgttctctgcctctgtcttgctccttccttctgggattcactgtgggaatgcgggattgttaatctggggatgctgtccaatcctgcctctctcaagctttgctattgatctccctcccagtgataataaagcttgaagaaaatgaaagtagcgttagtattggtcctcaaactcaagaacaggatgaaacttaaatcttgagtcatacaattgtgtctacatactgctccccaaaaagagaagtaaagaagatgctaactttcccttttaatttgcagtacttagcaatttgttttcttgagggttaagtaataacagtggaagaaaaaagggttaaaatgccaccaagaacccaattccatgtttagtttgaaagtgggaaatcagctgccactgggaagtctgaatccaatgccatgatgttctttgaatccttctgagaaataatcatgtgtagccataacatacctgtataacagagcagagaacataaacaaatgaaggtgaagggaagattaagacagaagagaaaaattccagaatcgactgatcatttttatctgtttagatgatttcaggcagaatcctagagaccaactttatcacaactgaattttaaaaatcaccagctttgtcattgtgatgcagcatcagtttcagtattatccttggagtattaattcttaatcatcttcatcttagaacatttttgaggtcacttctagtctctatttcaccagtgaagaaacaaaaatccccaaactatatcaggtggaattacacagtattttttttttaattttggggaaagtcgattcaaggcagtaacttgcaagctagtgttagaaaggatttaataaatagtggtttttctgtacacatagtgagaggtcattacatcatttggttgttgaaagtcataaggatgtctagcatgcgctttgcctgtagtggttcatgccaggcagattcctgactcctataacccagagcttatcagagcatttatgtccccaaagagaaatgtcacctccatctttcaataaacactttagcaaagaaaaatcaagtactttaattccaaatcttgagttaattccagaataacaatgatggctcggaaaaatatgggtatttctgtcaaaggacagagaaacctagtagagagtatttactttgggtcctagtgatggtatctgaacaagctaggtgaacaaagagcctcaataagggattttgaggtctagaaaaagagaggaaataccaaataaatggaataattataaaataaataccagcaaagttaaatcaatatatcatgtgggagatatccttatatcactcatgtgatttctattttgttcctatattaggccaaggagaggtggaacttgttttcctttttccctctcagctacgaatggacatacttaaaactgtttctctgcttctgttctctaaaatgtgattgtctaacagtaaccgtgatgacgttttgacagttgcacaagtttctttctttaagctttaaaaatgccagccagtaacccagtggcatttctactataaaatcttaaggccaatccatttccccttttccttattttcttggtttcaaatatatttttattgccaatggaaataaaaatcctaaattagagagcaatggcatcccttgtcttgtgaataaagagctcctaaatgtgaacttatacaggatgcagcaatttatagggtagttaatcattcttctttctagccagttgttccagctacagttttgtggctcttgttagtggcttcattcccagatagaataaaaatcaaaccaaaatcctggaaaggcactctgaggatgcttctctaaagtagatgggcatcaactataaatcacaatgctttgtttcctctgttatgtttcaagatgggtgggattttttttgtagcattacttattattgcctctcaagtgcttgagtctttgaaatccaagtcatgtgagtgaattagatacagctgttagaagtggcctttcaatgccaatggtacacattccttggtttctttacgatactattgctcttacaacttttatctgaagtcataaattcatagttgtcccagaagttaagttccttgcttctagaggacagaaaacaaacaatttacacaactcatggtgcatgtcaccagtccttagatctcatgaaatatgcatgaaatcttaaatcacttgctgtagccacccagccattgacatatttgaaagactttagtgtatcaaagtcactataatgaaaattttgatttcaccagttctaggagtgaaaaatcaaatgtttagtaaaactttctaaaattaacactgacagttgatttctgtatactgttgttcttaataatagctttattgagatataattcatattcaaaacaacttacccatttaaagcatacaatccaatgattttttagtatcttcaaagagttgcctatcaccataaccaattttagaacactttcatcactgtaaaaagaaactccattcctattagcagtcattccttattccaaatccccctgctcgccctagacaactacaaatgtactttccatctctatagatttgcctgttctggaaattttatgtaaatagaacaaagtgttcttttgtgactggcttatttcacttagcattttttttcaaagattcatccctgttgtagcgtgtatcagtgcatcattcttttttatttttttagagacagggccttgctctgttgcccaggttggaatgtgcagtggcatgatcatgggtcactatagctttgaagtcataggcgaaagcggtcctcccacctcagtctcccgagtagctgagactacaggcttgcaccacatgactgtctaatttataattttctttagagacagggtcttgttatgttgtctaggctgctctcaaactccagggctcaagtggtcctcctcccacagcatcctaaagtgctgggattataggtgtgagccacagcacctggcttgcatcattctttttattgttgaataatatcccacttgtaagaatatgtattttatttatcctttccccagttaatagatatttcgattgttcctaattcttgtctattataaataatggtgctatgaacatttgtgtacaagtttttgtgcagacatccattttcctttcttttgggcatatacctacgagtgtaatggatgggccatatagtaactttatgtttaatattttgaggatttttcaaactgttttccaaagtggctgcatcattttaaattccttccaccattgtgtgagtgtttcaatttctccacatatttgcaacacttactattatctactcttaaaaattacagccatcctactgggcatgaagtggtatttcattgtgagttttttttttctttttctttttttctttttttgctaatgtttgtggattttcttttcattttcttgatggtgtcctttgaagcacaaaagtatttaattttgataatttccaatttattttttgttattgctgtttgtgcttctggtgttgtatctaagtgtatgctactttaaaaaattagttgtaatatggcaaattggatacatgtgtaggctttggtgtcacaatcctaattttaaaattctgactctgcccttgacaaattaactaattaagcttccttagcctcagtttctcaactgtaagttggagatattaccaagacctacctcttgaattgttgtggggatcagatgaaataatgtatgtgaaatatttagaattatgcaagtctgtggtaatgaatactaatgttagctatcattattgttataatcccaataataaattctggtgctttgaaaattaaaccaaagccaagcagttgatatgaagaagcatgtaataatgtacagacataatgctttatagacaacattgaatttggctctcatgaacatcaggaatagtggtcatggtagttattatctccagcaggaactgtagctgagagatcttcagagctttttccaaggcgatatcactgggaaataatagagacaaggttacaagctagggctgtgttttcttcttaaaatctttagttcagtttttttcaataacagatttgtagtaggcatcaggtgactggggattcgtattcttcaagttgaaatattaccttgttgagaaagaaaccatgtgtgagacaaccatgttgagaaagaaaaagtgattttatagaaaattaatattgatagtgagcattatatgaaaatcatgaagttagaacatatttggccagaaaatttacattaatagttacccatagcaattaatgcattataattacacataccttttctttaatgaaaaagaattctttccttccaaagttatgcatgctattgttaaacattagagaatatagagaagcaaaaaagaaaatatcttttttgatattttcttaacatacgtctgttcctaataatgtttatagtttagaagcattgcatgaaatgggtagatcaattttctatttaatgtttggattcattaggtacgaagttagcaaattaatttccattagggtgcctgtatggttgtaaatcctggacctgcagaagatttttcagtattggtttgtagtcttttgtttagcagcaaataattagttctccagagcttctgaaattaattgaccactttaatggtgtttacctacctagagaaagaaaaagaacttctccaagtcccttggtaaaattaagcctcatgaacaattaactcaaatatacacaaggcttgtctttagcgagcatatactccctaaagttgattaagctgaccaagtgattactgcttataaattcaccattttatggagaagaagcaaacactgctaaataccttgtggaatcagaggaggggaaattagtaacttgaccccaatactgcgattttaaattgaattcttgaagcctacaagttttacacaggactttagagagctggatagtatcactttgtcaagtcctacttttactatgattctttgagaaaaatacatctgactaaataactctgaatctaaattggataaaataaatgtgacattcaaaatgttatttatgattttagaaaaatatccttatagacactagatgagttttagtctcaaatcaatcctccctatcatagtcacttatcaaaataactaaagcaaagtggtagagctgtgctctagaagtttgggatttatgatcacaatcttttccaatgagtcccctctttcctctgcctgtcttcaacatttgtttttttttttttttggttaggactatccagattgtgtggcctatttcaaactcatggcaaatacattggatgatcagaaattttctaatgtatttgaatttgtctacacaaactagagtaattgctattaattcctcaagtgttaattatttcatgcaaaaaggaaaaaggctattagtctttaagtgtattagtatgtcaatatttgggagaagtgtcatgcaattagtggtttgaatttcctattttattttattgcattttattttatttgcctagtcaaataaaaagtaatgttaaatacatggaagcatgattgttttctacactaaaaatcattttgacttgaaaagatctgatatccatgaccttcatctgaagttttggcagatgaaaatgtcagatgcgtcttttggattaataaaaggcaaaagtcagatcgaaaaatgagtataagctttaattatatgactttaggaggatatgttatgaaaatcaaagctttaatagtgattataattggcaagttctttttttataaggaattacaagtcactctatacaaaaattggaatttttgtcctaagaaatgaaatttactatagtttcatctgtgtgtgtgtgtgtgtgtgtgtgtgtgtgtgtttaaaaaatcaagtgatagggcttttcctcaataaaatctgaaatctcttatagttaagtgaacagaacagtgtatctaggatgctagacttttttttcaaagttagtttaaaacttatacatagtaaaatctgtatgccttagggatctctgtttgctatcccatagtgaatgattaattagtttctgttagaaatagtcagaactaggctgggtgtggtggtggctcatgcctgtaattccaggactttgggaggccaaggcaggaggatctcttaagcccaggaatttgcaaccagcttgggcaggctggtgagatcctatctctacaaaaacaaacaaacaaacaaaggacaataagaaagaaagaaatagccagagctttgaacaaaatttctaagtagaccaatgtaaaagtctgtcgtcaatatgtagtggctatgaatggaggttatgaatgaaagagaaggataagatgaactagaggtgagaggggaagacagcaggcccaagtgaaaggcagagccgagtttattgctttttggttattccaggtgtgtctgctttgtctcatgaaacacctggatgatcactgatttctagtggaagaaatgctgaaaagtccttactgtgcatttaaacattctaggtttaatatactcagggtttttcaaaagaaagggtggctggagttttgcactaactaatatttcataaagtgtctaagtatagatgtctggtttttttttgtatttctaagactggcttgaggtaggcatggagaattctttgatgggacataattttcttcctttctttttttttttttttttttttttttgagacggagttttgctcttgttgcccaggctggagtgcaatggcacaatctcggctcactgcaacctccgcctcccaggttcaagcaattctcccacctcagcctcccgcgtagctgggattacaggcatgtgcccccatgcctggctaattttttttgtatttttagtagagatggggtttctccatgttggtcaggctggtctcgaactccttacctcaggtgatccacccacctcggcctcccaaagtgctgggattacaggcgtgagccaccgcgcctggcctgatgggacatatttttcattcaattttattgatttaacctcacaaaataaaatatttccttaagatgactctgtggtcattgttgggcagcataagcttaatggattttagttatcataatttaccttaaacccaatttgtatttcaggatataaatagaggtttattgtagtgaatcttccaggaaatactaagtgatactaataattatagatggtgaacttaagtctttatattactgaatttgtttggtttgatgatgctaggctatggcattcttgctaatcaaaacgatgtgtcatggtgtaacataacttattaaaatgggcacagataacacaggaagctttttataaaagcagctcacaaattgtgttactttgaactgaactggccatttatgggaaaggtcactgggttgtaaataaggaccaaaagagttacgtttatattttttaaaagagattgaggagatttatttttacatttcttgaaaatgccttattttggtatggtattgacagatagtgaaattctgctcatttgtaaatatagtgtcatattttaataatttcaaacatattgaaaatgcagaatttattaatagtgggagcacattttcctttttactaaatgttctacaggttcttttctttccatccacacacagtgccattaccctcattctaagcctttcaaacatctggcagtaagtgatctgctgcacttagctctttccagctgagctgatttttaaattttcagaaaatttgtgagctaattgttaaacatggccattattaaaaattaaattatttcaacttataattaaataaattatattaaaacaaaagtattaaaaactcaaaagttggctgggcgcactggctcacgtctgtaatcccagcactttgggagaccgaggcaggtggattgcctgaagtcaggggttcgagaccaacctgaccaacatggagaaaccctgtctctactaaaaatataaaaaaatagccgggcatggtggtgcatgcctgtaatcccagctactcaggaggctgaggcaggagaattgcttgaacccaggaggtggaggttgtggtgagctgagattgcgccattgcgctccagcctgggcaacaagagtgaaactctgtctcaaaaaaaaaaaaaaaaaaaaaaaagaaacaaaaaaaaaaaaaaaacaaaaagcaaacaaacaaaaaaacaaaaattatcacttcctaattattttgcattttactattatctatgctattaacgttatttgccttcattgtatttgaaaggtggactatattctattgcactttcattgtactatattctaatatgcaactgtgtatcccttcccaactctgtgttcaatgactttatatttggttgctttaaaatgatgacgatgagagtatttatatcatagaaattggcaaatgccgtaagtcagtttttgtttttgtttttgttttccggagaggggattgttaaatatttgcctgcatgcaacaccactacatgcagtctgctatcttttgttcttcctgctttcaggctcctctcccagctgtctgtctagcacaacccagcataccaaattttcttaaatagggaaagttgaacatggtaaaagaatgaatgaagtcaaaagaatgtggaaagacctaggctttgccatttagtaaagtttagcatctctaagcctccatctctttatcaataaaattgagcaatgatcccttttagttctacccatttaagaagattttcaaatgaaaaccacaacctgctcatgtttatgaaggcactttggaaagcgctaaatacacgggtttttattagtagtaaacacttacttcacctttttcacttcttgactttagtttacaagggctcataatctaaattatatcataaattgctgtcccagatttttttacagcctaattgccacctgtatgttcgactttccttctgttctttatgttagatactgggatagtatgcaccaggtgggtgtgccatcactttctcagatgatgtccactgaagaccttgcatgatcatggcattcattttcctgctgtattcagactggcctcaactattttctttattgctctccaggaaaaattacaaatgaatcagactgggcaatgaagggtaaacctaattatcgctctttgttaaagacagctcttgttaaaatgcggatattgcaaattaatggaaaaaatatgacatagtaaaccatactcacttattaatatcttagtaaggaataattgatgaagttacttaaccttagagccctaattcagttaagttttaatgaaggacaagttgtagagatatcgagaacccagggcaggtgcctactgaagaagttccagaccaaggaagtataaagaaggacctgggtgggagcagtgagattggatatgagggccactggcaaagttttgccccagaacagtgtcaaaatgtttgcatttggcatagccctttctctttttgttctgaatggctttgctagaatatcttttctataatgaatttatcctgcttctcagatattgctaaagcactcccttttgaattttggtgctttaacatgcattttgatacattaccaaataaggtctgaatgacacaaattttagaactctccagagaaaagaaagatgctgagggaaaaagcataggtttgggactcactaaatcccagttcaattcctttctttaataaatatattcaattttacctgagaaagctctcgtgctctcgaattttatttagaaatttctctttgtacatgattgatttcacaatccttcttctgcctcctcttctactttcttctttctagattttcctatctttatgaagattattctgccttatcctcaacagttagaaacaatatttttgaaaatcactacggtatcctgcatagtgatttcccatgccaactttactaatttccattataaattattatttattgatgcctagagggcagatgagtgtagctgctatggagtgaggagacaaaacataagaaagttatgatcctaccctcaggtaatgattcagacatgataattaagtcaacaaattgatagaaactaatcactaactctctggctatagtcattctttcaatgaatagctcattactgagtatgcatgctacagtaacaaaattatataaggctgttgattaaatgttgattaagtgcatgtcttattcagagtttttttatatttgaaatggaagaggctggacttcagtaatttgctataaactgctagtatatgattatttgggggcagttattttttaaagaataatttaaatatggaatgtttagcagtttgttttttccctgggaaaaaccatactattattccctcccaatccctttgacaaagtgacagtcacattagttcagagatattgatgttttatacaggtgtagcctgtaagagatgaagcctggtatttatagaaattgacttattttattctcatatttacatgtgcataattttccatatgccagaaaagttgaatagtatcagattccaaatctgtatggagaccaaatcaagtgaatatctgttcctcctctctttattttagctggaccagaccaattttgaggaaaggatacagacagcgcctggaattgtcagacatataccaaatcccttctgttgattctgctgacaatctatctgaaaaattggaaaggtatgttcatgtacattgtttagttgaagagagaaattcatattattaattatttagagaagagaaagcaaacatattataagtttaattcttatatttaaaaataggagccaagtatggtggctaatgcctgtaatcccaactatttgggaggccaagatgagaggattgcttgagaccaggagtttgataccagcctgggcaacatagcaagatgttatctctacacaaaataaaaaagttagctgggaatggtagtgcatgcttgtattcccagctactcaggaggctgaagcaggagggttacttgagcccaggagtttgaggttgcagtgagctatgattgtgccactgcactccagcttgggtgacacagcaaaaccctctctctctaaaaaaaaaaaaaaaaaggaacatctcattttcacactgaaatgttgactgaaatcattaaacaataaaatcataaaagaaaaataatcagtttcctaagaaatgattttttttcctgaaaaatacacatttggtttcagagaatttgtcttattagagaccatgagatggattttgtgaaaactaaagtaacaccattatgaagtaaatcgtgtatatttgctttcaaaacctttatatttgaatacaaatgtactccctgggaagtcttaaggtaatggctactggttatcaaacaaatgtaaaaattgtatatttttgagtacctgttacatgccaggtagaatatctcctctcagccactctgagtggaaagcatcattatctctattttacagaaaagcaaactgaggctcagagagataatatactttgccagttaatgaatgatggagccatgattccagctgaggtctgtattgccttgctctctaggaatggtagtcccccccataaagaatctctcagtttcctttccaatcaaaaggttaggatccttttgattgccagtgacagaaacccaatttactagcttaagtaaataaaaggaacgaatttattggctcatgaagcctgaactatgtgaagacctaggtggagaactggccttaggaactcaatgggaccaaggactcaaatgccacctggtggcatttgccttatgctggttttattttctcagaccggaccagctttctacataaagtgggtccctggttagaactctttgctcctatctttaaggaccacgaaagaaggagccctttgtccttggctaaatgtgaaaaatcccagagactcttgagtcatagtgcttaccccttgggccactcatagtctagaatgaactaggctgagtctcgtgccaacagcacaggcctgatgccagataaaagggtgagtgaagggggataaaaaataagacatagctactaaattattgcaccaaagtaaaaacattgagttgacttgcaatttgtttcttttaattaaattcatttcctttttttggcattttgaaggcaaagtaagatattaaactttatttttattgattttattcaaagaattaagctagtgggagtagcagattcacacttctaagatcaagggccagcttctattattgaacacttggtgtgtgcaaatgccatgaggtagggatactttgttttgttttttattttttattgggttcgatctcttttgtttatgatgtatccccaagtgcctagaatagggcctggcatatggtatatactcaataaatatttgttgaatgaatccatgatggaatgtgaaatggctagcattacatagaaacctgtagcattgctggagagataaaatatataaacataatccattgcaggtatattgacaagttcaaaataatataatgggtattgaatatctaaatgtttgttgttgttgttgctgttgtttttgagacagagtcttgctctgttgcccaggctggagtgtaatggtgcaattttggctcactgcaaacttcgtctcctgggttcaagtgattctcctgcctcagcctctcgagtagctgggtttacaggcactcgccacaatgcctggctaatttttgtattttagtagatgtggagtttcgccatgttggccaggctggtcttgaactcctgacctcaagtgatctgcccaccttggcctcccaaaatgctgggattataggtgtgagccactatgcccagctttgaatatctaagttttaattggatgctgagggaatgattaatcagagtagggctgggttaattgaaaaatgtgatacatttgtatttatggccagatagagaacatgaatctgaatttgcagaattatctggcttaacatttttttctttccagttttcactgtatcccccatgttgattcaatttaaaaaatatacctattttacttcaattcaacaatgctatgccagtacaaacccatacgttctattatttttgttttgttttgtttttgtatctccaccctgttacttcttttcttataaaattggtatttgaaatttattgaaatattttggaagagtgacataccatttttggtactttgtacctctgcacccttgggaagtgaccctggcttcacatttcataactgccttgtgaccatggccctcaagtggttgccagatggttgaagaacattaacctatctggctcaattttgtgaccatggattgaatcctctacataactgcagtgtgcaaaccacacatccgttccaagattgtagtcaggatatgaactttttaagaataaaacttcttcccttctgatctgggcctggtatgtggtcctactagaaccacatcacctactcttggtgctaacaatttgtggcaccaagttgttcaagtttcacccattaaagaaattccccgaccttgccttctcctcaggtaactaccccattctattttttctttcatagctaacattctctgctctcctggtctctctacttcactttcatttacatctcagctcctgaagtatggtttccaccatgttcctaaaactacattgcccagggtcactagagacctcttatgaaatataacaacacctttctacattacttccgtgtggaccactttttcacattgaacccattttgttggtttatgtacacaccccttccttggctttcccatctgatccatttctcctttgatggagaaggtgagtctgctccatatttagcttcttactctgagtaaccaaatgttatggatgggaggttagctctgtgtgtgagagaaaggtggagaagcatgtggggagggaaatagatgggaaaaggtaattaggctttatagaagggctctcattagcaagcttctaggggatgccaagatccatgcttagagattgccaggcttgtcttcaaatctcagctgtgtattactcctttatgttttttgtttgtttgtgttgtttgtttttgagacagagtctcgctgtgtcacccaggctggagtgtagtggtgtgatctcagctcactgcaaactctgcctcctgggttcaagcgaatctcagtctcctgagtagctgggactacaggcatgcaccaccaggcctggctaatttttgtagagacggggttttgctatgctggccaggctggtcttgaactcctgacctcaagtgatctgcccgccttggcctcccaaagtgttgggattagtggcgtgagccactgccccggcctattactcctttagagtgatttagagccatgtttacttatggtaacttgacagtaatgggaataaccactgatgaaacgtaaagcctttgtctaattgtttacctagttcttccttgtggttcatgaaatttttcatctctgtacagtttgaaaattaagatgataatatttagagatattttattcctttgtgaagagaaaaaaggctttcattaacagaaatcagtggcaataacttaataaatacaatcagctggtgttcctatagtatttaaaagaaaacagaaagtttactagatttcagccagttttcagactatttaatgtctattcttactataatagaaaatatataatttgatcttgttctcatttttcaaagacctttaatacatgattttagtagttgaaaatgaagtttaatgatagtttatgcctctacttttaaaaacaaagtctaacagatttttctcatgttaaatcacagaaaaagccacctgacattttaacttgtttttgatttgacagtgaaatcttataaatctgccacagttctaaaccaataaagatcaaggtataagggaaaaatgtagaatgtttgtgtgtttattttttccaccttgttctaagcacagcaatgagcattcgtaaaagccttactttatttgtccacccttttcattgttttttagaagcccaacacttttctttaacacatacaatgtggccttttcatgaaatcaattccctgcacagtgatatatggcagagcattgaattctgccaaatatctggctgagtgtttggtgttgtatggtctccatgagattttgtctctataatacttgggttaatctccttggatatacttgtgtgaatcaaactatgttaagggaaataggacaactaaaatatttgcacatgcaacttattggtcccactttttattcttttgcagagaatgggatagagagctggcttcaaagaaaaatcctaaactcattaatgcccttcggcgatgttttttctggagatttatgttctatggaatctttttatatttaggggtaaggatctcatttgtacattcattatgtatcacataactatattcatttttgtgattatgaaaagactacgaaatctggtgaataggtgtaaaaatataaaggatgaatccaactccaaacactaagaaaccacctaaaactctagtaaggataagtaaaaatcctttggaactaaaatgtcctggaacacgggtggcaatttacaatctcaatgggctcagcaaaataaattgcttgcttaaaaaattattttctgttatgattccaaatcacattatcttactagtacatgagattactggtgcctttattttgctgtattcaacaggagagtgtcaggagacaatgtcagcagaattaggtcaaatgcagctaattacatatatgaatgtttgtaatattttgaaatcatatctgcatggtgaattgtttcaaagaaaaacactaaaaatttaaagtatagcagctttaaatactaaataaataatactaaaaatttaaagttctcttgcaatatattttcttaatatcttacatctcatcagtgtgaaaagttgcacacctgaaaatccaggctttgtggtgtttaagtgccttgtatgttccccagttgctgtccaatgtgactctgatttattattttctacatcatgaaagcattatttgaatccttggttgtaacctataaaaggagacagattcaagacttgtttaatcttcttgttaaagctgtgcacaatatttgctttggggcgtttacttatcatatggattgacttgtgtttatattggtctttatgcctcagggagttaaacagtgtctcccagagaaatgccatttgtgttacattgcttgaaaaatttcagttcatacacccccatgaaaaatacatttaaaacttatcttaacaaagatgagtacacttaggcccagaatgttctctaatgctcttgataatttcctagaagaaatttttctgacttttgaaataatagatccataatatatattcttatggaaatctgaaaccatttgggcatttgggggtaaaaagtattttattagtaaatttaaatgaggtagctggataattaaattacttttaagttacctttgagatgatttttctcaatcagagcaccacccagagctttgagaaacaattttattcacagcttctgattctatttgatgtaatttttagaaaataagttttgctggttgctttgaatcagggtatggagtacagttcactctgatcctatcatataaatcatgtaagtatataacattttcaataagtgattgttggattgaagtgaatgatatttcaagtaattgttatgtcatggccaagatttcagtgaaactcaaaatttctcctggttgtgttctccattgcatgctgcttctattgattaacctaagcactactgagtagaagctggaagaggggtctaattagaaggcccctttctatgctctgcttggcttgtaaaataatttatttctctagatcccaccaacatagtagtttcatgtatgcaaaaacacccacctaaatgtcaaagtttgtatgatacatggacatatctatagaattttttttggtctggtgcatgccaaaaaataaacatgatatagaagaatttaatatttattgagtacctaatctgttccagttcaatatgaaggtctttatgcagattattttacttaattttcctagtaactccatggagcaaaaattatctctaatttatataacaggaagttgagcgtgaggcaaattaagtaactttcccaaagttacacatatggtaagtttgagagatatcccagtctctttagctccaaagcctttgaccctttcaccataccagattatgattgctattaatatataattataattataatgattgtatttaggtactcaacagaatggtgactctagtaaccagccttggttctgctgagcttctctgcgtcttctcaggagacacaggctacagagcttgaaggctgaggattcttccagggtcacttcaggggcaaatctgaaactttcttcaggacaggaatcaacgagatcttctcacttacttatacctgggggaggaactgtatgaaatccacccaagaaccagtcatgctaagggccaaacctatagacaaaaaaagggataggagaatggagtatgtatggagaaagactaaattgttcttaaacttctcaagcttaaaaatatcccagcaaaagagatcgtaaaagcccttcatggcgtattaattatccatgcatgggggtgagtggaaaggtactcctgagcccgaggctacagctttggaactagcagcacctttgaaggggaaagcgtgtttccatcatctcaactcctactgataaccaatggaatattggtgagtaaaggatcctgggggaagaagcagctgaaatgtgtaggtgagaaggcagagagaagaatatttatattgggaatggcacaagtgtgatgaggctgcaggtttttcacccttgtcatagagaaaaaaccacgctgacaccatgcagttttaaatagtgagaaatttgcaaattgttagatcttaaataatttagataaacatagtggccatttagattattgcagttttttcaggatatctgatctcttgatttcattctttttgtctcttataagaataaaagggggggagaaaatttagccattatagtatttctctacattttctctgtccttttacataacttacaccagtgccttcctatttatggtattatttatgggtatttcttcttttctttcactgagcaaggataaatgagccagggattcttgaaactactgtaacacttctcttagaaatagatggtcatactttcagaatctctacacattcttagtccctctaaacaatgatagttgtggcataaaaatatttgcttggtttcaggactgatagagaaaagtactataaaatttgctgttaactgtgaaaggttaaaaaaaaggaggtgccatcatgaaggagctaatctttctgaagtactgctgtagttttaaatattattagctatgacttctcaccattaactatgcacttgctttttcttcatctgactcagcagccagatagatgcaacattgtctttaacatttaagactcctagcaagtccgggcacgggggctcacacctgtaatcccagcactttgggaggccgaggtgggcaaatcacaaggtcaggagtttgagaccagcctggccaatatggtgaaaccctgtctctactaaaagtacaaaaatcagccaggtgtggtggcgtggtggcgggcacctgtggtcccagctacttgggaggctgaggcaggagaatagcttgaacctgggaggcagaggttgcagtgagctgagatcgcaccactgcactccagcctgggtgacagagcgagactccatctcaaaaaaaaaaaaaaaaaaaaagactcctagcatggaagagaaactggctgttgaaaacctgaatgtgagagtcagtcaaggatagtttgagggaagccaagtagaggaagctctcacaagcagattggtgagagaatatgattatacaatgcatttattatgataagaaattcacaagcattcattcaaaatactcttgattcctaggcagctctgggcatatttccaccaacaaattgaggcatatgtcagtgcagcctaggtcagactaccttttttcattaaacctcacaaaattaaaggacatacaggagaagtcctggtactcatgttgcagactacagtctatatggcaaaggaggatctctgtcccttatgtttggatgaaaacattgggtaggcatttgaatacaagcctactgctaatatggggctaaggtctttggccccctaaaggtttgctgaaatattactgacaggaggcagattgataagaggaaaagcacataaatgtatttgacatgtatacatgggagccttcaggatgaagacctaccctctcagtgcagtatggaagcttgtataccatcttgaggttacagaaagaatgggggtttggatctttgtaaaacaggtttcagtggcaagacaggttatgagaaggagaaaggaagagacttgggtagcaaagggggtcttgttttgtaggtaaatcgttggcagcccacagagaaaatagatggagaatgtttcttttcagaccttggcaggtgtcagattctcagttaatctctcctagatttgaaaaaaaaaaaaaaggtctagaaagggagagcctggctgcactaacacattttctacagatgcaaatttctcccacaaaatacagctttgcaggtccacttctatctgctgggcctgtggcaaccatttcaaaatatgtgaatgaaatatatgtgggggtaaactatttttatttacttccctaaagaagggatggtgttctctcgggaattctgtgcatagagagcctgtggcttaggcactttgatttatgtatatctcttcctgtgattggctatctagggactgctatctccagcaaatcttctaaatgtctgccatgtagaattcctttctcatctttctgtctcacccccttatctagctgcttctctaaccctagagtgacactgcactccccacaatctcctatgtcctgaatattttaccccatcctaaactccatctctaacacagatgcactttcttgtgctgcctactgcattgtacatcttccccttagttcccatgatgcaactctgccctaccccagaaaatgtaatttaattggtctgggataaaacctgggacactatcattcttgaaatattccccaagcgattctaattatatagccaaagttgagaactatttgtagacaggcatcagcatgatcacttaatgatttgacttttgctagatctaaggtgaggaaattggagagtggtatccataggaagaactgtttagtttaattttttttttattttttcttctaaaaaaaaatccaacaacgagatacatgtgcggaacatgcaggtttgttacataggtataatgtgccatggtagtttgttgcacctattgacccatcctctaagttccctcccctactccttacttcccaacaggccctggtgtatgttgttcccctctctgggtccacctgttctcaatgttcaactcccttttacgagtgagaacacatggtgtttgattttctgttcctgtgttaatttgctgaggatgatagtttccagcttcatccacgtccctgcaaaggacatgatctcattcctttttatggctgcatagtattccatgatgtatatgtaccacattttctttatccagtctgtcattgatgggcatttgggttggttccatgtctttgctattgtaaatagttctgcagtaaacatatatgtccatgtgtctttatagtagaatgatttatattactttgggtatatacccagtaatgagattgctgggtcaaatggcatttctggttctagatacttgaggaatcgccacactgtcttccacaatggttgaactaatttacactcccactaacagtgtaaaagcgttcctatttctccacagcctcaccagcatctattgtttcctaacattttaataactgctattctgactggcatgagatggtatctcattgtggttttgatttgcatttatctgatgatcagtgatgctgagatttttaaaatatgtttgttggccatgtaaatgtcttttgtgaagtgtctgttcatatcctttgcccaccttaatagggttttttttttcttgtgaatttgtttaagtgccttgtaaattctggaaattagatctttgtcagatggatagattgcaaaaattttctcccattttgtaggttgcctgttcactctgatgataggttcttttgctgtgcagaagctctttagtttaattagatccaatttgtcaattttggctttttttgcaattgcttttggcattttcctcgtgaagtctttgcccgtgcctatgtcctgaatggtattgcgtaggttttcttctagggtttttatagttttgggttttacatttaagtctttaatacatcttgagttaatttttgtataaggtataaggaaggggtccagtttcagttttatgcataatggctaggcagttttcccaccaccatttactgaataggagatcttttcctcattgcttgtttttgtcagatttgtcgaagatcagatggttgtagatgtgtggtgttatttctgaggtctctgttctgcaccattggtctatatgtctgttatcgtaccagtcccatgctgttttggttaccgtagccttgtagtatattttgaagtctggtagcgtgatgcctccagctttgttctttttgcttaggattgtcttggctatatggagtcttctttgattccatatgaaatttaaaataatttttttttattctgtgaagaatgtcaatggtagtttgatgggaatagcattgaaattataaattactttgggcagtatagccatgttcacaatattgattctttctatccgtaaggacgacactttttccatttgtttgtgttctctcttatttccttgagcagtggtttgtagttctccttaaagaggtctttcacatcctttgttagctgtgttcctaggtattttgttctctttgtagtgattgtgaatgggaattcattcttgatttgcctctctgctgcctgttgttggtgtaaacaaaattcatttcttgttcttatttgtgaaattttggaaccaaatctattttcaaattagaaattgcttgtgataatggttttgcaacttagactggatatgagacgatgagatattagttctttcattcctttgtaggaatatggtgcatcttgcattattttagctaactagtgtcctttaatgactaatgaatatgacatggtgaaacaaagtaaaatatatatgatgcactaagtatgcattgtttccaaaggttcagcattttttttttgttaactctgctgggatctgctttatgcactgataacataacttattttatgatcttaagcaaataaaaacacttatctggacctcagtttccttaactgtacaactgagggaaactgtatagtatagctatagtacagtataccatctttaccgtcacttccatcttttaaattatgtgtatataagatagggcctagataaatggtatttatcttaaattacagtgatactagcttataacttaatttgctaggtcatgttgaactgataacaatgtgtgaactgatgagcaactgagaagtaaccaggttgtgttataacagtttgtttttgatttagggttatcagtgagggtggcggtggggaggggactttggagtctaactgtctagttcaaatattagtttttgtttatttttatttttaatttttgtgggtacatagtagatgtatatatttatggggtacatgtgatgttttcatataggcatgcaatgtgaaataagcacatcatagagaatggggtatccatcccctcaaacacttatcttttgagttaccaacaatccaatgacactctttaagttatcaaatcacagttttgccagctactagccatgtgattttgggtaggttacttaaattctcttcatctcaatttcattattgtaaagtggagataatgatagcacattttttctttttcttttttcttttattttttattattatactttaagttgtgtgatacatgtgcagaatgtgcaggtttgttacataggtatcaacaactctataaaacatgttctatccaggaaaagaaactatcatcagagtgaacaggcaacttacggaatgggagaaaatgtttgcaatctagatggcgattgcaatggcggttcgctgcatccatcagcccatcatctacattaggtatttctcctaatgctatccctccccttgctccccaccccctcacaggcccctgtgtgtgatgttcccctccctgtgtccatgtgttctcattgttcaactcccacttatgagtgagaacatgtggtgtttggttttctgttcttgtgttagtttgctgagaatgatggtttccagcttcatccatgttcctgcaaggacatgaactcatccttttttatggctgtatagtattccatggtatatatgtgccacattttctttatccagtctatcattggtggacatttgggttggttccaagtctttgctattgtgaacgctgcagcaatgaacatacataagcatatgtctttctagtcaaataagttataatcctttgggtatgtacccagtaatgggattgctgggtcaaatggtatttctggttctagattcttgaggaatcgccacactgtcttccacaatggttgaattaatttacactcccaccaacagtgtagaagcattcctatttctccacatccgctccagcatctgttgtttcctgactttttaatgatcaccattctaactggtgtgagatggtatctcattgtggttttgatttgcatttctctaatgactagtgatgatgagcttcttttcatgtttgttggctgcataaatgtcttcttttgagaagtgtctgttcatatcctttccccactttttgatggggttgtttttttcctgtaaatttgtttaagttccttgtagattttggatattagccctttgtcaggtggatagattgcaaacattttctcccattctgtaagttgcctgttcactctgatgatagtttcttttgctggatagaacatgttttatagagttgttgtgagaattaaatgcattaagcacatagaatagattctggtacatagcaagtgctctctctatatatggaactctatatgtagttggtgcaaaagtaattgtggttttcaccattgaaagtaatggcaaagaccatcattaccttttcaccaatttaaatatatggaaggaatatatatataaaacctatatatatatgtcacatatatgtctctaacccattattataatatataatacaatatatattataattataattgtatataacatatgttatataataatatagtaatatttattctaaataaatatataatactataaataatataataatttatatatatgattataatatataataggctatattatatattattaacatatacatatgtgtatatatatgtctttcatagacttaaatatatagagcaataataggttagaaaatagcaaacatgtatatataaacatatatacatatagaaaacatatataaaaacatatatatatatatatatatgtgtgttttctgcctttcatttttagagacagggtctcatcatgttgcccaggctggtctcaaactcctgggctcaagtgatcctactgctttggactcccgaagtgctgggatttcagacatgagacactgcacccagtccagtccctgtctttttaaatagactctctacctaagtgcacaaatactcattatttacatttagttatttctgtatatatgctataagcaaatcttgtagcaccagtttgatttttataaggcacaagaatatattttactaatgctttaaaatggcagctagattctagtattactttagaaattaaaattaatattttaacacatctttcattattgtgttatctgaaccaaacctattattgctgctatttcagcaaatccaggggctttttcttataaaatatgaagaatatagcttagatttctagtgaagatgttaccagtaataattaataaaatcagtaagcactaaaaggaaaataccaaaactaaagcattttgaattagtcattgaatctaaaagaaaggtagatttttttctgagattctgttctaggtgtggtatatgtgtatttttgcaaaaactataaacaattgtggcaaaatgaaggaaatatttaaaaacaaacctcttaattcttcagtggattaagcgtgaatatgtttttattttctatgatgaatatggaaaaattcatttccttagcaatttgtatgagcccaaaaactattgtcagactctgctgtatcaaaatagacaaaaaattgacactcacttttaccctgccaaaagcaaaatcttaaacttttgctttagtatataagccagcattcattgtatcctatgatgggttctgagtgtaggtgtatttgctttcttccattttttgtatgcatgttttctttttatttattattgtaagttgtatgaaatttttatccaaatttttattttcttctgattaataatcagaataatcagataattactggtaaatttgatgttaatccttccagctttttcccatgggaatttatacttaataaaggggagaagtcatcattacataatgtgcatattaatctgcttctccctttaatgtgttgtgaatgcctttccatgtcattagatgtttttctacctagttactttcatgaatcatatggctgtaccatgatttatttaatcagttcctcatcattgagtatgtaaattgcctccatttttttattactataaaaggtccttcagtacacacccctttaaaagctgactcttagaaggtgttcttgactctctacctaagtgtaaaaatacaaataaattgctttccagaaaaggtgcactactattttactttcctgatactaaactatgaaaattcagtcctaacaatagatatttaaataaagttttaaaaatgccaagtgaaaaagagcatattattattttcatttgcattacttttggttcctggtgagtttaatctgtttttgtatattaattatgcatttatatttctttttgtgtgtgtgaattgcctttcatgttctttgtgtgtttttattttgttgtatttgtctctttcttgatatatgagagaatattttccctagcctgtcaattgccttgtaattttgtttctagtgagtttttttttttttttttacaattaaaagctttaatttttgaaaattttgctggcaaatctatatatctttttctttgttttctgctttgacattattcttttataaaggcccatgccacccaaatattatgtaagcatgcatctatgtttttattacttcatcttttacatttaaatatctactctatttagaattcattgtgatgcatgtatgaggtagaaatctaatttcaaaaagatgagtatccagtttgtccatcatttattgcatgatctctttctccactgaattaaaatgccgtattttataatatattaaagtattacatgtgcttggacatgttcctggacttttgagataaatcagtctatttctttgtcatgtcacatattattatggctttatgatttaatatccagtaatgtaaaccctctgacacattattcttattcctcaaatgtttttgatgagttttcttccaaatgaaatttataatcattttattcattgattcaacaaatatttgttgaatggatattctgtgcttggtattgtgcatggtattaggattgttgcaaaaattgagactgacagtccctactcttacggtgctaaaaattcacttccaaaaaaatctttaaatgttgatgaagattgcactaatcttataaaataacttggaggggaatgtaatctttgcaacattaagttcttcattttagaaagttttaagactctccatttatttgagacttttaaaatatgtcccaataatgttttgtgagatgtatattttaagatatatatcttattgctattacattgtatcttttgttatattgttactatgaatgggatactcatttaattagatgtcatttttggtatatagaaatctattttcttagcatagtcattttttaaacctcgatctattaaattcttgattcatttacatttgttacacaatcatattctatgctgataatacttcttgcttctttccaatatttgtacctcgatcatttttcttgttgagttgtattagctagaagttctagaaaaatgttaaatggtagtaatagctagtattctgttttttcctgactctaaatgtaatgcatctagacttttataattatggcattgattgtaacattttgaggaagaaatcctttttcaggttaataatgtatctttatattcaagtttattaagaacatttattggaaacatattgaaattttatcagattccttttcagttgttactgagataatcataggttcttctgtattcttttaattaatttctcaaaattaaactgtcctattattcttggaataacgacatataaagtactgtatatttaaaagaagttaaaatgataatggtgattttattaagtgacctcacacaatagaaaacagtgtagccttagaagttttccaagtgaccattctacttagaaacaaccctgctttgggatcagaactgtaatttttaaagtaaagttttctgggtttaattcatttagtgtaattacaagcatgagttcaggtttctatttttttcacctgaactttccttcatggtttgaatatctagaaaaagcagactttcctatctctagactaaacatttgatcctatcttaggtatgcattacaattttttaaccataaatggttaaagaatttagactcatctacaataactttgaagctctggtcttgaagaacatgtgagaaatgagatataactcctagaagatataggagacatttttagtcttccaaattttccctgggaggctgatctaaattgagtcacaaaattgttcccaccaggaatgcaatcacttgagctgttttctaatctgagcccctctacccagatgatcttctgaactcatactgttcagactttcatccttctgagtagaaaacagccatagtcatggcaggatgagggctaggacaattacccaaggaattcttggcctctgccatgggactctgcagactcagatcatataatcagagatgttagcactggaggggacatcacaattagctttctccacctcttagtttatcagtgaggaaaactgtccagagcgcggaagagactaaaataacacagccaatgtaggtaatgtgctggataagaatttggaattcacgattttgaattcagtgtttatttcaccatcacgctggcttacacgttggtatcaggcttcttctattattgaagtgagccattaagtgaattccatcttgatttgtgtctgatacagagtaataaactattttattaaatatccaaataattatacattcctccttcttacatgcaagcctaagtttgcttgtactatttcatgtggtagcaaatcaggacgcttcttgtgtctctgaaaatactctgagtaatggagtacagtcagctttcttgtaccaagaatatagggactatgtttctcccagtcattctggggataatttttgtgaaggattgcacttcataggttaagctaggtatcagttaccagtgttttttccaaataaaaaaaaaatcaggtgatatctgtaaatggttccattgtaaatattaaagaacatgatgcttaaaacagattagggaaaactatagaaggggtggggtttcggagtgctaattttgtccttgaatggtaacagctccatgtggtggtgaggtttatgttggtttgctgtttgcagatgatcttattattagaatttttcataccgaaaataaactgcattttagtttgtaaacatgcccttccagagtaatgctaccagttctttgtgaaatagctactgttgttcaaaggatgactatgtcctcttcggttgaggaaagatgacaacaaactcagtaatgacatgtaaaataggtattacaaaccaggtatggtggcatgagcctgtaatcccagctacttgagaggctaaagcaggaggatctgttgatctatggatttgaggctgtagtgtgttgtgatggcacctatgaatagcccttgcactccagcccaagcaacaaagcaagactgtctctgaatttttgttttgttttgttttttgtttttttttttttgagacagagtcttgctctgtcacccaggctgaagtgcagtggcgcgatctccactcactgcaagctccgcctcctgggttcacgccattctcctgcctcagcctcccgagtagctaggactacaggcgcccgcctccacgcccagctaaattttttgtatttttagtagagacgaggtttcactgtgttagccaggacggtcttgatctcctgaccttgtgatcctcctgcctcggcctcccaaagtgctgggattacaggcgtgagccaccgcgcccggcccctgtctctgaattttttaaaaaggcattccactcaaattaatacacattttaattgtgttttgttgtaaattacaactgaataaaaattcagcaaataagtctgttgtggtagggaaaagtctattgtgatctggaaaatataatggagaaatccagtggaagagattttatttcacattactcaaaataaaaaaatcttatacaagtctttacacttgtaacttgaaaaattctgtgctaaaatttagcttggttgctaaaatatttctctttttttctcagaagcttctttttagcatcctatagacacaagttactttttaaaatatttgcatacttgctttgcaatgtattgtttatcagtagttctatattctttgagatagtctatccagtctttctgtatttatcgtatgtctgtatagatatatattagcagataaatgagttctgaaaggggagaaatgtgattatgctaatcatgatataaagaattgactttataagcagtgttcacaggtcatacctttcccgttactgtcttacagtgaacaagaaatgatgctttgtctggtatgcatggtaaataatgccccttgctctctgcttcatgatcacatgtgatacttctaacatagatagcacatgtaaatccagtggccttgactgcaactcaagagagcattttggccaagtacaaacccactagtcatgaaaaaaaaaaaaaaaccaaatcaaagtaaattgatggtattgacatttgtctatgaaaaacaacataatatagaacaattctggggtaaaatattgatctaaaataattttaaggattaaatattgccattgtaagcatactatgagcaattatgtttgtaatgcagatatatttataattttaaatccaagatttaccttaattgtacattttcctaatttaaaaaagttattttgaaaaaaaaatcctcgaatctagagaaaggttggcaaatacatatggaactttgtaaaaaacatccagggcagcactttcactgattgcagtagcttaggagtgaaaaacaacacaactgctccaatgtatggcaatgggcaaatatcccgatttattcacagggtggcatgttaggcagtgcttagaataaatgagttggttatacaagtatcaatagggataaatgtgaaaaacacagtgttaagtttttaaaaagttgtaaaaagcacagtaggatgttatttatataaaatttaaaaacctcaaaaaccattcttctttgatatatattctaaagatgaacatatatgtaatagaagtacaaaacatacataaaataatatacactatgcagtcatttgtgtacttacttttcaaaaatatttcagtagatatagcaaacagttaacatgtaatatttggataggaggttggcaattttctttttagcacctgcctgtctgctatcattcaaactcacatttaaaatgtggctatgtgagatgagagaactataatattccaggtttgtgattagtttggaaactttttaaaagtttgaatgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtactggttgttcctttccaggtttagcgcttccttcaggagctcttttagggcaggcctggtggtgacaaaatctctcagcatttgcttgtctataaagtattttatttctccttcacttatgaagcttagtttggctggatatctctcagaccacagtgcaatcaaactagaactcaggattaagaatctcactcaaagccgctcaactacatggaaactgaacaacctgctcctgaatgactactgggtacataacgaaatgaagacagaaataaagatgttctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccaatcccacagaaatacaaactaccatcagagaatactacaaacacttctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcatagaattggaaaaaactactttaaagttcatatggaaccaaaaaagagcccgcatcgccaagtcaatcgtaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggtattaccattcaggacataggcgtgggcaaggacttcatgtccaaaacaccaaaagcaatggcaacaaaagccaaaattgacaaatgggatctaattaaactaaagagcttctgcaaagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacactactcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaataggaaagacttggaaccaacccaaatgtccaacaatgatagactggattaagaaaatgtggcacatatacaccatggaatactatacagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataaaaaaaaaaaaaaaaaaagtttgaatgttttcttgcattcagagccttggttgacatagttaattaaaaataaaacattgtatataaagcacagaatgagcagctacacaaagctgctcaatcaatgacagctctatatgggttagggtttcttgtggggatgacattgatgtagaaagcatggtcatctattgagaatgatggggctggaggtattggatacttgaggtttagaaaatacattgtagaaaatggacaaaaacccctcaaattaagggatgaggcagaataatgcttggcaataccaggggtaggctgcagtctttcttggaaatatatattttaaatggaaccaattatcatagcatcatttcctctcagggttaccctctgatccctattttactaaatcgttataaaacaaaatgaggaattatgtgtccttcccttttgaagccaatgtaacaagatgggtaagaattagacctcctgagttcaaaatccctggattcagatctattcctgtatattcaggagaagtggtaataaattcgatggacaatttggtttagtagtcgattgaggaccctgatgaggtatatttgggaaaacataacttccgctctctctcattgactcacgggcctttgaggagtccaggagtcattggaatctggcctgaggttgaggctgctggcaaaactccttccccaaagtccattcctattgctgactgagaagggactagcattggaagtggctgattttaaataccgctagtgctggtgtgctcctccctcccattcccagctctgctttgtgtagttgccttgagaagctaagttcattctgaaaataatgccattgcacaaaacacttttgaaagttctagtttgaaattacatcaggtcacttggtctgtgtggcctcagtttcttcatctgccatgtgaaaataataatgcctactctgtagcaaagaaagtctctatagtaaacaaaaaaaaagcctactctgatactgaaagttgttatgaaaaataaaaaagggaaatgctttagaaactgttaagtgctatgtagatgttactaattaacaaaccatttcagaaactatactttttattttatggccactattcactgtttaacttaaaatacctcatatgtaaacttgtctcccactgttgctataacaaatcccaagtcttatttcaaagtaccaagatattgaaaatagtgctaagagtttcacatatggtatgaccctctatataaactcattttaagtctcctctaaagatgaaaagtcttgtgttgaaattctcagggtattttatgagaaataaatgaaatttaatttctctgtttttccccttttgtaggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaaggtaatacttccttgcacaggccccatggcacatatattctgtatcgtacatgttttaatgtcataaattaggtagtgagctggtacaagtaagggataaatgctgaaattaatttaatatgcctattaaataaatggcaggaataattaatgctcttaattatccttgataatttaattgacttaaactgataattattgagtatcttctgtaaactgcctctgttgtagttttttttttctcctaatcatgttatcatttttttggaatccatggtttcctgttaagatgactcacacagcctacataaaagtaattgacaaaatatcatcttatagtaaaatgccacatatctttatgttcagcaagaagagtataatatatgattgttaatgataacccaaacaacaaaagatttcaccttaactggttgtcataagtagtagtatccaccgccttattttgagttggatttttatcatcctatgagccctacaaatttaaagtttttggaacagcacgtgcattgaacccataagaacctactctgcttttctgcatgtattgtccagacaagagaccaaattgccgaggcatcatttaggtgaattctaattaacatttagctaccttacaaccacaattcaaggttgtttcaaaggcatgtgcttgcatcatcctgattcactaccatgtgttactaacttggatctgcaaagtcattataaaaagctgttttgatggacttatttggatattgctttacccttcttctctcttttcttttatcaatgtaaaaacattatatgttaaatacttggcttttaagagcatagatctgaaatctgcctctagcaaataacccataacacttctaagatatacctgcaaggtcaattgtgttgtaaaaccttgataaccatactttattgttcaaaaaagccttttatgaaggcagaagttaaaaaaaaaaaacaaaaaaaacagagtccacagttatcacctcagctacaatctcatcagttcacaagtaccagcaaaacatgtgataagtcaacaaatgttttatttcaatctgaacattttacgtaagtgaagactttgttagatatcatttggaatgtggaatctacacagttggcatatcagagaaggttgaattcagtttaataaatgtttatagaaagtgcttgttatcataatgataatagctcaggatgtgcatgacaagcttttaagcgattgggtacactatctcatttgatcttctgcacaactattaatggtaggtactattatccctatcttatggataagtaaactaagatttaaaaagtacagaacatggtgtgaacactgcttcaaaatttctaaaataggtaaatcacgatctctaaactggagggttgtccaaccactagggacaatagagtactgatatttagtggtcagactgtaatgcgggaagagacaggcatgggctaaacgggtgtagagatcaaataaggggcaggttagtttgtaaacatgtccatatgtaacatttagcacaaatacaggatataggtgctttcagacccagctgcattgataaaaagttaggtggtattgtatctgtcttcctttctcaatgttgcatatctgtgttcttgcccagtttgcttcatctctctagccacacttattggcctacaatggcatcatcaccaaagaaggcaatcccatctccgtgtggctttggtttgctccctaaagtaaaccttgtgtttacttttcccaggtctcatgctttcccatatctgacctgttttgtcctcatggccaggatatgtgggacctttcctacaatgttccaaagtttgtaatagagctcttctctgctttgttccaaattctgcaacattttactttaaataatgaatttaaatacaaacaaacttgagctttgcctatacttttcaagaatgcagagataactaaattaataaaaatattcattgagtccttactgtgcacacagctctatgttaagccttgtgcagaactcaaagtcactcgagattaagcctgttactaagttatgtgcaatttagctcagtggatttcccccacttcatattgctctgataatgttttggaattaactgccttgattccttcttttctctgcttgtctatacactatttattattctacaccatctcaaattctaactcctcaagaaaatccttccagatgatttttctaaccaggagttttaacttccttttaactaccctattactttctacttccttaactcatctatcatattatatttagttatttatatactaggtcgccttgaagaagggattgtgttttcataaatcttaataatccctgaggcatcaagtacagtgatttgcatttactaaatgctcaacaaatatgtgagggattcacttgaaactaatattagataattcccagtcaaagtgatctaatagcaaatcaattcttcagttttataggcaaagtatgactctggttttccataatcataattaatttgtcaactttataattttaattaagtaaatttaattggtagataaataagtagataaaaaataatttacctgcttaactacgtttcatatagcattgcatttttctttgtaaaatttaagaattttgtattaataaacttttttacaaaagtattaattattcagttattcatcatatacttttattgacttaaaagtaattttattcaaaagagttagtataggactacatgaaaaattcaaggccaaggcttaatttcaaatttcactgcctttggctctatcttttaaaacaaaacaaaaaactcccgcacaatatcaatgggtatttaagtataatatcattctcattgtgaggagaaaaaataattatttctgcctagatgctgggaaataaaacaactagaagcatgccagtataatattgactgttgaaagaaacatttatgaacctgagaagatagtaagctagatgaatagaatataattttcattacctttacttaataatgaatgcataataactgaattagtcatattataattttacttataatatatttgtattttgtttgttgaaattatctaactttccatttttcttttagactttaaagctgtcaagccgtgttctagataaaataagtattggacaacttgttagtctcctttccaacaacctgaacaaatttgatgaagtatgtacctattgatttaatcttttaggcactattgttataaattatacaactggaaaggcggagttttcctgggtcagataatagtaattagtggttaagtcttgctcagctctagcttccctattctggaaactaagaaaggtcaattgtatagcagagcaccattctggggtctggtagaaccacccaactcaaaggcaccttagcctgttgttaataagatttttcaaaacttaattcttatcagaccttgcttctttttaaaactttaaatctgttatgtactttggccagatatgatacctgagcaattcttgttctgggttgtcttatgtgaaaaataaattcaaggtccttgggacagataatgtgttttatttatctttgcatatccattacttaaaacagcattggacccacagctggtacaaaattaattactgttgaattgagcaaatatttattctaaatgtctctgtcaaatgacagagtgtggttgtgtggattaagtccctggagagagttctttgttctctcatgttctatgctgtggttcttgctttatgcaaaaagaagtaagttacttaaaacctggacatgatacttaagatgtccaatcttgattccactgaataaaaatatgcttaaaaatgcactgacttgaaatttgttttttgggaaaaccgattctatgtgtagaatgtttaagcacattgctatgtgctccatgtaatgattacctagattttagtgtgctcagaaccacgaagtgtttgatcatataagctccttttacttgctttctttcatatatgattgttagtttctaggggtggaagatacaatgacacctgtttttgctgtgcttttattttccagggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacaggtagcaacctattttcataacttgaaagttttaaaaattatgttttcaaaaagcccactttagtaaaaccaggactgctctatgcatagaacagtgatcttcagtgtcattaaattttttttttttttttttttttgagacagagtctagatctgtcacccaggctggagtgcagtggcacgatcttggctcactgcactgcaacttctgcctcccaggctcaagcaattctcctgcctcagcctccggagtagctgggattagaggcgcatgccaccacacccagctaatttttgtattttagtagagacagggtttcaccaggttgcccaggctggtctcgaatgcctgacctcaggtgatccgcccacctcggcctcccaaagtactgatattacaggcatgagctaccgcgcccggcctaaaaaatactttttaagatggtgtaaatattactttctgtatcaatggtacattttttacttgtcagtctctagaatttctttataaatatgttgattcagttcatttttgtagattataaaacaggtaaaaaaggataaaacatttatgtgaattaaagggaatacctaatttttgtgtagagtttattagcttttactactctggtttatggatcatcacaccagagccttagttactttgtgttacagaataactaatatgagtgaatgaatgacttacacaagtcactgcttaggataaagggcttgagtttgtcagctagagtatgacagaaagtatctaagttttggagtcaaatagcactttgtttgaatcccagattgcatgcttactagttatgtgaccttagtcaagccacttcacctcactgagtctttgcttttttcatctctaaaatagagatacccaccgctcataggctgtcataagggatagagatagcatatggaatgagtctgtacagcgtctggcacataggaggcatttaccaaacagtagttattatttttgttaccatctatttgataataaaataatgcccatctgttgaataaaagaaatatgacttaaaaccttgagcagttcttaatagataatttgacttgtttttactattagattgattgattgattgattgattgatttacagagatcagagagctgggaagatcagtgaaagacttgtgattacctcagaaatgattgaaaatatccaatctgttaaggcatactgctgggaagaagcaatggaaaaaatgattgaaaacttaagacagtaagttgttccaataatttcaatattgttagtaattctgtccttaattttttaaaaatatgtttatcatggtagacttccacctcatatttgatgtttgtgacaatcaaatgattgcatttaagttctgtcaatattcatgcattagttgcacaaattcactttcatgggctgtagttttatgtagttggtccagggtgttattttatgctgcaagtatattatactgatacgttattaaagaatttcctacatatgttcactgctgctcaatacatttatttcgttaaaacaattatcaagatactgaaggctgattggtaactcacatggaactgggagagtatacaattctgaaccaaatagatgattctctattattatatcttaatttatgtgttatggtatattaaacatgaaaaaaattgtatttggttagaatatgtttgctcttccttaactcgggaatgacatagggtaatattcacagattgggttcctataaatcctccacttgaagtgaagtcagttcaagtaatgaaagctacctcctgagatagaatcagtacttggcacctatctctagtgttctttcacctcatataacctttcactgattagtaaagattatatccaacaaagaaagtacagcacagactgagatatgattactgagataaatttgggcaaaatataaactacagcatttctgtagcaatgagaccatttttcttcagttgagctccatgttctacaaacttcaatcaaaaaaggttctaggagactcagtgaaagttgatacactgttcaaggaacaaataatttcagcacatgggaatttcacagggaaaaatatactaaaaagagaggtaccattttggatggtgtcaatatgggttatgaggaattcaggctgctgagtccagtgtacaatggaaactgagctgcaggtgtgtgattgtaacaacaaaagaaatgctgaaatattaagtcctttgccatgtaaatagaaaaagagtatttatttcccaaacattattgctcacctgtttttgttatgcctttcaagataaatccaggaaaggaattgcattttctttccagaaaacaagttcttgggggaattgttcaattggtagatgttgtttttctcattaacaagtgagtgctccatcacacttgctgagtgctccatcacacttgctctctgcattactcctctgcctgcaaacacatatatagcaagggtgatgacaaggatatcagagggtctggttttctcaaactcatgataaactcatggctgggtcattcttggtgctgattttactttgttttttgttgttattgttccctcttcctcaaaagatgaaatctatccctcttacttggaatttctctttgatatatagcgaatgtttggttgtaacctgtataatctggcatgaaattgtcactcgaaaaggctagaagtgttgacataaatatgggacagcaagagttgctcctactcaagagagcaaatataatgttctggaagagattggcagaattcacatcaaaggagtgattacttcagcctgggccactgttgtactggtcaaaaggctgtgcaaagctctctgaaaatccactcttttattgctctttagtaataaagtcactttcaattttaaaaataacaaactgatatatttttatgactcataaaatgttagcaattatattatggagaatctactttctgggtgattcttacaaatgttcttggatctatttttttttcttatagtacctattcttcccatttttctcagctctagttaatatatttcaacaacagttcaacaaatttaacatttttataaaaagtgtttcctatcattttataaataccagcctagtccatgttattccttttcttgttgaggagaaaggacacacattgtaaattcaaatatagacctctactgtgctatttaatcttggtaacaactccacaaaggagatgacatgttttccttctatagaggtagattctgtaaagttagagggaagagtgacttgcttaagatggcataagctgtaactggcagaaccaggattcaaagccaggtgggatgccaaaatcataatctgtcttcagtgtcaagttactgaaattggtaaacattagacctaaatagacggaattgcaatccgggttgggcacattaaactccattttcttcatcaatgtgctcagattacattttacttttcaggctaaaaatggaaaaaaagagtccctcttagttctgcacttgagaatgagaatagcttttctgaattatacaaggaagaagaactaatgcccaaatgccaggtacccacatgcactatgccatggcacagctgttgccccctttcaccagagccctctctctgtatcctggttgacctttccttgggcaagagctgggtggggaggatcacaagtgactccaatttggatggcttcgggaagactgggaccgagctgaaggcagtgttgtcctctgcactccctgttttctgtctgctggagcactgaagcctcacatatgtattaaaaaaataatttccatttgcatttcagactagaagattgaacgtatagtgtaatgtgattgcaaataattatattgaaatgagacagagaggatgtagtatctactgtcataatttttcaaaacccacctgcaacttgaattaaaagaaccacttgggtttttttttttgtttcaaacgcaaatcctggaaacctactgagactcattcagtcagtatctctaagaggcaagcttgagactgtatatttaaaaagcatctcaggtgatttttacacatgctaaggcttaagaaccacttctctgtagcttatatgttattttcaatgttcctcaaagccaagttagaatttccaaagtgttaagaatccattagacaatcacagaattgtctttttcctttataaatcttgcaatgttgttctcatttccatacttaattacttaaaacaccaaccaaccaacaagcaaaaaatgattagtctaactaatattacaagttaataatgaagtaaaggtttaaaaataatgtcataataatgttaataacaaattattaattataatttaaaaataatatttataatttaaaaataatatttacaagtactacaagcaaaacactggtactttcattgttatcttttcatataaggtaactgaggcccagagagattaaataacatgcccaaggtcacacaggtcatatgatgtggagccaggttaaaaatataggcagaaagactctagagaccatgctcagatcttccattccaagatccctgatatttgaaaaataaaataacatcctgaattttattgttattgttttttatagaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggtaatgtaccataatgctgcattatatactatgatttaaataatcagtcaatagatcagttctaatgaactttgcaaaaatgtgcgaaaagatagaaaaagaaatttccttcactaggaagttataaaagttgccagctaatactaggaatgttcaccttaaacttttcctagcatttctctggacagtatgatggatgagagtggcattttatgccaaattaccttaaaatcccaataatactgatgtagctagcagctttgagaaattctaaagttttcaagtgataagactcaatttatacaaagctaattggataaacttgtatatgattaagaagcaaataaatacttattatgcttttttgctgtttatttaaatatttaacccagaaaataagtcactgtgacagaaataaaaatgagagagaagggtgagccactcttaggtagttctggcattatttaatctaggccagaggttgcaaatggtgtcccatagaactaattttggctcctagacctgtcttatttaacctttcatttaaaaaatttgtattggttgccagcaattaaaaattgggagatgtctcacacacacacacacataaacacacacactcatgtgtgcagcctcttttgaagaattggaataactagtcaactgcgtcctccttttccacaagctgtgacagctccctgctcacagagcacctgccctctcctgttcatcatgctctcttctcagtcccattccttcattatatcacctatttggtcctgagactaagtgagtttgagatctgtgatttagacaaagtggtgaatctagctctgaatcatagtaagtagctctgggaatcatcttgtcttctgttagcccattgagagagaaatagagagagagagagagagaaagaaagaagaagaaacagatctggggagagtcactgaatgggagcatagagacagagaaacagatctagaaaaccaaactgggagaaaatgagagaaaccaaaagagaggtagagaggagcagagaagaaaatgaagaagcaaggcaaggaccaggctttttcattatttcttatggccaagacttcagtatgcgtggacttaattcttccttatgctcctaccttccctagggaaactgatttggagtctctaatagagcccttcttttagaatcacagtttgatgccttaaaactagttatataccttcacatgcttccttaacccacagaagtgatgctaatgaggcccttaataaggagcgtgctattaagatgaagacattcattttttttctccgtccaatgttggattaaggcacattagtgggtaattcagggttgctttgtaaattcatcactaaggttagcatgtaatagtacaaggaagaatcagttgtatgttaaatctaatgtataaaaagttttataaaatatcatatgtttagagagtatatttcaaatatgatgaatcctagtgcttggcaaattaactttagaacactaataaaattattttattaagaaataattactatttcattattaaaattcatatataagatgtagcacaatgagagtataaagtagatgtaataatgcattaatgctattctgattctataatatgtttttgctctcttttataaataggatttcttacaaaagcaagaatataagacattggaatataacttaacgactacagaagtagtgatggagaatgtaacagccttctgggaggaggtcagaatttttaaaaaattgtttgctctaaacacctaactgttttcttctttgtgaatatggatttcatcctaatggcgaataaaattagaatgatgatataactggtagaactggaaggaggatcactcacttattttctagattaagaagtagaggaatggccaggtgctcatggttgtaatcccagcactttgggagaccaaggcgggtggatcacctgaggtcaggagttcaagaccagcctggccaacatggtaaaacccggtctctactaaaaatacaaaaaattaactgggcatggtggcagatgctgtagtcccagctgctcgggaggctgaggcaggagaatcacttgaacctgggaggcggaggttgcagtgagctaagatcacgccactgcactccagcctgggcaacaaggcgagactctgtctgaaaaagaaaaaaaaataaaaataaaaataaaaagaagtggaggaatattaaatgcaatataaaagctttttttatttttaagtcatacaatttgtttcacataacagatcaggaaataatacagagatcataagttttggagctgggtttgaatcctggctctgccatttactttctgtgtaatctaagtcaagttactgaactttgtgggccctctggctctccatgtgtaaaatggagaatattaatatttaccttgcaagtttgttgtgaagactgaaggagagaatttaggtaaaacattcatcagagtaccatgcacacagttgttcctcaataaacattagcttctctgattgcaagttccagtctaaagtgctttatatataccagccaataaaaggatgcgagagagatataccagtgtattgttttctaccattttaaacctattttcatccactgttacaaattctatcatactgctccacataaaaaatattatcaatgatttttagtctctgaagtgcaatatttgattattgagcacacctgttgaagttttagtttcttctcacttacatgggttgtgtaaaggtaggaggtataaaaccagtgtcctaggtctaaatctttcttaatgtcatactttggattcattgatataagtaacttgagcaccagcgcttcattttacttcattttttaaagatatagtaagagtaattcccatctgcctagcaaaattgttttgtagaaaagtttgtggatcagatttattttactttgattttaggaatttcaagtgtcttcgtcggcatgaaggaaaaatatgcagtttgacattttctactactttcaggtcattattttcctactctggtgcaaaaaccctcaattcctgtctcactccatctaatcaaataggtagcatgcttgagcccttactatgtgccaggcactaggataagcactttatatgttttgtcccaattaattctcacagcatttctatgacctaaataaaattaatattttcatttcaccaataataaaatggaggcttcaaaaagtttagggacttggctcagctcacacaactggcaaggactgaaaatggattttagtcccaaatgtcataggctagagccctttcactaaactgttgtcttccatctggtggcatcctcttcctccagtctttgtcacctaaactctgggcaccccttgatggcatttacttatgatggtgatgcttgttaaacttcctgtttgcgacttcaacgtccatataaatgagtcttccaatactgtacttagaacttatattttgtagtgacttctttaaaagctttctctcttagtcatatcctgagttttgttagcacctggacttaccttactttggaaatgttgcactctgaaatctctttctcagcttggaatttcctaatcttccaactgtttgagtcttttaattctacatttactgcctttccatttcatcaggatttctagtctctttaattcttccttttgaactcctcctgatttaacctctgcttattcgaagaacaataattttattctctcagctgcactctcaattcccttttccttttggtgatttttctttttcctacagaacacttactttatcagttttggagaaggaagtgctatctgggtaacagtagtgctatctgttgactctagtcaactgtaagttttatacatttattgtttaaaccttatatgggtctataatccttcttgggaaatcctttcatttgtctttaatttcctttaccatttccctaaaggctattccagatttttatcacattcacaaaattcccgtcttttctcaggatctgttcacccccagtagatagccttgtctcccacaatacatggagaaaatagaggccaccgtcatatttgaatgtttccaacttctctcttcacctttggaattatctttttcttcttttgtgtctaagagaaagatgtatacttcttcttacccttgtctgaactactctattttgcttcatcttctcagaacaggggaccagcaattattcttcctccagaagcttcaacatcttttgtcaactgactccttctcatgtttaaatattttcaagttaaacaatttctttcctgactttcgctcacgcaacctcatgcccaaaaccttatcactcttcttccctttgctgtcaaggctgttctcacttcttcactttttgtggacttctccccactacaacatagattctgctatcaccaatctattaaaactgttatactcttgtggaatttatcatttaatttagcttcagtgaaccgttctttccagattattttggcctcagaccatgacttctaagtctgccgtgcttgccacttaagtgatgatgggccagtgggtccccacctaggcctctgtgttagtctgttttcatgttgctgataaagacatacccaagaatgggcaatttacagaagaaaggggtttgagggactcacagttccatgtgactggggaggcctcacaatcatggtggatgatgaaaggcatgtctcacatggaggcagataagagcatagaacttgtgcagggaaacttccctttattaaaccaccaggtcttgtgagacttcttcactatcacgagaataggatgggcaagaccctcccccatgattcaattatctcccactgggtccctcccacaacacatgggaattatgggagctataattcaagatgagatttgggtgaggacatagccaaaccatatcagcctccttctggctttttatgttctccgtgggtgacctctctcaggctcaagtgataaccaatgtgctgatgactctcaaatgcgcatctctggcttcagtttcttccttgaacttcatacatatgtttccaaatttcctgcgtgtacctcaaggttcttgttcatcacttcccaagcttcataaacgcactcattttagtgtattctctgtctcctttgatagcatccctgagaggcaagtccctggtgagttatatacaactcctcccttgctccaaacctgagagtaagtaacattcctattaacatattaggaagctgaggcttagacagtttaagtaactcaagcatggttacacaactagctagggcagagctaaaatgtcaggctaggcttctgtgactccaaagccctttctcacttagcatatcatcacttatttttttttttaatcacatatatgatttttttttctttaagagatagaatcttgctctatcacgtgggctggagtgcagtggcacaatcatagctcactgtaaccttgaacttgggctcaagtgatcctcctgccttagcctactgagtagctagggctacagacacacaccaccatgcctagctaattttattttattttattttattttttgagacagagtctcactctgtcacccaggctggagtgcagtggtgcgatcttggctcactggaacctctgctgcccgggttcaagcgattctcctgcctcagcctcctgagtagctgggattacaggtgcctgccactgtgcccagctaatttttgtatttttagtagagacggggtttcaccatcttggccaggcttgtcttgaactcctgacctcgtgatccactcgcctcggcctcccaaagtgctgggattacaggtgtgagccaccacgcctggccacctacctaatttttaatttttttgtagagacagggtctcactacgttgcccaggctggtcttgaactcctgttctcaaacaatcctcctgcctcggacaccccaagtgcagggattacaggcatgagtcattgcagctgacctgtatatatgatttttagtatatgtaaatatacatatttattaaatgtaaatataaatataaatgtgtggagtgatatccattgaaatgttaaacatagttctcagtggtacaactacaggtgatttctcttttcttatttctggttttctgtgttttccaaatttcttgaaatgtgtcttctgtaatcagaaataaaagttattagtaacaacagtcttccactggtacaagtgcttattggataaaagtcccacttctaagcatgatactcacaacttttaggttaatagcctttgtcaccttgccatatacatctgatccagccactcacaccattcctgagatatattttgttcctttgtgcctaaatcattgtgcatgcagatccatcttcctggaacacctataaccatttcttagtcctgtgaaatcctacttacatccttcatagcctagcatgtatgtcatttatttggtcaagggtgagttggttgttctcttgaatgtactgccatatgacgtggtgtgatttcaattgtagcaccaagctcattgcaatattaattcgtttgtcattctcccatgtaggatgtttgaagtagtttctaacacagagattatactcaataaatatttattagataaataaatgaataagggaataacaaatgcctttgtctcattttaaaatactttcattgttagctacccatataataaaaaactaaaagcagtagttttcaagcatgattgtttatgtatgccttaaaagaattttgaaaacctatgtacccctgacacacttttaagttaacttataaatttttcaacatagttttaagtggtggcaaatgatgtagtttcttgtgtattttaaactgcttaagtatgctatacatggatttcttcaaaaccctgaagctgcagtttcagtgcattcaatttatggaaaagaaattaatttataaaattggttcttattgtcaagtcaatcagctaaatataacttgctttctgtcaggaaaagtctgactttaaaatacagataagtaataactattattaattaattaaattattaaaattaaaataattaaataatttgttaattaaaatgccttattcccctacttatttctgcaatttgactctaagaatagataggacatgtagattgccttaggtttgaaatctgggtgaaataagatactgcctccttcagtatttctgcctttgcttttatgggagcctctttcaagaaaaagtcattctctcatggtccctttgtttgagtcccagaggttttcctactccagaaagtgcaacgtagtgagactagtactatactcccttgcatggtaagtgagaaggctgtctgtataaaatgagggaaggactcatgagagggaagtaggtcaggagaaatgataggttctcaggcaggttaattttaggaaagagtgaatagagtcccttaaaacaaggtgcatctgcttcctcctgatcaatctttaggactgtttactttgatttgaagaccactatgctaaagcttcccacgggggcaatagtgaggcaaggaatttttaaaagggaattacttcttcgtagctacttttgtgaaatgaattcatttgaattatctggcaatctcttcatatttatattcaacaataattacttaaagaaatgctttgagcttctcagaggagggtgctaccagtgtgatggagtagaattcagatttgggtagtgactttaaagctgtgtgactttagtcatttaactgctgagtcacagtctacagctttgaaagaggaggattataaaatctatctcatgttaatgctgaagattaaataatagtgtttatgtaccccgcttataggagaagagggtgtgtgtgtgtgtgtgtgtgtgtgtgtgtgtatgtgtatgtatacatgtatgtattcagtctttactgaaattaaaaaatctttaacttgataatgggcaaatatcttagttttagatcatgtcctctagaaaccgtatgctatataattatgtactataaagtaataatgtatacagtgtaatggatcatgggccatgtgcttttcaaactaattgtacataaaacaagcatctattgaaaatatctgacaaactcatcttttatttttgatgtgtgtgtgtgtgtgtgtgtgtttttttaacagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaaggtagttcttttgttcttcactattaagaacttaatttggtgtccatgtctctttttttttctagtttgtagtgctggaaggtatttttggagaaattcttacatgagcattaggagaatgtatgggtgtagtgtcttgtataatagaaattgttccactgataatttactctagttttttatttcctcatattattttcagtggctttttcttccacatctttatattttgcaccacattcaacactgtatcttgcacatggcgagcattcaataactttattgaataaacaaatcatccattttacccagtcttaaccagaacagacattttttcagagctggtccaggaaaatcatgacttacattttgccttagtaaccacataaacaaaaggtctccatttttgttaacattacaattttcagaatagatttagatttgcttatgatatattataaggaaaaattatttagtgggatagttttttgaggaaatacataggaatgttaatttattcagtggtcatcctcttctccatatcccaccctaagaacaacttaacctggcatatttggagatacatctgaaaaaatagtagattagaaagaaaaaacagcaaaaggaccaaaactttattgtcaggagaagactttgtagtgatcttcaagaatataacccattgtgtagataatggtaaaaacttgctctcttttaactattgaggaaataaatttaaagacatgaaagaatcaaattagagatgagaaagagctttctagtattagaatgggctaaagggcaataggtatttgcttcagaagtctataaaatggttccttgttcccatttgattgtcattttagctgtggtactttgtagaaatgtgagaaaaagtttagtggtctcttgaagcttttcaaaatactttctagaattataccgaataatctaagacaaacagaaaaagaaagagaggaaggaagaaagaaggaaatgaggaagaaaggaagtaggaggaaggaaggaaggaaagaaggaaggaagtaagagggaagcagtgctgctgctgtaggtaaaaatgttaatgaaaatagaaattaagaaagactcctgaaaggcaattatttatcaatatctaagatgaggagaaccatattttgaagaattgaatatgagacttgggaaacaaaatgccacaaaaaatttccactcaataaatttggtgtcaggctgggtgcagtggctcacacttgtaatcctagcacttttggaggcagaggcaggtgaattgcttgagtccaggagtttgagaccagcgtgggcaacatggcaaaccccacctctacaaaaaacacaaacaaaagaaaatagctgggtgtggtggtgtgtgcctgtagtcccagctacttgggaggctgaggtgggaggatcacctgagcctgagaagtggaggctgcagtgagccatgattgcaccactgtaccctagcctaggtgataggctcaaaaaaaaaaaaaattggtgtttgcaatgctaataatacaatttggttgtttctctctccagttgttttcctacatacgaaacagcttttaaaacaaaatagctggaattgtgcattttttcttacaaaaacattttctttcttaaaatgttattatttttcttttatatcttgtatattattactagcagtgttcactattaaaaaattatactataggaggggctgatactaaataagttagcaatggtctaaacaaggatgtttatttatgaaaaggtagtaattgtgtttcatagaatttttaaaattaattctgcgtatgtcttcaagatcaattctatgatagatgtgcaaaaatagctttggaattacaaattccaagacttactggcaattaaatttcaggcagttttattaaaattgatgagcagataattactggctgacagtgcagttatagcttatgaaaagcagctatgaaggcagagttagaggaaggcagtggtcccttgggaatatttaaacacttctgagaaacggagtttactaactcaatctaggaggctgccttttagtagtattaggaatggaacactttatagttttttttggacaaaagatctagctaaaatataagattgaataattgaaaatattaacattttaagttaaatcttacccactcaatacaatttggtaatttgtatcagaagcttaaaagataacctaatagttcttctacttctataacttacccaaatatgtttgcagagatcttatgtaaagctcttcattataacactgctttcaggagccaaaaattgggtgggggagccccataaatgttgaataataggggtttgattagataaattttggtgtagttctataatggcgtgttattcagccaataaaaggtttgttaaagaatgactgtgacggatgtatatgatatactcttaagtgaataaagagttacaaaatgttatgtacaagttacaaaatgtatgtacattatgatccatttttcataaaatcatatgtatgtatatatgtgtgtctggaaggataaatttatcaagttgttatctctgaaattttgggtatattttatatttctagattttctgttactttgttactttactgataaagtaataacgttgttgacttttgtcactctcccctattaataatcatctaggctgcaaaaggatcatgtcttctttatttttatattccaaggactgtcaacaagtgcctagcacttgacaggtatattatagaaatttaactgaatatctttaggaaatagatttttgtttgtagttgttctagtctacattaaatgtcttgcgcttatgaaacttccttgaattattttagtgaagcaatattagtatagaattttgcatcactggatgcccttgactgaaagctggcttatggcatctcaccagtgtgtggggagtttcagtccttctgttgtctgcatcacagctgaagcagtgctgttgctgacaattcctgacaccaccttgtctctattattgatcattgcctcactatggtactgagttttagcttattcttgtaataactgggactcatatgtatagaataagctattagctcacgtttttgcttgctttttatacagaatacatgtctgcaaatagttttatcaatattttggaattttgggagatatgaagttaaaaacatcattgaatatatatatatacacacacacatatatatatgacactatacatgatttattttatttaatttttaaaattttattctttttagagattaggtcttactctgtcacccaggctgaacttcagtggtgtgatcatagctcactgtaaccttgaactcctgggctcaattgacctttccgcttcagcctcccaaagtgctgggtttataggcatgagccactgtgtctggtccaatatgcatatatatatttttaacctggattatcagagctatattgtgtttaggtttataaagctgtactatgtgaaaatatcacttctaggtttaattttgtacaaaggaattttatatagaaatgaggtaattcagattttttcccatgtaataagaattgtaaaatttactgaaacaaacatcaaaaagatatctgttacatgaccttcctttcttttgaatatatttcaggtgatattatttattaaaatttaaaaatgaaaattaaaatatataaaaagttgaaaattattcctttctttactgtctctcatctgtccattttccattctcctgcattccctcatccaaccaaggtagccaatccaggtaactttttttagtatcttcccagagatgtttctctctatatatataatcaatatacattttttattattccccacctctctttttatgtaacaatatgcagagttttgcttcttgcttttcccactatcttggacaactttccatattcaaagcacagaggacttgcacatatgttcagactgctgaatatttctgtctctcccctgccattcatatgttgaaatcctaattcccaaggtgatggtattgcagggtggggcctttgggaggtgattagtccatgagggtgaagtctttagtaaatgagattagtgtctttataaaagaaaccttagagagaccctcacaccttagagagaccctcacccctttctgccatgtgagaacacagcaggaagacagctggctatccaggattcaggagtctcttagcagacccaaatctgctggcaccttgatcttggacttcccagcctccagaactgtgagaaataaattcctgttgtttataagccacacagttcatggtattttgttatagcagcctgaacaaggacacacacacacacacacacacatgcacacacatttaaatagatgcatagtattctatcatatggatggatattctatgatataatgaatcactattgattgacatttgggttgtttccaatattttgttaacacaaagaacaacactacaaataactttatatacatatcatttagcacatctgcaattgtatcagtaggcttcctataagtggtcaagcatttgtgtacttgtgattttggtagatgttgtcaaatgtccttccctgaaatttgtaccaattcgtactcatgccatacactctaaatagagtgctgatttccccacagcattactaacagatgatattatctaatttaaaaagtttctcatcttatagggaaaatagtatgtcaatgtattcttaacttgcatttcttttattataagtagtgtaaaatatcatttcaacttatacacaggaggaatttctctctatataaagtgatcctagaatcataatgaaaaatatcaccaactcattaggaaaatgtacaaaggattgaatagatatctcatcaaaaataaaaatataagtggcctttaaacattgaaaggtaacatttgaacaaagacttgcaggaggtgagggattagggaatgcagactctgggaagagtcttccaagtagcaggtgaagcaagtgcaaagctttcagatgggactgactatacctgtctggtttgaagaacagtaaggaggtcactgaggctggcatagagtaagacagggagggtagaatactgtcagagaagtaatcggcggtggaggtagggggtaaaccataaagtgctcgtaaagactaaggcttatttctctgggtgagattagaggccactggagagttttaaacagaagtaacagggccactttggctaatgtttttaggctattctgtagggagacaagggaggaagcaaggagatgagttaggagtctattgtgccagttcaggcaagtgatgatggtggcttgatccaggtagtagtggaagtagtatagtaggaagtgatcagattcaggacatgctttgaaggaagatccaataggattaatggataagttgaacaatggcatatgagaaaagtcacagaggagtcaaagatgattccaagctttctggactgagtaactggaaggataaatgtgccgtttactagaaagataatgggagaaacaggttttggatggagcttggtttgggaatattaagtttgaaatgcctatttgacatccaaatagagatgttagttggatgtacaagtctagtttcaaggaagagggggctggtagtgtgaagatggggctggataagattctaaaggaaagagggttgataagaagagaaaggggtgtaggggttagcctaagggcattctaagtattagaggttaaggaggtgggtgaagaaaacccaataaaataaaagtctgagaagacaaagctagtgaatgaatgtggtatcccggaacccaactgatgtcaagcagaagggtgttatcaactaggtcaaatgctcattcatcaagtaagatgaaactgttataattaaccggtgtcttctgaaatacggagataactcgtgacttaatgaaagcaatagtagagaaggtcaaacttgaccagaatgaaattagaaagaataagaggaaagaaaagaccaaatacagacaaccattgatgccttattcttttgatatactcctggagtccacttgctaatacaattgacccttaaacaatacaggcttgaactgcatgggtccacttatttgtgaattttttttcagttaatacattggaaaatttttggggttttttgacaatttgaaaaaactcacaaactgtctagcctagaaataccgagaaaattaagaaaaagtaagatatgccatgaatgcataaaatatatgtagacactagcctattttatcatttgctactataaaatatacacaatctattataaaaagttaaaatttatcaaaacttaacacacactaacacctaccctacctggcaccattcacagtaaagagaaatgtaaataaacataaaaatgtagtattaaaccataatggcataaaactaattgtagtacatatggtactactgtaataatttggaagccacttcctgttgctattacggtaagctcaagcattgtggatagccatttaaaacaccacgtgatgctaatcatctccgtgtgagcagttctctctccagtaaattgcatattgcagtaaaaagtgatctctagtggttctcgcatatttttcatcatgtttagtgcaatgccataaaccttgaataacatcaagcaatccatacaaagtgccactagtgatgcacggaaaagttgtaacagtacaagaaaaaagttgagttgcttggtatttaccatatattgaggtctgcagctacagttgcctgcaatttcgagataaatgaacccagtataaagactgttgtaacaaaagaaaagaaaatgtgaaaccatcagtgcagctatgccagcaggtgtgaagtcttgcactttttgcaaaatacaaaatatgaaatatgtgttaattgactgtttatgttatctgtaaggtttccactcaacaataggctattagtagttaagtttttgtggagtcaaaaattatacgtggatttttgactatacagtgggttggcacccctaaccttcatgttgataaagggtcaatggtatattatttaatttttttgtatttatattcataaataagattaaatctatatttccaagtaatctctataagattttgttattaatattactattatttttgagacagagtcttactgtcaccaggctggagcacagtggtgcgatctcggctcactgcaacctctgcctcccgggctcaagcaattctcctgcctcaccctcccaagtagctgggactacaggcacgcacaaccacactcagctaatttttgtatttttagtagagacggggtttcaccatgttggccaggatggtattgatctcttgacctcatgatctgcctgcctcggcctcccaaagtgttgggattacaggcatgagccactgtgcacagccattaatattattgttacccaataaaaaaaatttggaaacttgtcttcttttcccctgattctgtttaaatagcactggagttacctgttttgaattttttttccaagcggtcccttatgagttttctctatgttttatttgtttcatttcttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgtttcatttcttatatcgtatttttgcaactcctttattgatacttttcttcctgattaggtttctactaaaaccaaacaagctttccatgaattagcttttagatttacttattagtttaactgttctgttgtattgtaactcattaatttataattttatctttattaattattctatttttcttcgcttttttgttgtttttctagtttttgagttagatgtttgacgcttttttaaaaagctgtgcattttcctctgggtaatactttagctgtatattatgtattctgatatatagtgtttccattacattgttttctagaaaatctgtagctttgatttatatttgtttcctctttgacctaagatatcctaagggaaaatttaacattttccagaaagaaaacaaattttctttgttttccaagaatgttgttcaaattatttctactgcttggaatttttatcatttttgtgtatccagtaaatagtcaatatttgtacttgctctctgaccacataaaagaatatattcgtgtagtttctattaatagattagagttcaattcagatattaaatgtacatcattattcatgatatttaggtcttctacatcttcacttatcttttttctacttgctttgccattaacagataaagttgaattaaaggcttctactacatacatttctccctgttattccttataggttctgtaatttttgcttcaagaatattgctttttaaatttaatatatagatacttataattacactctagcattataaagagccttttctttttcattgaatgtatttgggcctgcatatgtctaacatgaaaattatagtcctttttttgtttctttgtttgtatttacagttttaagttccattttcaacctttatgcactctttgctttaggtgtgtctcttttagttagcataaagttaggtttgtctttaatttcacctgaagtcttttcctcttaatagatgggttaagccaactgaaaaataaaactgacttatatacttttatttcaagtatgtcctccacaaatattttttgaatagattagcttatatactttggaatttgttaaaaaaagatttttataaaaaataattgtggtgaaatgtacataacataaaatttatcattttgaccatttttaagggcatagctctgtggcataaagtatactcacatagttgtgcaactatcacctccttttgatttttttttactaattttgtaaatttgtttcatctgagctgtcttattatgttttgttttatgtttttctttcctttattatgaagtcactgtattgtctgtaggctatatgtatctgtgagtgtgtgtgtatatgtgtgtattatggtttttaaaaaagtctatatttgttttccagtggctatacttaatactaataactttatgttaaatttttcattctatgtgactctagttcactaatatgagctctgataaaatcagtgctttttcgaggttaggagatcaagaccatcctggctaacacagtgaaactccgtctctactaaaaatacaaaaaattagccagacgtgatggcgggtgcccgtagtcccagctactcgggaggctgaggcaggagaatggcgtgaacccaggaggcagaacttgcagtgagccgagatcgcgccactgcactctagcctgggtgacagagtgagactctgtctctaaataaataaataaataaataaataaataaataaaatcagtgctttttcttcctctgctacctcctttccttctactcagttttagtcagtagtattatcttttttcagatttatctttgtattgttaaatctgcttatgcttctattactttatttattagctttaaatgataccttttgactttcagcttttcttaataaagcaatcagcaaatttcctttacactccacacttataccccatttcctttgtttgtttatttggtttttacttctaacttttcttattgtcaggacatataacatatttaaactttgtttttcaactcgaattctgccattagttttaatttttgttcacagttatataaatctttgttcactgatagtccttttgtactatcatctcttaaatgactttatactccaagaaaggctcatgggaacaatattacctgaatatgtctctattacttaatctgtacctaataatatgaaggtaatctactttgtaggatttctgtgaagattaaataaattaatatagttaaagcacatagaacagcactcgacacagagtgagcacttggcaactgttagctgttactaacctttcccattcttcctccaaacctattccaactatctgaatcatgtgccccttctctgtgaacctctatcataatacttgtcacactgtattgtaattgtctcttttactttcccttgtatcttttgtgcatagcagagtacctgaaacaggaagtattttaaatattttgaatcaaatgagttaatagaatctttacaaataagaatatacacttctgcttaggatgataattggaggcaagtgaatcctgagcgtgatttgataatgacctaataatgatgggttttatttccagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggtaagaaactatgtgaaaactttttgattatgcatatgaacccttcacactacccaaattatatatttggctccatattcaatcggttagtctacatatatttatgtttcctctatgggtaagctactgtgaatggatcaattaataaaacacatgacctatgctttaagaagcttgcaaacacatgaaataaatgcaatttattttttaaataatgggttcatttgatcacaataaatgcattttatgaaatggtgagaattttgttcactcattagtgagacaaacgtcctcaatggttatttatatggcatgcatataagtgatatgtggtatctttttaaaagataccacaaaatatgcatctttaaaaatatactccaaaaattattaagattattttaataattttaataatactatagcctaatggaatgagcattgatctgccagcagagaattagaggggtaaaattgtgaagatattgtatccctggctttgaacaaataccatataacttctagtgactgcaattctttgatgcagaggcaaaatgaagatgatgtcattactcatttcacaacaatattggagaatgagctaattatctgaaaattacatgaagtattccaagagaaaccagtatatggatcttgtgctgttcactatgtaaattgtgtgatggtgggttcagtagttattgctgtaaatgttagggcagggaatatgttactatgaagtttattgacagtatactccaaatagtgtttgtgattcaaaagcaatatctttgatagttggcatttgcaattcctttatataatcttttatgaaaaaaattgcagagaaagtaaaatgtagcttaaaatacagtatccaaaaaaatggaaaagggcaaaccgtggattagatagaaatggcaattcttataaaaagggttgcatgcttacatgaatggctttccatgtatatactcagtcattcaacagttttttttttagagccccattcttattttttatacactttgagagcataatgaaaagaaaagctacctgcaaaagttttggacttacctcaaagaggatatacttcattcctcaaaaggccttcttccaggaatagtatttcataacctggaggttggaaaaatctggatttgttacaaaaaaatctgagtgtttctagcggacacagatatttgtctaggaggggactaggttgtagcagtggtagtgccttacaagataaatcatgggctttatttacttacgagtggaaaagttgcggaaggtgccttacagactttttttttgcgttaagtatgtgttttcccataggaattaatttataaatggtggtttgatttcctcaagtcaacctttaaaagtatatttagccaaaatatagcttaaatatattactagtaataaatttagtactgtgggtctctcattctcaaaatgagcatttactaatttctgaacactgtgctaggtcctgggaataccaaattgaataagacatagtctatttttctgaagggtttatagcagagtcccctgtgttaataatgaaggagtgtgtggtatgtgaatcatatatcaatagggttgttaaaaataatgaaaaaaggagaagaggaagaacatcttttttttttctgattgcacgggcagccttaaaattatttttgaagtgtacaattcagtgtttttttagcatattcacagggttgtattatcatcaccatatttttggcctcttgaaaagaaatcctgtgcctattagcatccaattaccgttcctttgtagctaagtctcccccattccagctttaaacaatcacccatctactttctgtctctataaatttgtctcttttggacatttcacataaatgaaataatataatagggttttttgtgcctaaataagcttctaaagaagaataaggtaaggaatcatcattcagcaaatatttattaagacttgctttattttatacagtgtactaggagctggagatgaaaatatgtgtagaacatgaatcatatacttcgggaatttgtggactagtgggaaagattgacatatcaataacaaatcgaattagtgatgtaatagaggcatttttacaggagtaaaatgaggtagcatggactctatctgggtctgaataatgtgaggagtaacctccttacacaaagaggcacaaggctaatgtcctctgatggaatgattcaccatgcaattctaagggtgacaagaatgaaagttagggccttgaagaaatattttgattaagagctgccaataaagtagagtaaagattagattgatgtgaagaagtgggagattaatgagtaaatggtcactggcttgttgagaagattaaatgagatgtacatgtaatgtacctaacacaacgtcttgtacaaagtagccattcagtagagactagcttgtattatctccctttgaggtaaagaaaactgttagaaatagtatttctactactgatagtatttcttctacttatgcctccctttgaggtgaagaatactgttagaaaacatgacataggagaaatacccctgagagacagttcttattagtgactactgtgcagaaaagatggaggttggtgtaattaaggagaaggaaagccatgaagccaaagtattatgaaaaagcatcaatatgaattttcatgttgacaaagtggtataaaagataattataaagatggtcacttataaatacggtagttctgtgtgacacaatttacagaagttggtatatcgtgtggaagaaaacagcataagatcctgaaggtttgaactgtgggcacattggctccatgctcaggaaatggcaatggggttgggaagtgattccactttatgtccctttcagacacataaaaattacttgtgtgagtatcttatgccagacactattcactgtgtagtgagcatggtgggtatgaaatgacaactttattgtctttcctgtcaaagaacttgtaggctggttgggggaaagagaccatttcaatatgaagtgctgagctagaggtacccttagggcactacagaagcctagctgatggcttttagcctggctagacagttcaggatctctaaaagcaggtgccttgaaggctgagtcaaatacaaaaatgtattttggacagaggaaattgtatgaacagaaacacagaacatgaaactacttggttggtgcagggtatcatcagcatagaaccagacagaaccagagtgtaaataagccagaaggccatgtcatggaggccttgtataccagtctcaggaatttggttgtggagagctttcatcaggggaatgatgtaatcagcttggaaatgtagatatatcactgactgtgatagtgaggagcagaattaaggtggacgtgattagaagctttgtgaatagcagaaagaacatagattttgaaagctggcagacgtaggttactgaagaaagttacttaaccttgctatgtctttagttttatcctctgcaatatggggataatactgcctattttgtagagtcttgtggattcttctggcatatataatagaaaataaaacagctattattattattgttgatggtactatttgctatatctgactacaaggagaaagactaataggaaaccatttcaggaatccagatatggtcatgatggacaggaagagacaagagttacatagaggaattctgggaagataagaaatgtcatttttatgtactgtttgcatccatcagacaaggcatcaggaaaaatgatccttcaggaaagagtgattttttttcttcaagaaattagaagaggggagaaattggtttaagattaaggactccatgcataagagaaactgggagggaagacaggtagaaatgctatggggttaggaaggaagaatgcagaggtggattacttagaattgagacatctgatcaagacagagggatcacagcttttgctaacaaagtactagtggaggatgccactaggtgaggtttaataaataattgttgacaataagttccatttaaaaaataaacaatttatgcttcttctttgcctaagtgtcaaataaaacattcagatttttatttcaaagtatccctgagtccctgttcccttttttgtcctgctgacttttggaactgatttaggcttccttagtcatctcataatagaaaaaatcagccaggtatttcctacatttcttgtattttaaaaaaatgtaatggatgtaatgaattttaagcaaatgtaatgaatacaataagtaacttagtatatgctgttttcttctctatgctgaatgtttcatacatgttattttctatacaactacatggtcaattccttgaaaatatcaactccaaaatctttattttggtatactccacgtagcacattgagagagttttaaactcttgttggatgactgtttcaaaagtgttttgaagtaggcatgtcagttgcaaaaagtttgctcagcaaatgttgttctgtctcacagtctcagacattgagcagatgattacatgacagcacgtgattgctgggagtaacagacaaaagtaactgaaagtgctcggttatcttgacagtcaaaatcaaaagtgtcccctattttcagtgacctaagagtttctttttgtgtttttggtattgttgttaaataagtgttctcacctttgaaaaggtcaataagaattcaatacagtataatgtctgtgtgccaaatgaaggtgccccttatttttaagtgtggaggagttttgatcataagaacttgaaatacctacagaatccttgatggttaagcagctggtgccagcacaagaatccctcaatatgttctctatgaagccccgatcaccaaatgcaaacattcatgattcagtatattttcatcttgactgccaaagttgatctgtttcttaatatattacatctagacttggaactggagatgagaacagaatattatcttcctcatttttgtgtttttgttcaactctaatgtctgcaaagcacttgcgtatgtaatgatgctcagtgtcataggagcaggcaggtaagtgtaaatttgtctggataggagaaagcatgcacaacatatttcacatagttttctgatttcagtttgtttttgcaaattattcactcagtgagatagcttaaagacgttatcacagggaaaggcatggagatagttctgtgttgatagaaaacttgtaatgtacagccatgagtgagaagtcaggttcagattcttcaccttcagtcctcctctttcataaacagctccatgtcctattttacatatcctactttaaaacgagattatagaagaatgaatttctaggcaaagtgacacttattttaaaatactattacgtatccctgtgcccattaacttatcctaccatttttcttcccctgtgtccaaaccacctttagaatctcctaaatatttgtagctattgtaaacagcactggagactttgctagtttaaaaggagaaatcaacgcaattaagccctagttaatttacttatcccttatgagattataattgtattttgttattaaaagggggacagagtacactgttctcttgcctttttaatttccagactaccacttctcctgcacttgacaataccgcagtctaccacgtagtcccatggctgacaggaggagaattctaggcaggccagtgtttgagtagtgagtaattggactgtctttacccagcaactcactgttttgtaaatgtacctgagtttggagaagtaattggcttttataaggggtgcggggtggagggttggggtggggagagtgagaaggaggtcagagctttaggatatataattggtctccacaaagttgttgtgatacttttggaaccacgtaatggtcttcattaactaagtgtctgtcatgacagccattacatatgcattataataaaaatttatttacagtgtaagttgaagaaggtaaaatctggatgtagtttctaaactctgcttggcagttttcatatttaagccactagaagaaaaaaattgggagggaagctgagaagaatttactgaaagaaaaaaatacttgggagggaaattggcaagaagtatgaaaaagcttgggagggaagtaagcaaataaatgagttaatgactgttctggaaaataaactctatcatgcagatatcacatgactgattaaatttgaatttgacctcctgctttccaggtctggtaaaaactaacctgtaagaacttgaaacttagcctttgaatggtcaatccaccactgtaggagaatttatgaatgttcagttgagagaactgaaaataaagaagtaccataggaattaacatttgcattcagtagccaagatataatggacatctgaaacaggtatttgaggccaggcgtggtgtctcatgcctgtaataatagcactttgggaggccgaggtgggtggatcacaggaggccaggagttcaagaccagcctactaaaacacacacacacacacacacacacacacacacacacactagccaggcgtggtggtgcacgtttgtagtccaagctacttgggaggctgaggcatgagaatagcttgaacccagaaggcggaggttgctgtgagctgagattgcgccactgcactctagcctgggtgacagagtgagactctgtctcaaaaataaaataaaacatatatttgaaacacattgaattatgtcccttaaacaagaataaacatcactaaatgactgtaccttgaactacctgtaattttctcctgataggtaattaagcttcaaagtactgacacttatttactgtaatatgaagcaataacttaaaaaaaaaaaaaaactattgaaccagaaccaaacaggaatgccatagcattttgtaaactaaactgctatttcatttcatttgagccctggaacttgaaaataaatgctagctaacatctgtgaacagaacatacccatcagtactgtgctaagcacctttcatgaactggtcattaaatcctcactttccatttatttagtgacaacttcacccagagtttgcagtcaaagtgaaaatgtgctgaattccaaaagtgtgagctaggttttagaagttaatcacaattctggaacaaattactagcttaacaaatgagagttcttatgtctctaaaaccaaaatagccctaagtctgtccctcccagtaagatttgggccagtcaatggaacagtaatatacaaatataattacagctgtctaggagcaaactatcctatgaatagataataaaattaagacacttaagccatgttttcatattaaaacacaaagtaaaaaatcattgttttccaaagataaaagccatactgtatcatgacatatatatgcccgatgtttcgaccctcttgaagaattgagattctcgactctacactcttagcgttttctatattgaacagatgtttaatttaaggaggtcaagagaaatcttacacttattttttaatggtaccttagacatagaaggaacctcagaaatctctggctgaatatttccatctgcagatgatcatgtcattaggcttctgactctatagccatagaaaaatattcatgaagacctttcaggaagggaatgttggtatttctaaaaattgagtacaagtattctctagacaaaacagctcttgaaatggcagattgtattcccattattatatttcagaatcaagacattaatacctactttttatttaccaggtttagttatccttgaattagattttataaattaaagaaatagatttcaataaatatttgttgagttcctagtatggaaacatcgtgtttggcaccagggatgttgcctgcaagtataacaggagttcgtatttgtaatgagtttatgatttacagatatttggggggcaaagatatcattcggtaaatacttatgagtgcaaactttgaactagggactgggccaaactctaggaacatatttgatgacagagacacaatccctgtcctcaaggagctttcattctagtagagaagatgaaaaccagtacagtttggtaagttagatgatattggttaatgtagggttcttatgtaagtctagagaagtagcatttaatctgttcttagaaggtcaggaaagatttccctggaggaagtgacatttaagctgagagaggatggataaacaggagtcatctgagtgaacaacagggagaacattccagaaagagaacaaaatgtacgaggcctgatgccaagagagaacattcattgcattggggaactatagtcacttctgtgtggctgggatgtagaatgaaatgagcctggacccaagagagcactttgccctttggggaagctgtaggtattacagtaaggttggagtctggaaagaaaggggtatattgtgagatctgaattgggagaggacagttatatccagacctttatatgctccagtaagaagactgaactttacactgggggccatgggactcactgaatggcattaaatttgagagtggtcatatgaccagatttgcattttacaaagattgtcattgactgcaacatgaagtatggagtattggaggagcggtaaggctggtggcagggagataatttaggaggctttaggtgagggatgataatgacttgccaggtaggaaggagtaaatttcttctcagtggataattagaagattgaatggatggacttggtcactatttggtatagaaggggaaaaaagatgtcaaagatgatgccaatttttaaaaataatttaacatttatttttaaatattttttcagccttattaaggtataatggacaacaattgtaggtatatgtcatttacaacatgatgttttgatttatgtatacattgtgaaatgactgccatagtcaagctcattaacatatccatcactcacataattaacattttgtgtgtatgcagtgagaacatcaggctctactctcttagcaattttcaagtatagattacatttgttaccaactatagtggccacactatacaatagagctccaggacttattcatcctgcctaactaaaactttgtactctttgaccaacatcttcccattcgtctctcctccccatgccaagtttccatcttggtcagttgggtggatagtagtactatctgccgaggcaggttggtagggtgaaaacaatgtgttcccttttggaaatgctgaggtgaccagggaacttccaagggaatctgtctggatctagagcttagaagagatgtttgggctggaaacagacatcaggtattcttcagtatatgggttgtaaatgaagtcacaggagtgggtgatatcaccaatggtgagtgtagtataagaagactggactgaggacagatttccaaggaatttcaatacttaagaggtacgcagagaaaagaggggctgtgaaggacaccaaggaggagactaagagccaggagggaaaactttcaagagagtattgcattatggaagggaagaagagagaacattttaaatgatacgcaatgctcaataatggtatccgctttggagaggccaagtaagattcctaagtacccattggatcaaggtccttaatcttacaaaaacttatgcaaatcaataataaagagatgataacccgataatcaaaaatagacaaggcatataagaagaaaatgaattaaaaatattcaaagcattcaacatatacaaatgcgctcaatctgatatataatgaaagaaaagtaaattaaaacaacaatgggcatgactaaataacagtatgagggagcctgaggagaaggagcatttgaaatttcagtacagaagagaaaaggggtgacttatagaaaaaggagacagaaaccatagaacatgtttggaggataagactcaaacaggtagtggggacccttttctagagtaggatgaaaacaggtaatgtgtgtggatgcaaatatgaggtaggatgtaatgggaagttgagcgaattcatatttagtcattcattcaaaaatacttaattgagttactgctgtgtggcaagcatcattctacaaacagagggcacagtgataagcaagccagtttgtactctcgtgtaacttacattctactttgagaagacagattataaataggttaaaaagtcaataatatgatgtttcagcatcaacaataaaaaattagggtgatatatagagtgccagggaaagtgctttcatggacctcttcattctctcctctcctggtgtcataagctactccttcatccatgctgccatttctcttggtttacggttccagtatagtactcatcacattattactatagagccatccaccttatgaaggtgaaggtgtccatctccttacttaaaaaaaaaaaaaacaaacaaaaaaacaaaaaacccgaaaaacaaaaaaagaggcagaaagacagaaggtcctccactaactttcacgtgccatgtaaccagcgaaatccaattattttacagcattctagctatagaagagtttgggaagcgtagtgcttagtgttctagcctttgtagcacaggaaagggcctggaaggaaaggaattgtgtcttccgcagttgcttttctttatggggaagtgctatagcccaaacaatattttaggaattttcatctattgtcaatatgcaaactggaaggggataatgaaaatgttgtggttagaagtttatgaaatattgttattcacattttaaagtaaaaagagggaatgtttaagagacttgtttaagatcacatgtctcataattggtgggaccagcaatacaatccaaatctaactacttatctttttgctatgccctattagtgttcatattagaaaagaaattctatctcagacactaatgatttgttctttggacaccaatgactttaagttaaaacttcatactagttaatttaattatggtgtagcagtattattaaactatcaagactataaattttctatttgtaaaggagattatgataccaaagattagtgaactaatgatattgagaattctatgacataattttgaaaaatatttgcaggatatttatttttgtgtaaatgatgctttcaagctaccataatcctaagtaagtgtatatttgggaaaaccacctattctaacacacttgaaatttaaataagtcaggaaatttttttccagatcttctcccaaattatcttcatctttttcctctccccttgggaaagaatctcttcatgcctcataatatcaaatttaaactatggaagtccaggtggtggacagtcagcaaaggggaagatgagaagcttgtgttataaagccagctcttgtcagaataaggatctggtaggaacttcagaagtgatgggtaggtaagtatgaaggccaggtcctaagatctaaattacaaagcagaagacttacttaccagggagctggaaaacatgttaggaaatccagagcaggaacagatttcaagatagcacaataatatagcagtgaagtactgagaaaagagtttttttcacgggttggatttattctagcattttaggcagcatttgggcatttctaagtggtcagacttagaggagatagttaaggaattagcagctgctaaatgccaattcttagaccagttgaatcaaaatcatctaaaaagctttcagaaaccagactttttaagggccatttgagagactctcaaatctggaatccagaaatctatagctagatgagtttaaggtagagccagaataagaaaaataaaatagtttgtttgtttcaggtatcttttccaatattatttccgaacctaccccaaacaccttaaatcactgcattctatagccattcttttaaaaatgcttgagttattagttttcaaaaacaaatacaaatctgcacacatacagaaataaacattaaagagacataaagatattaaacagagttacatatacttacaacttcatacatatatattatatataaaactgaatattaagtgtttgatattagtgacaaaatctgtaacatccattatattagtgctttttgtactttttgttgggtgtagtaaaaattgcattcgaatttgagttttctgctatatatttggtcagttcctatcagtgaaggaaaaacctttttttattattttattgtttttttattttttgagacggagtcctgctctgttgtccaggctggagtgcagtggcatgatcttggctcactccaacctctgcctcccgggttcaagcgattctcctgcctcagcctcctgagtagctgggactacaggcacctgccaccaggtccagctaatttttgtatttttagtagaaatggggttttgccatgttggccaagttggtctggaactcctgacctcaggtgatctgcctggcttggcctcccaaagtgctggaattacaggtgtaagtcaccacgcctggcccctttttattttttaagctgattgaagattcttagttctcatgctttctagtggtgattaatctttagccaatatttctatatacagttattagtaatcatgtttgacttaggtcaacaaacaatctttcctaaaaaaacagaaccccaattttaatttctgaattatttagtatctattttctgctgtggaagttgaattatgttgatagatatcatacagggccatgtaacactctcagatacacgttcacatgtatagtagctgtatacaaaaatgttacttcattctctctctctttataatactcttggctctcttacgttctctcacacactctactcttcccttcctctgttctttctacttgttccctctgctcctaccacacttattccccccttgtccattttccttgtgcataaagcacaagtgcttagtaattatcaaatattaataacaatgacactaaccacccaatgatttagtgttaatgacatgctttattgaatggcattacctctaaagttcatgtttcctttacccaaccaagcttcttaccctcctcccttaccacaagcatctatattgtcaaggttgttataaagagtaataagccagccattaaaaaagggtttatggtattttcctatctacaaagtcacaggaagctcaaatgtactcagtaaatattgcaaaattacacaggaccattaaatgtaacactccaccctttctctctctctctctctctcttgctctctctctctctttctgtcaatatagcaacaccctatatcattgccctttgtatgtgcaaatcagagttaataagctttatattagcaattactccttaacaacttctggtttgtttggtccagttgaataatgtaagcacttaaaaaaatgaaattataaacatttatgtgaaaagtgcatatatcacattggatatgttgttatgcactccttaataataaagtaagttaatctttattgcacacttattataatattactttgaccctctctagtactctttatctaagtattctcaagtgctttacaatctcaaacagacccaatgtgttgtatacacagaatcctttgaagctgacatttgcctttctgaccagcttgttgtaaaggaaatcagccaaaaaacaagtatctagatgagtagctcaaacattagtacacatagtaatcacaggtcaaaatgcagatagattaccctgtccaaattctcctgagtaagagtaggtgaaacatttttaaataagctccccaggtgattctgaaattggtccaaggaccacatattaagaactaatgatccaaacaatttgactttttattgtagattaaaccatgctgagaaaattattaaaaattgaaatggcagtggaggatggtttgaaagaaaggtttttcagggccctttcaacaataaaattaattgaacacaatattaaaactctatatttgatttaagactaaggttttcattgtttttaaatctcagtaatttttatgtaacaggtcaattcatacccagcatcttaattccaatgaatgatttcccacaacaatttttgtggataactccaagggaactcgaaggaagttgtagtatgaacaaagagaagtagaatttgtccctgtgtgtaaggcttctctgataagcagcacaggctctcatactgctttttaaaaaaattatgatagcatcaagtggaattaattttttttagattatactttcatggaagggaagatctactgtgaaggctggaaaaccaacacccttaagataaatatattaccagatttgagcgctcttagtaatcagcaaagataaatgtttaacagtgcatacaaaatgaagtgttttatgttaaatcaaatagagaaagccaaacactaataatgtggttacaaatgaacaataaattaggtaatcagaacaggtacagacattaatagcaggatattggtattattaatgtattttgttttaaaataatgaacttaattacaattctcctcatcctaccccactattttattttattccagattcagcagcttcatattatgtctctgaaacacttattattaaagttatccaaatgtacacatttctctttatataaatgtttcagtccagaaaaggaggccaaatacattagctcagaacatcaaatcttctcagatgtgggaatcttttattttcacacttttaaaggtaatctgtatttctagcgtctattatagacagaaaactttcatatgacaacattcctattttcttaactgccttgataggggcgaagacaaattctaagtaggactttttaccccattcttcttaccatcattctttcacaaaacccccagctttagacaatcgctattatgaatttgacatgtactattccaatccattcccataaatttacacccatatatacatatagttatctatgaacaatatttagtagcttttttgtgtgtggctttaaaatttacataaattgtataatttgtgcacattcttctttaatttgccttcttggctacggttatctttttgagatctagctatgctgctggtatgtagaattctatttcattcttttttcattgttgttttgtacccataacgtgtcacattttatttataccttctgttcctgatggacatttagattcttccaggattttactcaatactgcaatgaaaatctttgaatttttctcttttgcacatattcaagagacttttctgacatatatatctataggtgaattgtgtagtcatatgatacatacacacattttaaatttcactagatactgccaatttgccctttgaaatagccatacaatttatagtaccaccagccacttatgaaagttcccatttcctcaaatctttgaaagttcttattataaacagacatattaattcttgccattctgatttgtaaatcagaatctctattgttctacctctagttctaatttggaattccccaattacttgtaagatgctatatattttcatgtttgttagtcattctgatttcatatcctttaccaattatctttttggtaagttattgtggtggccatgagatgtgccttacagaggccttgctagagggaatgtgattgaatgagagccccagatgctgtgtattaaaatcctgcactgagtttgtctcaagatttcttgcacgtgaatgaatgagtacagctgggatactaaagcagatgtgtatttgggagatatgagacttctttagtggctgatttttggctcataaatgactttgccaaaccttccttagactgctcagtgttctaacatcttccatccagccttctacccttctttcctttactaggggattgaatttacattgaggtctcatagccttctctgcctctctccttatttccttttatacaaatatttcccctaataaatccatgcacatttaataccattttgctatttgcaacctgcaggtcctggactaacacagttctatacattgcattaccattctctagagtgggatcttttgttgtagagagttttaaaatttttatgtagtcacttttatccatatttttctttatggtttatatttttgtgtcttctctttaacacatcttttctagcagaattcataaatatattattctatattgccaaaagtttgaaagttgcaatcattagaattaatttttgtatattgtgtaagttaagaatctaattttattgtttttcattggaaagccatttgtcccaagataattttttagtagtccctccttcccctattgtcattctgacatattttttctaggttccgatctatgcatgtgtttctttatggaagagttggccctttgtatctttgagtttcaaatccatggattcaatcaaccacagatagaaaatatttagaaaagcgtcagaattgaacatgtacatacattttgcttgtcattattccctaaacaatatagtataacaactatttatgtaggatttacattgtattaggtattgtaagtaatctagagatgatttaaagtatacaggaagatgtgcatatgttacatgcaaatactaccccatttatataagggtcttgagcattcatggattttggtatccacagagagtcctggaaccaattccccacagatgccaaggcacaactgtatttattctatcatctacttgtttaatctcacatcagtatctacttttgaaataacaataactttattatttaactttttttattacttaggattagagaatttcctctggtgaggcatcatagtgtctcaagctggccataaagacaagtgagggctaggatcggtaagactgggcagaggaagatacaacagatctcctatgcatgaagcaaaagtgcagctcagaagccagctctttcattaagttgtcctctataccctcactagattgtaagctcttgaaatgagaggctataccttaattgtctctgttatctaaaatacttccactcactgcttggaacatattgcctgcaataattaagcttgccctggctcccaaagcatagagcaaatcacactcctccccttgcctttgagaagctcacagtcttcgaaggtagagatatgtgaacagataagaaaatggatgacaggagaacagaaacgcatgactgtcagagaagtcattggagactttacagaggaaattaaatttttattgatcttgaaagagtttgccagatgaagtagaggacaggcattttagacaaagggaacaggaaatgtgaaaacacaaagtgatggaagtcatggtgagtttggagaactataaaacttcaatgtggctgaagggtaaggtggatatagaggagtgctgggaggtgaggctgaagaaataagctaggaaatgtctttttatgccattttttaaagtttggactttattctgaagttcacatggatccaatattttttgttttgtgttgttttaagcagaagcgtgacatgatcagcttgaatgatgaacaacttgaattgtttaaagtggatcacacagtctactgttttacagttattctttgaccaagatattctttattaactgaggaaaaaaagggctttcctgaattttgcagtcatgggatatatgataagcattcttgatttatcatcttcaatcctgttacataacataataaccattgttattacctttagcaatgctttcctcagtattatctaatggcctataaaatgtgactttcatttgcaaatacagtacatctaacaagaacttaccacagctgctatgcaaaataccaatacaattgacccttggacaatgtgggggttaggggtgctgattccccatgcagttgaacatgttacataacataatacataaccattgttattatgtaacaggattgaaaatgataaatctttggaaagtggggcaaatgaattcttatgaattccatatcttccacatgtgttttacttttttgataagaagtagtaacctagttcagaaagaaaataatcatccccttttacttatgcaggataccaagtctatcttagcaccataatagtgaatgataggaatcaagctctatgaatacattcacatgtacatatatatggctatataggacacatgcatgcacatatacatatatacacttgcatatatgtgtatatacatgtacatatatgcatgtatattcaattgtatatgtgtatatagccaagttattgtacagttgacctttgaacaacacgggtttgaactatgcaggtccacttacacgtattttttttttccgtttctgacacccctaaggcaacaaggccaactcctccccttgctcttcctcctcagctgactcaacatgaaaactatgaggacgaagacctttatgaagattcacctccacttaatgaatagtacatacatttctttttccccatggttttcttaataacattttcttttctctagcttgctttattgtaataatatagtatataatacatataacataccaagtatgtgttaattgactgcttatgttatcagtaaggcttctggtcaacagtagactattgctagttaagtttctggtagttacaagttatatgtgggtgttcgactgcatggggagtcagcaccccaaccctcatgttgtccaagggcgttgtccaagggtcagttgtaattggtattttggatagcagctgtggtaaattctggttagatgtactatatttataaatgaaactcacattttataggccattaaatattattgaggagagcatttctaagggtaaaatcttgtctaatgcttgaaacatcttcattttcctgtcagtttagatctttttgaagtaattctgaaaatctctcttttaagctaaatttaacacaaccaaatagccaaatatttaagttccactaatgaagatatctaaatttctgttaaaaatttaagatatatgttaaacccttctaatataactcttctctcagtcaaacttttttttttaacagttgctttgcttcttctttcaaagtcatacttcaacaaagttgctattgaatatgtctgactaaacatgttagctatatgataagatggctggataagagataaatatagaaaatgtagctttttttctacttgcaataaccctttaggaattaaaatggaaaactaataactatttgattcataatagtagcaaaccgtaaaatatttagacataaatctactaagaaatttataagacatatatggagaaaattcaattgaataaaccgttattgaagtatataaaataagatctggatgaatagaaagatcataatttttaataaaattttgcatcttaaaaagtgaaccctctccaaatatatgcacatttaataaaattataaatacatcccaatgaggttggttttgaaattttgttaattggaacttaaatttcacctaagaagaaaaaataaagaatagttaagagtgcatgctttgtagacaaattgccttagttagaatcctggctctatcatctattagctatgttatctttgggataacattcatcttttcttatagatatgcttaaaacagtgcctgacatatagtaagcacaaatatccattagctattcttcttattatttatgttattagtattgttaatatttgttattatatggaagactaaatgaccaaagagagtcaagaaatttatgaataagatttatgcgttgttagatattagagccattaaaaaaaaaaaaaccaaagtgccaaaaaacctagcacagtgttaatacaggaataaaaaaatggatcagaggaaccaaacagaaaagccagaaatggatcttaggaaacatgagaatatgatatatgatagatgctaaatgaattcagtataaaaatattaatgtaataaatcatgcttgctattcaagtaaaagaaaatgaggttagattcatgtctcataccaaatataaccataaattataccttgattaaattttttaattaaaaagcaataatatttgaaaagaaatataggatactcaatgtataacctgaaggttgggtagtacttttcaacaaatataggaatttttcacttgaaatactagaagaaaaaaagatagcaaacaaatacaggaattccaatttcaagcagatataatgatttcatgaaatgttaactgtgcacatgatagatggtctatggatagtgcaaaagaaaaagagaaaagaaaaaatgttttttaacatatgcagcaaaaaaggtttttaacatctattacatacaaataaaaatgaatgtataacacagacttcaataaaaataggcatttcacaggagaacaattcagatggccagtatttacaatttcataggtattaaggaaaatacaaattaaaatggcaaattagcaaaaattgaggtgtgattatattaatatctgttggtggtggtgattatggggaaaagggtactttcaaaacttgctaatataaatataattcttttggttgttttgtaaaggaacctgacaatatcttttaaaaataaagaaaacgcatacttttgacctagccatcccattcatgagggtatgtcttagaaaaataagatcacaaaatcatagagatttatgtgcaatgatattattggtaggtcatttttatgaggaggggtgtggatagtaaatgccagggtaaatcacatagcatctaataaacgtatttatgaactacaaaagcttacactttcagtctagtctagtccagactgcaaataaatgtgagcaagtgaattcaagcacagaagtgcttgaaggcaggtttcataaatctactttcttacagtatcctgatattgacttatcgagacagttactgtggggttgattattaaaatatttatgtatctaggtatttttcattcagtagtatgttattcaattagcaacaagtgtggggatttaaagatattcttgtttgtttttactgctgaaacatattctagtggaaatttcgaataaacgattagtcatcctaaaagcaagatacattttctcagaaaagacaaggtaaagaacttgtatatcctccctcaattcgtttataaggtaataagatgaataaaaatatcatagtacaatttagcattgtaaaataaaattaattggtcatctctagtgtggtcgtgcttggaaggtgaaagaagccaagatcttgtctgggaatatcatgtctaccttgacctcacccttaagaatcctagcctttagtttaaaatcacatggctacatacataccaacttcaacaatagtacatctggcaaggtcatgcaaacctgggacttgagcttctgattctaagtccagtgctttttgtgtacatcatctcttgtacataccttatgatgatatgctaataaaagctacgtgatcaggccttaaaaatctgctttttttttgtaatggtagaatggggcatattatcacatcaggtaaacactctattcaaggataaatggaaatgaatgtcatatatagatcattgataaatatctcattacaaaattatgagagttaccaatgtttgagtgtatattatgggccagccctttatattaaattacttcaaatttttacaactgttaaaggaagatattattatacccattttatagatggacaagttagggccagaaaagacttcctcaaagctgttagtccagtaatggagacagggctagaaaacaggtcattttgctctttgactaatgttactactcatgttttgtattttgtttaaagttttattttattttgctttatttattttttgagacaagatcttactctgtcacccaggctggagtgcaatggagtgatcacggttcattgcagccttgacctcctgggctcaagcgatcctcccacctctcaatctccagagtagctaggactactacaggtgtgtgccaccatacctggctaaattttgcattttttgtggggacagggtttcactatgttgcccaggctggtcttgaactcctgggctccagcgattcacctgccttgacctcccaaagtgccagtatcacaggcttgagccaccatgtccagccaagttttattttagaattaaaaaaaattccacttggattgttacattttatctcattgctttatatttatagaattactttataaatgccactttcttaattttcatagttagcactctttatgaaacataaactattatttgacccaggtttttgttagaggaattgagtcagagagctgttaagtaactgagatttcacaataagccagacagaccagggttcaaattctgggtctcacattatccaattcaatattccagctttgttacttattgagcaaccactacaagcacagtttacatgacatctgatagctctcaaaatgaattttacaaacataattcagatttcaactcagcagtgactcaggagaaaggacacttggatgcatttctttatggcatttttcccagggtacacgcaacctggaagatctcccaagtatgggggaaggtttcaccctgaggaatcccattccctctaatctgggacaagggggaggagagtactgtctcttatcagccatctccccagggaggcctgggccctcctggaatgcataccatggcttactgactcaaagtgttgaaaagaccaggcattgggacacacaacactactcttaaaataaaaaaagaatcagagtagcttgtggttataattgaaatggacagagtaacatggtaccaagaaactattagcaattccttccctaaatccctcattttcttaaagcattttctccttttcctcaacaagctttaagttggatttgaagaatgataagactaaaaggagggctgtttctggtctttggaggaatttgatattccattcgatctgagtgtgcaaagcctgagttcacatgaactcttctgatctctttctctaatattttttcaccttattcatatgggaaagaaggaggggaatactttagttccattctccctcctcctatttccttgacttgtttaaaatataaatgttatagacacctaagatagaaatttgactgaaacagcctcttaattattgtcttaaaaaattggtataatgaaattgcatttgtagtctttggacatttaaatccagaagggatattttctttttcttttttaaaaatttaattcaatagtttttgggctacaggtggtttttggttacatggataagtgctttagtggtgatttctgagattttgatatacccatcacctgagcagtgtgcactgtacccaatatgtagtcttttatcccccccccgctccacccttcctttatcgtccccaaagcacattatataattattatgcctttgcagcctcatcgcttagctcccacttgtaagtgagaacatgcgatatttggttttccattcctgagttacttcatttagaataaattgtctctagctccattcaagttgctgcaaaggccattatttcattccgttttttggctgaatagtattccatagtgtatatatgccacattttctttatccacttgttgattgataggcatttaggttggacccatattttcgcaattatgaattgtactgctgtaaacatgagtgtgctttttttttttccatataatgacttcttttcctttgggtagatacccagcagtgggactgctggatcgaatggtagttctccttttagttctttaaggaatctccatactgttttccacagtggttgtactagtttacaaccccaccagcagtgtaaaactgttccattttcagcacatccatgccaacatctattattttttgactttttaattgtggctattcttgcaggagtaagatggtatctcattgtggttttaatttgcatttccctgataatcagtgatgttgagcattttttcctgtgtttgttatttgtttgtatatcttgagaattatctattctgtcctttgcccactttttgatggaattatttgtttttttttcttgctgatttgtttgagttccttgtagatcctggatactagtcctttatcggatgcatagtttatgaatattctttcccactctgtaggttgtctgtttaccatgctaattatttattttgctgtgcaaaagcttttcagtttaattatttcccatctatttatttttgtttctgttttatttgcttttgggatcttagtcatgaactttttacctaaaccaatgactataagagtttttccaatgttatcttctagaatgcttatgttttctggtcttagatttaagtctttgattcatcttgagttaatttttgtataaggtgagcattgaggatccagtttcattcttctacatgtggcttgccagttttcccagcaccatttattagatagggtatcctgtccccactttatgtttttgtatgctttgtcaaagatcagttgactttaagtatttggctttatttctgggttctctattctgttccattgtctacttgcctatttgtgtaccagtaccaggctgttttagtaactatagccttgtagtataatttgaagtcgggtaatatgatgcctccagatttgttctttttgcttagtattcctttagctatgtgggctcttttttagttccctatgaattttaggatttttttctagttctgtgaagaattatgatgatattttgatgggaattgtattgaatttgtagattgcttttggcagtatggtcattttcatagtattgattctacccatccatgagcatgggatgtgtttccatttgtttgtgtcacctgtgatttctttgagcagcattttgtagttttccttgtagagatctttaacctccttggttaagtatattttcatgtattttagttttttttttttgtttgtttgttttgttttgttttgtttttgcagctgttgtaaaagggattgagttcttgatttgattctcagcttggttgttgtcagcagggacattttctaaagtatagactgtagttccttatcttctatctgtttcttactgtccccttcagtattcttgtccttttttcccgctattatctttttgaccttttaatatatagatatctacttctacttctgacaatttttgcttctccaattttctttctttttctcctctgcacacatttatttattttcttctatgtacttctttatttttaacttaatatttgattaacttcccttccctgtctcttttccttctttccataaatcttcattaattgcctgcactgagctaggattctatactctctaaatcaataatctattttctatagtcaactgtgttataatcgtactgtcaagataactacttatttttaatacttaaaaatattttgaaattttaaccaatttaattaatacaatgttgagttcaaatttgaaaaaaacaatggaaaactgtaataattctagcaacctcctgctttttaataatgtattagaaaatttgcctctttttcaaaagcctacagtgaatctattcatacaaggcaaaagcaaaccattctcttcattctctttttttctccaaaagatttaagtgttttttgtttgtttgttttgttttgttttttagatattgagtcttgctctgtcatccaggctgcagtgcagtggtgtgatcatagctcgctatagcctcgaattcctgggttcaagcaatcctcctccctcaccctcctgagtagctggggctacaggtgcatgctaccatgcccagctaatttaaaaggaaaaaaattgtgtagagatgggtcttgctatgttgcccaggctggtctcaaacttccaatctcaagcatttctcccacccagcatcctgaagtgctgagattataagtgagccactatgcccaaccagatttagtttttaaaaagagaatacgatttgaaaaaggaaaaatgtgaggcaggagagaagaaatacacacacgagctgttttgtaattgctgtaaaactgaaatcttcagcctcactaaaggagcacttgcatgaacacctctaaattaccttattaccttctaaattaggtgtgaagtctaacttctaaattatgagtgaaatccactgcaattcttgttatttggatggaatcctaggtatgtggtccagttcatgagttgaacaaaagcatgctcatttaggccaggtagaaagaaataaagacctatgttttacatgtctcataaccactgaaggtccttctcataagcagtgcttatgggtattaacgacctctctatattttacttctccagtgcctaagtagccgagtccactgagtcctgctacatctcctccaacatgtcagcatttttttcacaggccttttgttactctagatcagaaatgttgatagcaacagttccttgagggcagcagctagcatgatgccagccaacaggaaccaccaaatggttcttaatataaattactacttattaatctatttactttgtgcatttggagttttgcatgtaaagtcctatttatgtccatatggtagataaatggaacaaatgaataacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaagaattccacaaatttagataagatagagtatatggcttctagacatccaacatagaactgagtttgtgttatcagtttaagatttggttttgctgtaaggtgcacacactttgaggaactaaaaataattgtctgttcttattctgatcagaatgtgtaatgtgttgtccagttttggatgatgaatttcttatttctaatctcataagaaacttgtcatagatgtgagggagagaattaagaacagagtgtggggaagaaactgtgtacattttgatgggatccattatgtagctcttgcatactgtcttcaaaaataagttacactataaaggttgttttagacttttaaagttttgccattggtttttaaaaaaatttttaaattggctttaaaaatttcttaattgtgtgctgaatacaattttctttattacagaagtaccaacaattacatgtataaacagagaatcctatgtacttgagatataagtaaggttactatcaatcacacctgaaaaatttaaatgttatgaagaaattatctcatttctattaatatgggaactgtgtcttcatctttattactgttctaaggtcaactcaatgtagattttacttgcttatggtttcatattttagctaaatagtaaaataatatggatatacattttgttgtgacttactcatactttccttatttggaacttttatgaatatgatatagagactgaaactacaaggaacaaaatgcaatatcaattatacagttgtggcagcactgctgtcaatttgttgatagtgtttaacacttagaaaaacattttaaaaataatttcacataagtaatgtaatttattagctgtctctgacattttacagtttggaatagtttattttctttttggtgtcctcaccaaaacccaacatcttcaagggcaggaactgtataatttttgctattgtattttgagcacatagcatggtacttgcctctaaatagatactattgttaaaatattttttaaggtaatattttaaagtgtatgctatggtacagttcagtttgtgacttttgctagtttatgccacttacagttagcaaaatcacttcagcagttcttggaatgttgtgaaaagtgataaaaatcttctgcaacttattcctttattcctcatttaaaataatctaccatagtaaaaacatgtataaaagtgctacttctgcaccacttttgagaatagtgttatttcagtgaatcgatgtggtgaccatattgtaatgcatgtagtgaactgtttaaggcaaatcatctacactagatgaccaggaaatagagaggaaatgtaatttaatttccattttctttttagagcagtatacaaagatgctgatttgtatttattagactctccttttggatacctagatgttttaacagaaaaagaaatatttgaaaggtatgttctttgaataccttacttataatgctcatgctaaaataaaagaaagacagactgtcccatcatagattgcattttacctcttgagaaatatgttcaccattgttggtatggcagaatgtagcatggtattaactcaaatctgatctgccctactgggccaggattcaagattacttccattaaaaccttttctcaccgcctcatgctaaaccagtttctctcattgctatactgttatagcaattgctatctatgtagtttttgcagtatcattgccttgtgatatatattactttaattattattatacttaacatttttatttactttttgtgttagtattttattctgtcttctccttagatagtaaccttcttaagaaaatatatatgctaagtgttttactggtttaatatgcttagactactcatctacctcaatacttccttggagatctcctcctcagtcacacagagctcaggacttatatttccttggaactcctgttagggtccaatgtacatgaaattccctagacagacagacagtcagttatatggcttgatttcaaagtttcaaaatgatttaatggactatcaagtagtttattaggagaacagttattatactcttctaaaaataaagactttaagcaataaagatgtatatgtatataaaatggctgggttattcctagaagtacctttcttagaatttagttaaatttaatatccaagatactatcttttcaaccctgagattgtgaaaagtaacttctatcaatataaactttactacatttgtattgtgttagtgtgttacagtataatctagaacaatgtgtctttctatatgatatatgacattttaatgcctaaaaaaactgatatgtcttagatgattctagtcaggatttacttctagaatagattaaaattctatttgaggagagtcaaattaattatcgaattctcagttgttattattgctgttttatttttagtgaaacagattagtcttaatgtaaacacttgagaaataaattgatggtcaacctaaaatgtaaaaaagaaattaatagaaaatttaaagagcaacaaagctctgacatttaaaagaaatgaagtacaaatctctagggaccttaaagatcatctaataatttcctcattttctagataaataaactgagagaccccgaggataaatgatttgctcaaagtcaaatatctacttaatataggaaatttaatttcattctcagtctgttaacatgcaacttttcaatatagcatgttatttcatgctatcagaattcacaaggtaccaatttaattactacagagtacttatagaatcatttaaaatataataaaattgtatgatagagattatatgcaataaaacattaacaaaatgctaaaatacgagacatattgcaataaagtatttataaaattgatatttatatgtttttatatcttaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggtaggtatacatcgcttgggggtatttcaccccacagaatgcaattgagtagaatgcaatatgtagcatgtaacaaaatttactaaaatcataggattaggataaggtgtatcttaaaactcagaaagtatgaagttcattaattatacaagcaacgttaaaatgtaaaataacaaatgatttctttttgcaatggacatatctcttcccataaaatgggaaaggatttagtttttggtcctctactaagccagtgataactgtgactataagttagaaagcatttgctttattaccatcttgaaccctctgtgggaagaggtgcagtataaataactgtataaataaatagtagctttcattatttatagctcgcaaaataatctgtatggaagtagcatatataaggtatataaacatttagcctcttgataggactaactcacattctggtttgtatatcagtcttgcctgaatttagctagtgtgggcttttttttatcttgtgagtttgctttatacattgggtttctgaaaagatttcttttagagaatgtatataagcttaacatgtactagtgccaatcttcagacagaaattttgttctattaggttttaagaataaaagcattttatttttaaaacaggaaataatataaaaaggagagtttttgttgttttagtagaaaacttaatgccttggatgaaatgagccatgggcagggttgtaatgaattgatatgtttaatagtatagatcatttgtgaataatatgacctttgacaagacacaagccattaacatctgtaggcagaagtttccttctttgtaaaatgagggaataaaatagatccctaaagtgtgtaattttagtatttctaaactttatgaaggtttcctaaatgataattcatctatatagtgtttttttgtgtgtttgtttgtttgtttgtttgagatggagtctcgctctgtcacctaggctggagtgcaatggtgcaacctcggctcactgcaacctctgcctcctgggttcaagctaatctcctgcctcagcctcctgagtagctgagattacaggcatgcaccaccatgccgagctaatttttgtatttttagtagagaaggggtttcatcatgttgaccaggctggtcttgaactcctgaccttgtgatccacccacctcagcctcccaaagtgctggtattacaggcgtgtgccaccacgtccagcctgagccactgcgcccagcccatctatatagtttaatatcaatctaaatgaatttctcagtcctgagcctaaaaatttagttgtaaagaatgatatccttgactaataatagtttctattaatggattgcatctagtgctaggtggcatatatttagtccccacaactaccctggaaggtatttaaaatttttcacatttgcagataaggaaactaaagttcagagttcagcaacatgcttgaattcaagcagctcctaggatgttaatggtggaggttgggttcaaatccagatctgtctgactcaaaaaatgcatactcctaaccagtgcactatatcccaattccataggagcccttctttgtgattcatagcactttcccatgagttttgttgattttgtgagaaacaaaactctttttcctttggactgtctggaatctctctttttcaaatttttgaaatgtatttctatgccaaaagacaaagatttctagaggaatatgcctaggatgagaattatgtaatttaaatcacagctggaaagagagaaagtcctaagttactaagaaatgttcaaacacaaatgagctttcagtctattggaagacctttatagctagaagtatactgaactgtacttgtccatggacccctgaagaaacaggttaaatcaaagagagttctgggaaacttcatttagatggtatcattcatttgataaaaggtatgccactgttaagcctttaatggtaaaattgtccaataataatacagttatataatcagtgatacatttttagaattttgaaaaattacgatgtttctcatttttaataaagctgtgttgctccagtagacattattctggctatagaatgacatcatacatggcatttataatgatttatatttgttaaaatacacttagattcaagtaatactattcttttattttcatatattaaaaataaaaccacaatggtggcatgaaactgtactgtcttattgtaatagccataattcttttattcaggagtgcttttttgatgatatggagagcataccagcagtgactacatggaacacataccttcgatatattactgtccacaagagcttaatttttgtgctaatttggtgcttagtaatttttctggcagaggtaagaatgttctattgtaaagtattactggatttaaagttaaattaagatagtttggggatgtatacatatatatgcacacacataaatatgtatatatacacatgtatacatgtataagtatgcatatatacacacatatatcactatatgtatatatgtatatattacatatatttgtgattttacagtatataatggtatagattcatatagttcttagcttctgaaaaatcaacaagtagaaccactactgatattttattatttcatattacatataaaatatatttaaatacaaatataagaagagtttttaatagatttttaataataaaggttaagagattcgaaagctcaaagtagaaggcttttatttggattgaaattaaacaattagaatcactgttgatattttattatttcatattacatataaaatatatttaaatataaagataagagtttttaatagattttataataaatgttaagagattaaaaaactgaaaatagaaggcttttatttggattgaaattaaaggccaggcatggtggttcatgcctgtaatcccagaattttaggagactgagtggggaggattgcttgagcccaggggtcaagaccagcctgggcaacacagtgagacaccgtatctacaaaataattaaaaaattagctgggcatggtggtgtgtgcctgtatgctaccattaactaaggaggctgaggtgggagaatcgcttgagcctgggaggtcaaggctgccctgaactgtgattgtgccattgcattccagcctgggtgccagagagagaccctatctctaaataaataaataagtaaataaataaacagcaacaacaaaaacactcaaagcaaatctgtactaaattttgaattcattctgagaggtgacagcatgctggcagtcctggcagccctcgctcactctcagggcctccttgaccttgacgcccactctggctgtgcgtgaggagcccttcagccctcccctgcactgtgggagcccctttctgggctggccaaggccagagccggctccctcagcttgcggggaggtgtggagggagaggcgctgggggaactggggctgcgggtgcccttgtgggccagcgcgagttctgggtgggtgtgggctgggcaggccccgcactcggagcagccggccggccccgcgagccccaggcagtgaggggcttagcacctgggccagcagctgctgtactcgatttctcactgggccttagctgcctccctgcggggcagggctcgggacctgcagcctgccatgcctgagcctccccccaacctgccgctgcagtgggctcctgcgtggcccaagcctcctgacgagcaccgccccctgctccacggcacccagtcccatagaccgcccaagggctgaggagtgtgggtgcagggcgcagggctggcaggcagctccacctgcagccccagtgcgggatccactgggtgaagccagctgggcttctgagtctggtggggacttggaggatctttatgtctagctaagggattgtaaatacaccaatcagcactctgtatctagctcaaggtttgtaaacacaccaatcagcaccctgtgtctagctcagggtttgtgaatgcaccaatcagcactctgtatctagttaatctggtggagacttggagaacctttatgtctagctaagggattgtaaatataccaatgtgcactctgtatctagctcaaggtttgtaaatacaccaatcagcactctctgtctagctcagggtttgtaaatacaccaatggacactttgtatctagctaatctagtgaggaggtggagaacttttgtgtctagctcagggattgtaaacgcaccaatcagcaccctgtcaaaacggaccaatcagctctctgtaaaaccaatctgctgtctgtaaaatggaccaatcagcaggatgtgggtggggccagataagagaataaaagcaggctgcctgagccagaagtggcaacctgctggggtctgtagaagctttgttcttttgttctttgcaataaattttgctactgctcactttttgggtccgcattgcgtttatgagctgtgacactcactgggaaggtctgcagcttcactcctgaagccagcgagatcacgaacccaccagaagaaagaaactcctaacacatccgaacatcagaaggaacaaactcaggacacgcggcctttaagaactataacactcactgcaagggtccttggcttcattctcgaagtcagtgagaccaagaacccaccaattccggacacaatttgactgcagaaaatggatgtccaaccctgtggtttccctgggccacattggaagaagaaaggagttgtcttgggccacacataaaatacacttactatagcagatgagctaaagaaaagaaaaaagtccatgcgtaatctttgtgatatgtgccaccaccaataagcaaaattgttctcttattcaaaaggttggacacagctgctctagatattttattattaaatatgcaggcaattactgtttaaatgaagatttcctcacagaatgagattaaaagtatatattagtggcttagcattcattttagacaaccattttagagattcaaatcacacacttgcttacagaaattttgttgtcttcaatgtccccattgtggtttctttaccaagcctctactgttcttcacatcaccaagttaaaaaaaaaaaaggggcgggggggcagaatgaaaattgcatggtaggccacaagttcagatcctcatcgacacaagaggtgcctgaagcagtggatgaggcttttctatggatcatgagcagccacataaatgcttaaaagggcctggcagggagcatcagtgggtgatgtggctgggaggctgaatggagagcatttgttcttcagttatctatagaaggcagctgtcactcagcaccagctaagggcttcccatgagggaactggggatcaggtttcccagatctttttatgtaacaggataagacagagatccagctttttttgggtaattatttcctattttaaaatacgggtagttgattaaataaaaacaaacgaatgaacaccatatgggcacaacaaaacacatctgtggcttggattcagcttgtgaatgattactgcagatatttattctagaggacacccctgggtatgtcctaatataaaacctaaatctaaactcaagtcccatgctaccttcagagaataaatgacccagaaaaagaaccacctctcctaaggaagtataaatttgtaaataactgagacccaaacttacaactatacatttttcttattgttgggctgttgctaacctcaattaagaaggcttgatgatatttgtaaagtgtcatcactccaccatggtccagtaacatctgatcactccaccatggtccagtaacatctgaatggtcaagaaatatctaaacgtatgtaccaaaaatttgtgtatactactgtaccaataaaccatttgtttccatttgatctctgagtgtggtaatacatgttatttgccctgctgttgtaaataaacaaaccaaatggaggcttgatgcaagatgcagtgtagcatagtgccaactctggactccgactactcagggtgtaaattctaactctgttctattaacaccatgaaactgagcaagttagttaaaactcgctgggcccattttctcatttatacaatggagattttaatagtacagctacataggccattttgtggtttaaaatacatcatgattatgaaacacttaatgtagggcttgctacataatgagcaaggtttgttgctgttatcattaatatccttaattctcattattataaaacttgagatagtatgaggtgaacaagttcataacagcaatataatgaaaattttaataattccttttatactttaacaaaaatacgagattgggtaatttattatttttacatgagtaataaatattgcattaaaatatatttaaaatttaccacattaatgtctgccagtcatgccaaatgaccaacatgaatgtgaataaaactcagtctgtgcccatttaatcttaaccaaccctttataattgttaatgatttgaacctctgccttgaaagatcacattacttgattgtcttcaacttatctgaatgtggtagtgatttctgtaaatttataggacctttgtctcatgcagctccatggagttgaacttatgcacctttaaaatggtatatacttaattaattaagtgttgatctgcttcacatgtgtataatattattagctcactaaaccaagaaaacagtggtcctttagggaaagaaactaaattacaacagagaatataaataccatataaatatctattatttattgaactgtcacaattattgcaaaaaattaccttttagtggacaaaacaattgatattgcccttttctggaaaagaaataatgtaatatatgatgaatagttttggccagtatcctctagaccttgccagttaactggctctcaaaattttgaataataaaaacttggtgatagtagaaaaatagtaattttttaaaagtatgtgcacaattatacaactaaacaattcattcaccagtgttcacaattctattgccttctttgaatcaaaatttacatagtttttcttttagactaagctcctttatgataccagtgtgcccatttctcattaccattgaaatgtctcatgagcatgtcacattctggtacaactgctaatccaggatgacagtttagttcttttaaatccaattgagagccttctactcatgaccagagaacctaaagaaaggttaagatacatttattccttggtgtaagtgatttgtctatttttagttttcctaagggtcatatttcaatttagatttttttttataggttaggtaaaataggcttcccttttgcaatatgaaatatgtagtcttttaaaaaatttcttcaaagctattaaactgaaaaaaaattaatttggtctattcagtttgttagcacttaccattttggaaagagagtgactctacttttgtatttggtaacattttccctactacagggcagtatcttttgtaagttcttagatattagcaccaaataaataggcaaaaaaaatctattatgttaattcttagaacccctgcttggcagtgcatcattgactagatggagaagaaatgaaaataatacattaggaagcagtttcctggttcttttgaaaacaactagagagtcttgttgttgactggaatatctgaagatcctgtttaatgctttcattctatgattgttaagaatatgtcatagaactgctgtatcctgtttctttatgtcttcccttctgtttgttgattagaaatccctgagtggctttacattattagtacagtagatatgtagtatattcccataataccactgctgctattgactaatagtaataattttagggcagctttatgacagttggtttatgttttagggtgtcatttgacttgtgaagcattgaaatctgggtattaagcacactgttttctatgtggtatggaatgattcttaaagccctgagaaaatggaaaataaaaatatttttcctttttaccataatcacctatgactgtcactctatcataaactgcataaactttataacctcaaaacattttggaaatgaaatgacagaacttgcttactcaattgcttctatatacaccaaatatttttttaaagtattatgttaagtccttgaaaatattttgttctactcaatagaagcagtttaggttggtagttctatgtggaaacagtgaggaaataattttatattatgatgactagaccagtctttgaacatcactttggttattgttccattagtaaatattataattatttctgagatttactcaccttcaaagaatgttggcaatgccagcattattaacactcctctagttagaacaaagaggaaatgtaataacaaaacataataatagccaaataaagagtgacttagaatgtacacccttatctaggatcctgagtaattcgattattcttaggaaatacacttttgtgctagaacaaagacttttgaaatagctaatttctgggtttcttttcattttgaattaacttgaatttcaaggaaacaagggtagtttttacagatacagtgcatagaagctctgtgtacaatgaagaaaagtaggaaagtgagaaaaatgccattagatttttcatcgttatactatctgatatgtgaatttaactaaaacttatatacctcattatagtacttcctaatgtaatttcttaatttaagtgttccccataaggtttttttttatataaacttaagtactgttaaatatttaaggcaaattcaggtataaaataagacttgttgatatcttattccaagcatatttgtttctctcctatttatttttattctgtgttcatttccaaaattgttttactcacaactgtttgttttttctgtttcattctgtggtaaaggtatcatttggctaattgtataatttcagtgtcatttctaatattccaattgtgatagtatcaacacaagattaaatttctctacatggtttatgagaatggaatgccaaattgaaatagaacagagcacagatgatctaaatataaaaagaactacaaaaatcacagttgtttaaaaaggttttttgtttgtttatatatggtgcagaacatttgttccttagccaaatgtttccaccttgagaaagctatagagattctatgtagtcctagtaccaataatatgttttaacctgaatgtaccttatctttattcataaactgtgactttttacactgctgaaacttttttttttaagacaatctcactctgtcgtccagtctggagtgcagcagtggtgtgatcttggctcactgcaacctctaccttctgtgttcaagcaattctggtgcctcggccacctgagtagttgggatcacaggtgtacaccaccaggcctggctaatagtttttgatatttctagtagagatgagttttgccacattggccaggctggcctgaaactcctggcctcaagtgatctgcctgccttggcctcccaaagtgttggtattacaagtgtgagccactgtgcctggcctgaaactcataattcatttccattaatattaatctcaccttttccaataattaattgatttcacaagtattagtcccctataatcattgaatggctaataaaattatttatagcaaacagattaattatctgccagcagtctgagattagtttctttaaaaaatgtttattatttaaaacattcagctgtgatcttggctttcttgtgaggttcaatagtttctattgagtaaaggagagaaatggcagagaatttacttcagtgaaatttgaattccattaacttaatgtggtctcatcacaaataatagtacttagaacacctagtacagctgctggacccaggaacacaaagcaaaggaagatgaaattgtgtgtaccttgatattggtacacacatcaaatggtgtgatgtgaatttagatgtgggcatgggaggaataggtgaagatgttagaaaaaaaatcaactgtgtcttgttccattccaggtggctgcttctttggttgtgctgtggctccttggaaagtgagtattccatgtcctattgtgtagattgtgttttatttctgttgattaaatattgtaatccactatgtttgtatgtattgtaatccactttgtttcatttctcccaagcattatggtagtggaaagataaggttttttgtttaaatgatgaccattagttgggtgaggtgacacattcctgtagtcctagctcctccacaggctgacgcaggaggatcacttgagcccaggagttcagggctgtagtgttgtatcattgtgagtagccaccgcactccagcctggacaatatagtgagatcctatatctaaaataaaataaaataaaatgaataaattgtgagcatgtgcagctcctgcagtttctaaagaatatagttctgttcagtttctgtgaaacacaataaaaatatttgaaataacattacatatttagggttttcttcaaattttttaatttaataaagaacaactcaatctctatcaatagtgagaaaacatatctattttcttgcaataatagtatgattttgaggttaagggtgcatgctcttctaatgcaaaatattgtatttatttagactcaagtttagttccatttacatgtattggaaattcagtaagtaactttggctgccaaataacgatttcctatttgctttacagcactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtactttactaggtctaagaaatgaaactgctgatccaccatcaatagggcctgtggttttgttggttttctaatggcagtgctggcttttgcacagaggcatgtgccctttgttgaacctccatttgactggcatgcacatgtctcagatattataggttatcatatattgttgctcctaatatttctgtgttagataattagagtagcttggtttgtaagaatgtgatgttggtgggactgtagcagaacaagaaggcccttatgggtcagtcatacctctcttttcaaatatttggtctagctctcttctgggcatcttgttgccaatatatagtattgctcaaaagggcaggagatttgaagtgatcaaggaaaatatattttttctattgattaagtcttttgatggggtagaataatctaatttcatgtaactgctcaaagttatatggtagggggatcccaaatgtattttaaaactatttttatatcatcatatttgaagtaatagaaagtcagagtagcagaataaaggtactaaaaattttaaaaactaataaggtactttgaaagaaatcaattatgttgattcctcattaaacaaatttgcacttaaagactgaggttaataaggatttccccaagttttttcatagcaacctgtgagcactttctctgttgaggcatttatggtatgaaaagatgagtaaggcacagttcttgccctggagaaggtcacaggtgagaggaggagttgacacagaaacatttgatataaagcaaggaataaattccaagactaaaattttcagaaatctaaaaaactcaagataagaaaaacccattatattttctgggtaacaaaatttcagtgttattaacatgtaggaagatcttgatatttattctgaagcccatgtgtgttgctgaaatattgccgcatttgcatatactcatcaccatcctctgttttggagctaagaattttagactcaagatgtctaattaagttgatccattgattttattttttatggaaatctgagacccacagaaggcaggggatttgcccacatttctagaagagtcagacatgagcgatgaggcacagtggaaagaacatgagcattgcctgagctctgagttggcgctataagagcagtgatcatgggcaagtgactcttctgagccttggcctcctcacctgttaagtgaagaaaagaatatttcagaagatctttgtgagaatgaaacaaggcaatttacttgcctgctacatagccaatgggaaatcaatataagttccccgtggttcccttctgtggggttttgttcccacagagggtgcactggccattccacttcttcttttccaagctcctcattccctttaacgctgttcatagttggttccaaaccatttgaaatataataagcaccaggatggttttttctttccaccaaagcaaatttcattttctaaacactgtttataaatatcaatggctattttttcaatttttgattatcatgaaaatatacaaatatgtttaattaaatatgctaaagaatgtattaataaatatgtattaaataattcctacatataaggcctttttgcttggggtatgggtgatacaaaataaatgtggcatgaacccactgacctctagcaatttataacctagaaaaagagttatgatatgtttataagttcctgtgatataagacatgcatatagtcattataacagaggtgcaaacaagatgtatcaagtatgtccagaggaggaagagattaatcccagctggaggaaacactgatgctttcttgcagcaggggcatttgagttgagaaagggaggaaacatagattttgacaatgagagctgaggggaaaggggtttcaggtggagggaaccgcatgtggaaagcagggaggtaggaaagtgtagagtgtgtttaaagaatagaccagtttggctgaaacaggatatttgagcagaggaagcttgtactaggtaggtgggttgaggccaaattatgcaaggcattaaatattaaactaggaattttggactttatcctgcagtttatggggggtaaatgataagattcaatatcactttatttgtacagtattatgttacattttatctaattgtttgtttaattcctgtctagacaatgaattcctcaagggcaaggagcatggcttattcacctcagtaatttcagtgcctagcattgtgcctggtacaaagtggacacttgtatataaccttttttaattgaagcaacaagttgtcaaccttacaaatgtgaatccgtgattcagatgacaggttgaaatgtagattgtctgcgaagagggcagaaagagagtatgacaaaggaggacaagacagtggggcaggcagggagagagagcagccagggtttcggtagaggtatgtcaaaaaggtatggaagtcagaggagaaggagacccctatgttatagaatacaaatggaagggaaatgatgacaacagtaagttgtcattaaatgcaaggttgcaaaagtaagattgtaaagcaggatgagtacccacctattcctgacataatttatagtaaaagctatttcagagaaattggtcgttacttgaatcttacaagaatctgaaacttttaaaaaggtttaaaagtaaaagacaataacttgaacacataattatttagaatgtttggaaagaaacaaaaatttctaagtctatctgattctatttgctaattcttatttgggttctgaatgcgtctactgtgatccaaacttagtattgaatatattgatatatctttaaaaaattagtgttttttgaggaatttgtcatcttgtatattataggtgggattcttaatagattctccaaagatatagcaattttggatgaccttctgcctcttaccatatttgacttcatccaggtatgtaaaaataagtaccgttaagtatgtctgtattattaaaaaaacaataacaaaagcaaatgtgattttgttttcattttttatttgattgagggttgaagtcctgtctattgcattaattttgtaattatccaaagccttcaaaatagacataagtttagtaaattcaataataagtcagaactgcttacctggcccaaacctgaggcaatcccacatttagatgtaatagctgtctacttgggagtgatttgagaggcacaaaggaccatctttcccaaaatcactggccacaaagtgtgacattttggcattggcatcactatttgatggaagccaacctccccccaaaaggcctgtattagaatgaagatggattccctgggtgggttacacttgaaactagcctcacccatgaacactttggcacagattagctagcccattcccccacagtaaggaccataaggaagggacagaagcaaagataagttttagaacaaaagagaggggaaagaaaaaatctagggttttatgagggctgtccctgagtgatagatgtgaataggcctccagggcaggctggctcagaggctgactctttgggttggggtgactgattggtggtgaggatggagaagaaaaggggagtggaggaggtgaaagtgaccttgggacattaggtctccataagtgacaggatttaaggagtgttgtaagctgtggttgttggaccaggtttaagcacagcttcctgagcttcctgactggtttaggtcaagctccagagagcaaatgccacagtctcagtgatctccttggagaaacagttggaataggatgttgcccatgttgggatgagtcattgtccgctcttgctctttccctacccctgcaaaataataatactgtatttgattgaacatataaaacaaaagaaggattatcacataagtatgtatatataaccaacattggcaggtgcagaaaaaccagactgtcagtttgcctcatctgaaatgattgacacaaacaaatatatttactgtcccaagtgaactttggcattttggatatccttcagttgttctgtttaaagatataacttagaagcagctgatggaatatttaaatccatgcgttgaattcatgcattcaaagaaacatgtcctgagtcactaaatgctgacatttgtttttcatgttaagagtgtaaataactggtcccaaatataatattattacatcagataaaaactggaatgtgaacctcttaacttgattgtgaaagtatttgccaatggtgcctcttgataattatttgaggctcacttcagaactcctctggaagggttaatttttaaatagtcattttataaattaacatttttgacatatgtgatggctctcaaattttttcttttatgccagtttgaatcatttctgctcaatttttttttttaattgggatggagtctcactctgttgcccaggctggagtgcagtgatgcaatcttggctgactgcaacctccacctcctcggttcaagcgattctctcgcatcagcctccagagtagctgggattacaggcgcgcaccaccatgcctggataatttttgtattattactagagatggggtttcaccacgttggccaggctggtcttgaactcctgaactcctgacctcaagtgatccacctgcctcagcctcttaaagagctggaattataggtgtgagccactgcaccaggccctgttcaacttttaatgctaagattcatttgttgttgtttcacaagtgattaggcagaggtcttttatattaatttacccattttatttgtaagagagtctcatattaaggaagcataatatatgacaatccaaatacagtacaaatttggttaattttgattttgttaaataattaatcacaggggtccttcaaattgtgagctcctctggttatacttatgttttacctctggttatacttaatttcaaacaaatgaaatttcattctattcatgatatttcagaagcagatctgttgcacaaaataaagcatacctataaattttctttttttaaaaaaaagtctctgttcactctattttctattatttttctctttttaaaatttgaattttattgtggcaagtccacttaacatgagatttaccctcttaacagatttttatgtgtaaaatacaatattgttcaccatgggtaaatgttgcacagcagatctctggaacttattcattttgcactactgaaattttatacctgttgattagtatctccccatttccctctctcccctgtcctgttacccatggttctgttctttgcttctttgagtttgagtattttgatacctcatgtaatcttcattctattttctaactttgacaatgttctgacaaatttgctttccggattggagcactgtatagtgaaaattgaaaatcttggttattttctacagattcccactattttaccttgagcagacacttatcttgaagggtctcagatttgtcacttgtagaatggggaatataaacctgataatggtccctttcagttctaaagttatatcagttgaaaatacatgtgtcacttatggtaacgggtagagaactggctcactgaacagcatatggatattataaagtggttttttttaatcctttctgcagacagttactttatactttattcaaatggattattgtgaagtacatgttagcggactttgtaccttttaaaaatgtatgtatttggtgtaatgtagaaatatagaaatttattaagtatgatttatttcaatgttaagcatgagaaaatatgctccgaaaggttagatagcttgcctaaatgacaagcttgtatttcaagcagaactttctgaatcaaaagactccaagacgaatgcccagctttcaaaaactgtctaaccaaaataaatcctaagattcaccttcatactaaaattatttaaaaatagtttattttaaattaatattcacttaaaatgtatttatcatgcaatactttaaagtgtctgggaaatgaaaatatccaaagatcaaagaacaccatgttttcaaacttcaaaaatgttatcagtgacctaaacaatttttaaaattttcatagagcctatgaaaaatgtacttgcaaatggctactttctgactaggaatagaatggggagagtatttagtccaacaatgatagactggattaagaaaatgtggcacatatacaccatggaacactatgcagccataaaaaatgatgagttcatgtcctttgtagggacatggatgaaattggaaaacatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaataaaaaaaagtttgaggtgtttaaagtatgcaaaaaaaaaaaaagaaataaatcactgacacactttgtccactttgcaatgtgaaaatgtttactcaccaacatgttttctttgatcttacagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggtatgacagtgaatgtgcgatactcatcttgtaaaaaagctataagagctatttgagattctttattgttaatctacttaaaaaaaattctgcttttaaacttttacatcatataacaataatttttttctacatgcatgtgtatataaaaggaaactatattacaaagtacacatggattttttttcttaattaatgaccatgtgacttcattttggttttaaaataggtatatagaatcttaccacagttggtgtacaggacattcatttataataaacttatatcagtcaaattaaacaaggatagtgctgctattactaaaggtttctctgggttcccaaatgatacttgaccaaatttgtccctttggcttgttgtcttcagacaccctttcttcatgtgttggagctgccatttcgtgtgcccccaaactctacttgagctgttagggaatcacattttgcagtgacagccttagtgtgggtgcattttcaggcaatactttttcagtatatttctgctttgtagattattagctaaatcaagtcacataaacttccttaatttagatacttgaaaaaattgtcttaaaagaaaatttttttagtaagaattaatttagaattagccagaaaactcccagtggtagccaagaaagaggaataaatattggtggtaattttttaagttcccatctctggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgtttatgttatttgcaatgttttctatggaaatatttcacaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggtactatgaactcattaactttagctaagcatttaagtaaaaaattttcaatgaataaaatgctgcattctataggttatcaatttttgatatctttagagtttagtaattaacaaatttgttggtttattattgaacaagtgatttctttgaatttccattgttttattgttaaacaaataatttccttgaaatcggatatatatatatatatgtatatatatatatatatatatatatatatacatatatatatatagtattatccctgttttcacagttttaaaaaccgatgcacacagattgtcagatagcaattctgtgattgaaggggaaatatgtcacctcttcatactcatattggtgaagggtcctagcttcaaaattaatagattcctaaagaggggaaatgaaacatccgcatttacacacacacacacacacacacacacagagttcctcttgtcggtaagttttgttttttttaaatctctactagataaaatttgttatctaattgtgagttttacacaaagaaaaactgtcacagaaaagaaagacagtgtcacatttttcaaaagaaaaagaagaaaagaaagtgccatgtttttcaaatacaaatgttctggattgattttaggatctttagtgaaaaacaaagtatttcataataagtaaaataaaaatctatgtaggtaaatttgtttctctaatttaagaatttgaatttctgagtatttatgataagtgttgaaataacttcttatatgtgacagtgaatactggcagagcaaatgccaaatcaatgccaaatctgtaggatcatttgattgtaggaacagaattctactcaaaccgaaagcaggcatttgctggagttacagaaaggcctcatggaacaccgagaaggtggtgccattcgactcttaaagaagctgcaacaggcacaagagagtcagctgcagctcttcttcttgagtctatatctgtcctgggtccattcctttttgtggttgcttcattcctttctctctctgaagactggtttttctggtctaccagggctatgccacattgactttatgtagtgtctccattctggcctcctgaatttacaggagagttcctctgtacaaactcaaagtcctggagagaacagaaaacagcttccttttggctcaggggtccaactgcagtctactctgctgctatgaggatagtgggttcaccacctttgttgttctctcagctagggcagtgggaaatgactctatgaaaggaatatacatgggcaggcaaatgtactaatcctcatcagtactgtaattttaagcaactttaaaaaattcttttaagttatttgaaaataagatcaaagaaggctgaattacataaatgaagatttgttaacaattaattcaaaccaatataacacatgctataacatggttgagtgtgattgagtcttgatttattaggggcaataatcaaaacatttaacaatcattatagtacagaacttaccaatcaaatcagatgctcagccggagtggatgttggccacccagctattattatccctggctcaattggtcttcagctgtgttaacttgcaaacattaattaactatctaagcccctcattttcctcaagtgtaaatagacacaataatattacctattccataggtgtggggtgaatagtaaatgtaataatttgtccaaaacacttagtatagtgcctggtccatggtaaatactaaataaatgttatctgacttattattaaaattttatcttctcagcttaaccttcagaacagtaatatattggggtctagataaatcttgcctatatgaaaataatttaatactacatgcagatatatgctgtgtatattatgccttctgttagaggaattgcagaaacaaaaatttcaattaataataagatgaattatttctcccaattgtagaatcttttgacaattttatcatgcattacagatgtaagaactcttgattgggacttgatagtctaactttataataatttaagaacattcctcttagagaatttctatggccataatactgaacacatgaattttaattagctgtcctctttagccctaaaaaaaaaattactgtaatttaacacttaagtgttgttcttcccaggtacagtaatctttttttttttttttttttttttttgcatagagggtaatcttttctctttccaaatggcagaactgttagttttctgactgtccggtgaaattctaagtccacttacttcccaatagcatgcaattagcaaaggtcctccttgcaaaggcacagaacacacctaaacatcttgcagatgctgtttggacactcttcccctgcttttggtctctttgtaaagcagctcatctggatacaggatctcttttccccattgcccattctaatatatgttaccgttattacttatagaataatagtagaagagacaaatatggtacctacccattaccaacaacacctccaataccagtaacattttttaaaaagggcaacactttcctaatattcaatcgctctttgatttaaaatcctggttgaatacttactatatgcagagcattattctattagtagatgctgtgatgaactgagatttaaaaattgttaaaattagcataaaattgaaatgtaaatttaatgtgatatgtgccctaggagaagtgtgaataaagtcgttcacagaagagagaaataacatgaggttcatttacgtcttttgtgcatctataggagaaggagaaggaagagttggtattatcctgactttagccatgaatatcatgagtacattgcagtgggctgtaaactccagcatagatgtggatagcttggtaagtcttatcatctttttaacttttatgaaaaaaattcagacaagtaacaaagtatgagtaatagcatgaggaagaactatataccgtatattgagcttaagaaataaaacattacagataaattgagggtcactgtgtatctgtcattaaatccttatctcttctttccttctcatagatagccactatgaagatctaatactgcagtgagcattctttcacctgtttccttattcaggattttctaggagaaatacctaggggttgtattgctgggtcataggattcacccatgcttaactgagtggtgccaaattgtcctcaagtctgttgtactgatatatatccccatcaagagagtacaagaattctcatagctatgtatcttcaacaacacttggtgtctggtagatgtgaagtgattactaaaaatatagggaagctgcatacataattattggcttttgctgttctcttacattaatttcttattcatgttgattactcatttgtcacctagttttttcttccttaattaaattgtaggaatttatgaattatggattgatcatcagctctatacatttcaaacataatccctcagtcagtggcttggcttatagagtcttttgatgaaaagaagcttttaagtttaataaagttcaatttattgtcttttcctttatgttttgtgcttttggtatcttgattaagaactccttccttatattgggttctcaaatttagcagcataacattttcatactattatttaaatttttttcacattatttagtgatagcacctttcttattcctaaagtgtttatcattgccttctgtctttctgcttgataaatattgccacacatttgtatactttattagtgtgtacaaagaccacattttagttgtgttatttctcttgttttggttttctagaatgcagagccattaatattatagtaatgcttatgtgctaataccatatcaggggcacaaatcccattgcagcgggactgagaaattaaaggaaatgatgcacatttactcatttttgtttaaaaaatcaaatgcatatttttcaatcagactatatggttggtctggatagcttcatcattgaatttttaaagtatttttgtactactgtatttaaaattattcattcaccactgcttttgtagatggtttagaaacccaagttaggaatgactgtgcaacactattattatactctttttaaaattatactttttgcttaagtttctttccttgttctctgagacagtgttcatgttcccaaaccacacacatttattcagctataaaatttgtatgatcaactcctgtcagaacaaacatcattataaaaaatatctccaggaaaaagaaaacccttttaatgctctcttctggttcatgtgtcttcttattttctttaagcattttcataacccattgagctgtaatttaattggaacatgatttatactaaagttggtttctttacctttaactttttttttttagtttgatcagctctctttagcttctgtagttcggtctttaattccattccagtatgcttttggagttgggtctcataaatgtatagaaatgtttctgttgggaaacagcaggagaatattaaataaatattgtgcttacatctatttaattctttgcccaactttctacaactttgactttacatttaagctcctcatgcacttacatgtttctttacctaaaaatatcttttcaccatgggtgtgtacaattcctttgtccttgctgtattaattttcttggtttacatagtagcctctacacattgatgtcaaaacctctgtttggtgcatttctactctgcgtgttcaatctccatgaaagtttctgtaaggtattttcattcctctagtttttcacatgtgcatcctggctttgtgacctgtgctttgatatcgtgcctttcatcttgtggcattgaaggatctttgcaaggacctattgtgttataatacagtctatgaaaaatatcaatatttgcatttgatcacatttaaaaaaatcacattcttttgtttgaatatcaaagctaatatgtgagtgatttccctgccaaatagcacaagtagcctttcctgggtgtttatgggcatttatctggttaatgattcccatcatagtgctgtcacccatgccattgctaaacttatacagtaacttttttgttttcacctcagcatatgttgagagtaggaaatagataggactatgccctcaaattttacgtttatatgatgttaatcctaaaggtccttgtgacttctgaagtaaaaactcagtgttgtcattttacttactgaattgttagctgagtttagagttgagtttacaatggagtaaacaaggtgtttagtttgatgtatgcttttagtctttcagaaaaaaatgtttatacttggaaagaatagtttatttacccatctggcctagtttagacaaaaacacagagtcaaatgtcaacagaattctgaagttataaaaatgacagtgtggctttttttttttttaaccttccacctggtgcttatgcccaagtgcctagctttctttagctctcaactaataaaggtaatgtttagataacatttaacgttaagttgcattgtgtttatgatcacatatctcaaatattggtacacgaaactgtacaacaaccttttttattagattttcctacgaaattccttattatattccctaagatagctttttcccaccttcttcttccttctcccttctcaggtgctccaataattccaacccctgcagccagtgactttattatatctttttttaaaaatctaaaaaaaaaaattgatgcaaccaggaagaattttctcatttctctccaccagttgtaccagcctactgcacctctcctcatgcaccaccttctgcctgtgttcttgctcctatattcaggagcaagtaatatgcaatacctccctctttgtgggatctttctcattagcataaaaatactttcccttgatctccagctactaccccatttctttgacctacatatagcaaaatatttgagaaaggaccactttccatcttttcctcaatctacttccatttttttctcaatccactttcatttcattgttctcctcaacccattctttccacaacctacttcattttatttccatcagccccataactcaggatcaacatcttgccagagccaatttccttgtctcccttaacagctccagcagtatttatgccatggacaaattattcttcttgtgatactttctctcttgcttccatgacactactcccacttcattttctttctacctctctggctcttccttggtcccttttcctggccccttctctctttcagatctctaaacatcagctatatctcagccctgttctactgacactctctagctgttattttctaaacccatgtttcagaaaccatatcttgatgaatcttggaaggccgaggcaggcgaattacttgaggtcgggagtttgagaccagcctggccaacgtggtgaaaccccatctctcctaaaaatacaaaaattacctggccgtggtggcatgcacccagctacttgagaggctgaggcacaagaatcgcttgaacctgggaggtggaggtttcagtgagccgagatcctgccactgcactccagcctgagcaatagaggagactccgtctcacacacacacacacacacacacacacaaagaaaataaaccatctcttgatgaatcataaatttgtgtctctagtttagacctctatcctgctctctaaatgatgtatccaactatcatcttgacaccatcatatgttcataaaacataattatagaatatctttcagtaggcttgacattttaaggcatgagtttccgttcagtatctccttaaaatatacccagggtctcaggagactattcaaacaggacaaagcttctattctacttactaatgtgtctggccctatttggcaggttggataaaaagtcatctgaacattgtcactttatgaataatatagtttaatagtttgtgaatcacccctgcaatttaaaaaatagtaaaattatcagaatctaatttaataattcctattggaacaccccatgttaggggatttccagttatttcaattgatatctcaatgttttaaaaattgtttatttctattactaattcactctttattttaacataaattgtggctatctatctctattcatttcaattatatttctcataccattctatagatggggtgaaaagaaaagtgttaattttttaaaactccatacctcaaatactatatgaatttatagttgttattgctaaagcaattatcttacatcttttcctccaaaacaaagttatgtgctggtttattttctttgtactcataagatgccttccatttttagtaacataagtcttgtctttctcctattcttagctacttaagcattatgtagcttaaataagcactaaagattcctatctgtatgaaaaaataaagattaaataaataagatctagaaagggtgacaaggtgatgcttcaaaatgaaccataccaagccatctagcgattgataaattactcacactcataatcacattgttggaaagaagccattgacaattcagtttgtttcacaactgtctatcacatagtgagcacaactaaaagactactttttgtcttttactgcttgttttgttgatcaagtgactgattgtacaatgaccaacaagaagtctgatgtgtagagaaaaggggaacctggcttttctgccttactcctgatgcctaattctgagcatgtgaatattattctgtttctttaattctccaagtgaagcagcagataaaccatccttgtttccattagctgtctaccctgttcaactgtgtgtttctaataacataagaataagaaagccaccagggtgagcagggaaggcaatgagtctgcaaggcttgtggatagatttctgttagtgaggctctagaaagttcttccaagattgatgcaatctgagaagagttttctgtcaatacaaactccctgggtttctcctttgtccttttactgcctgtgtttgttttgggttccagtaaagatcaagtgactgattgtaccatgaccaacaagaagcctgatgtgtggagaaaaggggaacctggcttttctgcattactcctaatgcctaattttcttgtactgaaagtagtttttgctgtaagaatctgaggggaggagtcatttcttcaatttttttttttggtctccttttaatggtttcttgatcatgtctatccttatttttctgttttcacaaatttttgtggtatattttcctctcatgacctctgtctcaagacttctttccatccatctcttctcatttcatcctgtagagtgtctgtggtaagagccctgcattctactctggccttgccatgtgtggccttgggcaagtcctagcctccttgagggtcttatttttctcatttgtaaaatgaaacagtttgatgagaagttttctaaggttccttcaagctttgacaatctctctcttctggatctttttcccatgaaaaatttcaactcttgattagcatgtaggcagggattattccacatccttataggaatcacatttctgctactgtccctgaatgctagagtccattgattaagttattcactgctgcaattgtcagagctgatcaaagaactctgaaccagtgtgttactagaactaacaaagaaaatgccattatgatgttctagagtcttgaattagtagaagaggtttaataagaaccctaagggattgctagaatgttaaaaacaaacaaacaaaaaaaaaggttgaaaagtttagaaaattcactggtctttgtgcccatcattttacttccagggtttagataatctcatttttgcaatgaaggaatggattagatcacaagttctcatcctagtagcacatgcagaatctttataaaaacacagagtagccaggtgcggtggctcatgcctgtaatcccagcactttgagagcctggggcaggtggatcacttgagaataggagttgaagaccaagctggtcaacatggcaaaaccctgtatctactaaaaattcaaaaattagccaggcatgatggcacatgcctcccagctactggggaggctgaggcaggagaatcgattgaacccgggagatggaggttgcagggagctgagatagctccactgcactccagcctggtgacagggtgagactccatcacaaacaaaacaaaacaaaagaaagcaaaaacacagattactcagggtccactaagaccagtgaagtcagttctcttggtagggggcagggtgactgagcatgatgtttgtaattttaaaagtgctccaggtgattctagtgtgtatcaagcaagacttgtgaaccactgaactacatgctaagactcattttagctctgattttctgtgagtcatagcagagggctcagcaaactttttctataaatgctaagatagtaaatattttcagctttgtgggctgtatcgtctttatgacaactcaactcagtctttgtagagaaaagcagctgtacataatatgtaaactaatgggagtagctagatgtgtcctgtgggccatagttttgctgactcctggtctatgtcatagaatttccttttgaattgatggaccaccagcaaatgatttttgtcctgtatcaatcaatgatacatacataaatctctacaagacatgtaaaggatgaggcttaatgacagagtactttggggaagacataatattgcaaaattaagatgcttagagaaaaatcatattaaaatagtgaaaactgtgagaaggtattttgatttgttgttttggattcctctttttgcaaattcttttgaaatattttcagtggaagctacatagatccaattgtattcaccaagctagattgtaattaagctccagagtaagtaatagatttgatgagtgatgtccaaccttttacatggaagagtaagtttgagtcttcctttgcccattgacacacttagtaccatgtttaccaaagttcttagttattgaaatgggcaccagcatattttgaaacgttggtgttaacttgggatatgccttttgtcatgttgcaaatagattttgtttctgttttgtgaagatcaccatctctgtcacttctgatagaaaaagtgacactgacttctcaagtgatttgacacaggttaaaatatgtaaaccatttctgtagagagcaagctgtaataatatactaaagggctaggtttatagtataatataaataactcatttatgctgttaataatttatagcaacatggcatttgactgactttttatgtgctctagtcatgtaagtaatagatgtggaaacatagaccagagtttcaagaacatgttttgggcagagtctgttttcttgctattatctcttaagtttatgttcatggcctaaagattatgctaatggatctgccttggtcttgggtgtcaggtctgtgttagcgagtattgaaaagcatagtttttgcctactgggaaggatttatgatttaaaagccctaaatctccccttttatgtacttcatacttagaaaatttttcctgtaaactgtgtgacttttttacattgtgccagttttctagatgactctcgtcatatttatttcttgcaatccttctataactatcagttatgaagtctctttatagtgttgccagccaggtctcaggtgtgtgaaatgtattttctattatggattttggggtatgatggcacatagtttgggtgttaatgcctaatcttgatgtactggcttctgaacaaccaaaaggatgaaaggaaatagaacaaatatttttgtgagggagaggagtctggcttcttgacttactctagaaaaagcctgtaagcctcctcttccctccttgtcacacaaagtgacaaagaaaatcaagaattgttttcttcttggcttaaatgcatcccttataaagtaaggctgagatcaggctgtgaagctatctttttgtcaagactgtcataattccaaaacactttgttcttctaatgcttaggttagtaactttaaacatttttataaagatagtgaggtccagttttaaggattgaccccttctcaaggggctcagaagaggttttggagaataataaaattaaataatgaaaccaataatttaaaccagatcatgatccttaagaaaaaatcccatcaaatttgggctaaactctaatatacagaggtctgcacaacttatgtcaagtattcttccccacaaatgaagaatggggttcattgtgtcattggttgggtctcattttggcttcatcttctatttctcaaagtctaagaaaagtgctcctacggaagtgggtgttggctatcatgagactttgctgctggcaggccagcttgctgctctagacagagatatccctcgatcctccttggacaactcttttctgtgcacaggaagcagcaggctggggttaaggagtttgccaatccagtcattctgataattgctgaatatgaatttctatccagcacaatctaggtagctacaatggcacagtagtttttatgtatcaggtgaaaatgtttaataggcactctaaatgagagaaaaggttaagtgaggttaaaagctcaatgaaaacaaatagatgagactaaaaatagttcaataggttgtaacttccatctcatccaaacagcaatgaatattttgaggctgaggcgctgaggggtaaaattgcagcctggactacttgctaatgtagacctacagcactgtcattcttactgcacagacactgctttctgcataggaggtagaataatgaattcatttattattaacaaagatttattaagtgactgcatggtgctaaccactagatggggagggatgttttgaactgtccattgtttgactataacaaggaacgctttgaacgaggttactatcataggcagaatttgtttaacatgaagcctatgagacataagccacaggtcctctcacgtgcaggaactcctttgaaggccctatacttaattttatatgcatagtttggatttggattcttttttttttaagagttccccaaattacttaagcttcaggctccacaaaacctggatctacccctggtagcagctatgaatctttgactatgaaattaagtgtacaagaaatatgactttactttttctgtgattgagtttattttctatttgagcacgcattccactgagtgaaagaaataatatcattgaattcagagattttgctgggttctaagtggagtttacagaatgccatgatattaggaattaaggagtgtgttgccctacatcatcttttgtccgtgctcactgtctctgaggcactgatgttcctatgtgacctagaggggcatggtccaggtagatggagtctgtccttgttctcactgtgagctctcgcttgctgacccttcttcagtttcttccatgcccctgaggggtaaaaagattcaaatctgaagctatatcaagccatctgtgcatagacattccaagcaaccatgttcactctactgctcccatgtcatgcaaggcacaggaagcttcactatggcatgagtatttcctgggctttgccttggaattgaggcacgggcctcctttgttctaaaattccccaaatctacttgaggatagaaccaggatttggttgcaaggcagaacttttcttagaggacctggtatctaaaccctcttgttacccccatttatggaccccatttatggggtgaggagagtgactgcttctaatccatcataatttttgtctatggctactgtttttgcatagacactatgttttgagtccttaggctttggcttttggcgcttaatggccaatattcacatggctcaaaattttcaaatgatccatatctgacttgagtttcaaaagtcagtttttgaaacttaaatgatcagaattgatttgttctgctctggttctgatgtggcctctccttccagaggtactggaggtagaatatccaaggtggaaagcccacgactacaaggaattggttagtaattcataatgttagctgtccacatctattcagtaatggcatttcagtggctgcacaactgaccatggtgaaagtgtctgcacaagccactttttcttcctgtcagaaaatgttctcacccactgaattgaatgactgtctgctcatatgctgtgaatgagtgcccagtcttaagattaaatcacacgttcttggctatgcatatttgggcatgctgtggggagttataataggctgtcttagagtcacattaagcagctagacagacaatgagttggaaagttacattttctaaatttgattggtacattccatttgtcacatttgacattagaagttctggattcaccctctatggtgagcttcactaatggagaatgtaatttgcaatgctcaaacacaagtcctaaacagaaaacattgtatgttacattccagtgctaccaaaatagtggttttgaaagtccttattttctaatactactatgtgtaattttgagtcatttagatagcaacagttaaatgttttatagattgtttggaagtattaaaatgtgaaggatttttgttatatagtgtctttcctatcttgcttaataaaatataagtttagaattgtgtatagaattaacatgcaaaaatatcaagtctcaactttatacagttaatctacatttgtgtatacccttcaattatttcaagagagggatactattcttatgcaggataaatacaataagatattttaaatgaattttaactacatctctggcagtttcatctcaatagtagttgtaattttatctcccagaccttattatagactagcagctctctatgaaaattagtgacagtgtgagtgtattttaattcaaagttaatcaagaatgactgagtcaagagttagctacccctgaaagtaactcataattcagaatttaaaatattacatgtggaacaatcatgactatatgccttttactttctctatcattatttaggttgtgggctttgggtccttttcacatccgttaacagtgggcttgacttcaaaggattattttcttgaatcttgaataattgctgaagacaatttgaagatattttcaagatgaaggaaactgaagcacagaatcactagagtgaaaaaagaacttcacaaacagtgcaggcttgatcaatggcatgggaaaacaggcaatacagttagaattgctaagatggaattttaacgttcaattaaggatctatctctaaactcctctgctttatccaccaatcattccatattaaagatgaagaattgttcccatttcaccttttgataaggaaaaatagaaataacagaagcaaatacacttttgcccacatttttttccaaaaagaataatttttgaagtctaaacgtttggtgtaaataagatgatgtgttaatattgtaaaggaaagctagttaagtttttgactgaataaagccagcatcaataattactagtaagactaaaaataagagcagtaaaattgtgtctaatcagctactaatatctgggaaggattgagccacaggatcaaagatggtatcttttaaaaatagaagttgagtgaattcggtcttcaaattctttctttttattcatttatatttatttactcattagtatattcattcctttattcatgtattgttcaaatatatattgggtacttattatatgccaagttgtttttaaaatcacattccaaattcccgtaagtcataattattcagagatgtatgttttttttaaaaaaaattgaacacctttaaaaattatcaagtccttttatttctgtatgcattaaagataaactttactaaatgttacatgaatagatttataaagcagataaatatttaatttcaaatataacccttatatgcaattatattttccttagcactaaaaatgaatatttaagtaatttatattaaaagtgtaattatttaactgcagatgtatgccaatgacttaaattgtttaaagattatagcaaagttgtttaaaattgtctaatcatgaagagttcacttaaccacctggttgacacataaaattatagttagttactaaggtagttcgagagaaagagaagaatcttcagtagtggttttgaggtgtggtacattttattataatataccggttatacagcattgtgcagtgctgctcatagtagaaataaattttctctttgatgtcatctattcccttgtgtggcttacataactgagaattaggtgatcacaaaaataaacaggcctatacagagcccatttatataagtcctggttatttctcttcagttaaacttttaattatatccaattatttcctgttagttcattgaaaagcccgacaaataaccaagtgacaaatagcaagtgttgcattttacaagttattttttaggaagcatcaaactaattgtgaaattgtctgccattcttaaaaacaaaaatgttgttatttttatttcagatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctgaagcaatgtgttagcagaatctatttgtaacattattattgtacagtagaatcaatattaaacacacatgttttattatatggagtcattatttttaatatgaaatttaatttgcagagtcctgaacctatataatgggtttattttaaatgtgattgtacttgcagaatatctaattaattgctaggttaataactaaagaagccattaaataaatcaaaattgtaacatgttttagatttcccatcttgaaaatgtcttccaaaaatatcttattgctgactccatctattgtcttaaattttatctaagttccattctgccaaacaagtgatactttttttctagcttttttcagtttgtttgttttgtttttctttgaagttttaattcagacatagattattttttcccagttatttactatatttattaagcatgagtaattgacattattttgaaatccttcttatggatcccagcactgggctgaacacatagaaggaacttaatatatactgatttctggaattgattcttggagacagggatggtcattatccatatacttcaggctccataaacatatttcttaattgccttcaaatccctattctggactgctctataaatctagacaagagtattatatattttgattgatattttttagataaaataaaagggagctgaaaactgaattgcaaactgaattttaaaactttatctctctgtggttaattgcaaacacagatacaaaaatatagagagagatacagttagtaaagatgttaggtcaccgttactaacactgacatagaaacagttttgctcatgagtttcagaatatatgagtttgattttgcccatggattttagaatatttgataaacatttaatgcattgtacaaattctgtgaaaacatatatataggatgtgcgaaaagtccctgtgtatcatgtgaaatggcttaaaacagaacaccataggtattcatatcagtgaataccataggtagctgaaagtgttttttcctggggtcgccaagatgaatgccaaaagtgatatcattattataaacaatagccagaataggttggtataaacctggtagaaagccttgataaattgactttctctcctcctgacatcctgccacccctttgctttgctgatgctcatttgtccactaaattaaactcaagcaagccctagtaaagtaatagaatttgtggagtcctcattagtataggaagtttccctgatgtgagattagtaattagagatgtagcaaaatgagaaagaagtaatatgcttagatatttcattttctctgaacctgtatatacaaaataggccatgcgtgttcagtaactattcactgcaaggcactctctaggtactttgggggaattggaaattactcacataaggctatggattgtgccatttgtcaaaagacaaaatgacaacaaatttagtttaaagacctcagtcagctttattttctattctagatttggacagtccttcatttcacaaattggagtaagtgttccaataagttgagcaaaggagcttggctttatagacccaaaaaaagggccaaaggaagcagaaacaaagaacaataagagaattggtcatttcaaagttacttttcttgaaaggtggggacaaggagacagaataatagaaaagtcactgattggttaacattggattaagaattaaaacagaggaaactttaagattgaagtttgaaactgacttgtttgggaaatcaggctgtcttctttcttgatttcttagaaggccggataacaactgagttttgctttggtgaacatgggtgactccatttttacttttagtctggtctgttgaggcctcgtgagagagcttaatctaaaacaatgacttcctataatttttgtttgacacatccaaagagggactctaatatttattgagagcttatcatatcttaagtactgtttaaacacttttatttgctattacatttgatcttattataactctaaaggcagaaatgattgcttttattttccacaatggaggaaactgaggttcaattaagtgagtaaggaagcagggatcttaaacccagataccattgctcctctttaaaggtggaagaacagaaaacatggggcaggggaagagagaaagtttctgtcccaggacatgataatctaaaagggaaaacgtaagatccactgaaacctgaggcagatttattgtggcaataacaaagcttaagtttcacagaccttcatttgcctgagccaactttgaaggccatgtatctaattttgtttttataattctataatctttattcttgaaaagagccctccctccaaatttacaagctttgggcccccaaaatccttgaaatgcccttgaataagagatatccaggtaaatgctatgggaattcagaggaggaagcagttagtatcagttggcggagagttaggctattaagagaaggttttatataggaagtggcatttagaatgaagctttgagaactgagctgtgtatttgaacaagtaaaggtggtgttgcagaattttgctccttagttctattaaaaacccgggttcttgtcacatgatccggaaaatttaggcacacagatacattgaagcatgagtagagcaggattttattgggcaaaaaggaaaaaaagaaaactcagcaaatcgagatggagtcttgctcacagattgaatcccaggccaccacaaaggaactgaagagatcgggcttctcccctgcataaggtgcaaattccccatggctccacccacttccccttagtgtgcatgtggggctccagtccacggtgggcatgcccagacaagccttgggcaggttccctcatctgtgcaaaagcatctgatgtaaacacttgaggggtggttcggagattctctgggacccttttattttcttatctgcctaggcatttggctgtctcagtgggtgggaaagggtgctccaggcaaagggcataacatgaggcaaagggcatgcacagaaaacagtgactggttcagtcaggttgggggatgccaaaggaagtaatgggagacaagattggagcaagatagataagagattgtggattttttttcttttttatctatataaatacagagacagggtctcactatgttgcccaggctggtctcaaactcctggcctcaagtgatcctcccacctcatcctcccaaagtgctaggattacaggcatgaggcactgtgcccaacctccaattttggattttgagagctaaagcaatatagtcgaaaactcagataatccaggtagattttgctattaggtgctatttggttcctggtacagagctaaaacccttggaatttcctaagtgataagagctacaggagcatcttttgttatatgtttccccccctagttcctgaaatagctctagagaaatacaggtgaataacatcctttgttattcatatcaagcccctatcaaccataccccagtttctatttatgaagtggcttttgggaagtccctaaagacaggagtggggaaaggctggttgtcagggggatgggttgaaactttcatcttccccccttgacctccagggagggatgagtggctgaaaattgtgtaaaatcaacaatggccagtgatttaatcaaccatgcctatgtaatgaagccacccgataagccttaactggaactttttggagagcctccaggctggtgaagacattgaggtgctcagaaggtggtattccagagagagcacagaatctctgttccccttcccacattcattttgctatgcatctctcccatctggctgttcttgagaggtatccgtttataataaactggtaacctagtaagtaaactgttaccctgagttctgtgagccattctagcaaattatcaaacctaaagagttcatggatacgtgcaatttacagatgcacagtcagaagcacagatgacaatctgggcttgccattggcatttgaagtgtgttgggaggcagtcttacaggaatgagcccttatcctgtggggtctatgctaataacagacagttgtcagcattgcttggtgtcgaaaacccacattgttggtgtcagaagtattgtcagtaggatagggaaaacagtttgttttctttttttagtggtctttggtcatctttaagagcagggcttctcaaagtgtggtccttgaaccagcatcacctgtaccacgtaagaacttatgagaaatgttcattcttgggccccaacaaagaattaaaaattctgagggtgtgaacggggtctgagtttcagcacaacttcccgaccatgctgatgcattcttgcccaagcatgaaagccctcccttgtttaagaaggccattagggccgggtgtggtggctcatgcttgtaatcgagcactttgagaggacatagtgggaggatcacttgagccctggagttctagacaagcctgggcaacatggcaaaatgctgtctccacaaaaatcacaaaaattaggtgggcgtgtgttgtgtgcctataggcccagctacttaggagactgaggcaggaggatcgcttgagcccaggagattaaggctgcagcgagctgtgatggcaccactacagcctggatgacagagtgagacactgtctcaaaaaaaaaaaagaaaaagaaaaagaaaaaagaaaggaaaatgaaaaagaacgccattaggtataaaggagcaatggtaaaagaccagttgcaaaaggttagggaatgggtggttactgaaataagaagctatgtagaacactagtgttggtggcaggaagtagaaagcaagagcactgctctgtgggggatggtcatagcaaatgcaatatggaggcatttgcctctgcactgaggagaaaactatcttttccaagataggaggaaaggagataagtggaattaaagagaacctttgagcacagagttgggaaactgaaggtatttgtgttgtgctccctcaatcttttaattcaactataagctaaacccatgaaacttgagtagtttcagttatctgacttttttcttctcttttgatacagtgttggctattctgggtcttttgcctctctttatgtacttaagaatcagtttgccaatgtatgcaaaataactggctgggattttgattgtgattggcttgaatctatagatggagttgggaaggactgacatcttgacaatgttgaagcttcctattcatcattatgaaatatttctccatttgtttgattctttgatttcttttatcagaatttagttttcctcatatagtcttttaaaatattttgttatattttgttcaagtattttgtttttgaggaatgccaatgtaaatggtattgtgattttaatttcaaattccaatttttcattgctgttatataggaaaatgattttttttgcatgttagccttatatctttcaactttgctataatcaattattgatagtttcaaggattttttggtcaattattttgaatcttctacatagattatcatcatctgaacttagttttatttcttccttcccaatctgtatacctttatctccttttcttatttcattagctaggacttccagtatgatgttgaaagtagtggtgagaggggatatcttggtcttgttcttgatcttagtgggaaaacttcaagtttcttatcattaagtatgattttagctggagggtttttgtagaagttttttttttttaagttgaagaagtctccttctatttttagtttgctgatttttaaaaagaatcaggaatgggtgttaaattttgtgaaatgcttttctgcaactattgatttgagcactttatttttcttctttggcttgttgatgtgaagtacattaattgatttttgaatgctgaatcaaccttttgtacctgagattaatcccgtttggttgtggtatataattatttgtatacatgttgagttcgatttgctaatactttttgagaatttttgcattggtgttcatgaaaaaatattggtgtgtagttttttgtgacatctttatctgcttatggttttaaggtaatgctggcctcatagcatgagttagggagtatttcctctacttttacatttgagaagagattgcagagaattagtaaaattcctactttaaatattttgtggaattcaccagtgaacccatctggacctggtgctttctgttttggaaggtcattaattattttaaaatagatataggcctattcagattacctattttttctcatgcgagttttagcagattgtctttcaaggaattggtctatttcatttaggttatcaaatatgtcaacgtagagttattcatagtattcttttattatccttttaatgtgcaagggatctgtagtgatgtccccttttttgttttattgatattagcaatttgtgtcacatcttttattttgctttgttagccaggctagagatatctctatttttgatgtttttgatgaaccaactttttgttttattgattttctctgttgatttcgtgatttcaatttcatgatttttaaattatgcttacatttgatttaatttgatcttcttttgctagttatccaaggtggaagcttatattgttaagatccttttgcattcttatgcattcaatgatgtaaatttccctctaagcactgctttttctgcatctcacaaatattcatgagttgtattttcatgttcatttagtttgaaatatttttaaatttctcttgatatttctcttttgacccatgtgttacttagaagtgtgttgtttaatcaccatttttaaaaattttctagctatctttctgttattgatttctagtttaattccattgtggtctgagagcatatattgtataattttaatttttataaaatttgttaaggtgtgatttatggcccagaatgtggtctatcttggtgaatgttccatgtaagctttggaagactgtgtattctgctatatttgaatgaggtagtctatagacatcaattatgtccagttgattgatggtgctgttgaattcaactatgtccttactgattttccacctgctagatctgtccattctttgcagagggacactgaagtctccaactctagtagtgaatattctatttcttgttacagttttatcaacttctgcttcatgtcttttgatgctttgttgctagaaacatacacatgaagaattggtatgtcttttggagcatgacccatttatcctcatataatgcccctcattatttcctcgccctgatgtctgttctctctgaaagaaatatagcctctccaggtctcttttggttggtgttaaaatgacttaactttctttatcccccttacttttagtttatatgtggttttaaatttaaagtgggtttcttgtagacagcaaatagttcagagttgtttttcgatccactttgacaatctttgtcttttaattggtatatttggactattgatattttaagtgattattgatatagttagataaacatctactatatttattactgttttctgtctgttacactacttgttctttgtttatatttttattgtctactctttttctttccattgtggttttaatcgagcattttatatgtttccattttcttttcttagcatagtaattcttctttaaaaaaacattttttagtggttgcccctagagtttgcaatatacatttacaactaatctaagtccattttcaaataatactaaataatttcatgtgtagtgcaagtaccttttaataataaaacactcccagttccaccttccagtctcttgtattatagctataatttagttcacttacatatatgggtatacctaagtatatacattatcatatttatgattgaatatattgatgaaattattttgaaaaaactgttatcgttaaatcaattaagagtaagaaaaatagttctaattttattataaaatgaaataccttcatttattcattctctaatacactttctttctttatgtagatccaagtttctgacctgtataattttccttttctctcttcagcttctttgaacatttcttaccagccagacctactgacaacaattttccccaatttttgtttgtctgatagagactttatttcttcttgacttttgaagaataattccacagggcacagaactctagattggtgatttcttcccctcaaacccttaaatatttcattccactgccttcttgcttgcattgtttctgagaagttagatataattcttatctttgcctttctataggtaagatgttttttcctctggcttctatcaagattttttctttatgaacatgatatgcctttctttttgaacatgatatgcctttctttttgaacatgatatgcctttgtgtcggattttttttggcattattctgcttggttttctctgagtttcttggatatgtggtatggtatctgacactaatttggaaaaattctcagtcattattgcttcaaatatttcttctgttcttttttttcctttattctccttctggtattcccattacatgtatgttacagtttttgtagtcatcccgctgttttggatattctgtttttttcagtttttttttccttcgcatttcagtgttggaagtttctattgacatattctcaacctcagagattctttcttcagctgtgttcagtctaccaatgagtccatcaaaggcattttacatttttattacagaatttttgacctatagaatttcttttgattccatctttgaatctccatttctcttctgcttttcatctgttcttgcatgttgcctactttttccatgaaaacctttagctttttttttttttctttttgaggtggagtctcactgttgcccaggctggagtgcagtggtgtgatcttggctcactgcaacctctgcctcctgggttcaagtgattctcctcctcagcctcccaagtagctgggattacaggtgcctgccaccatgcctgagtaatttttgtatttttagtagagatggggttttatcatgttggccaggcgggtcttgaactcctaacctcaagtgatctgcccaccttagcctcccaaattgctgggattataggtgtgagccaccatgccctgcctttagcatgttaatcatagttgttttaaattcctgatctgttaattccaacatccctgtcatatctgactgtggttctgatgcttgctctgtgttttcaaatggtgtttttttttttttgccttttagtaagccttgtaattttttattgaaaggtggacatgatgtgctgggtaaaaggaactgtagtaaataggcctttagtaatgtactggtaggtgtagcagagggtgagggaagtattctgtagtcctatgattaggttttagtcttttagtgagcctgtgcgcctgcagcttggaagcacttgtgaagtgttttttcaccccttttggtgggacatagtgactagtgtgagcgggagttgagtatttcccttcccctaggtcagttaggctctgaaaaaaccctgataggttaggcatggtaaaatagtctcttttgagggcaggcattgttataagaatagaatgctctggggccaggtgcggtggctcacgcctgtaatccccgcactttgggaggctaaggcaggtggatcacctgaggtcaggagttcgagaccagcctggccaacatggtgaaaccccgtctctactaaaaatacaaaaatcagccaggtgtggtggcacacacctataatcccagctactcaggaggctgaggcaggagaactgcttgaacccagtaagtggaggttacagtgacccaagattgtgccactgcagtctagtctgggtgacagagcaagactccgtctcaaaaaaaaaagaatgctctggcatatttgaaaatggttacttttccctttttttctctgatcttcactgtgagaacctggtaagcatcctataggcaaaattcataaaagtatagaagtcggccagtgacttggacccacttggaattttcttgctctcacatcatgcacactgaatctccagcaatttttcacttacagtttaggttttcctaccctactactggttctctcagaggtttctgcttattggtttctgttttgtaagttgtgattctctgtacctaactgcctgtctcccattttggggggcagtggtttgccctgtgacctcacttctctgacagatctaagaaaagttgtttatttttcagtgtgctctgctttttacttgttacgatgaagccaaccactttcagaatttctacaaaccagatcagaatctggaagtcctgtttttttattttttttatccctttgtttagcatgttacctatcttaacacattttaaataagtgaatgcatagcttatatctacttctaggttatatgcttccttagaataggaattgattcttaaaatgtcgttctgctcacgcctgtaattccagcactttgggaggccaaggcaggcggatcacttggggtcaggagttcaagaccagcctggtcaacatggtaaaaccctgtgcctgcaaaaaatacaaaaattagctgggcatggtggtggccatctgtaatcccagctactagggaagctaaggcatgagaatcacttgaacctgggaggtggaggttgcagtgagctgagatcgcgccactgcactccagcctgggtgacaagagcaaaactccatctcataaataaataaataaataaataaataaataataaaaataaaaaaataaaataaaacaaaaattttattctgagcagtctctgaagaatataaattctactgccttgcctttagaacttataacagcatctcgcaaactatcacaagatgctccaaacatacttcttatgtgctgaattaagaagtcaactcaaatttagtatactagtaatatttttggatatcccaaaacactgccagctcagctttaggctgcccttcttgggggggaaaaaagcagttgaaatttaggacttaagtgggcatctcgtttaatttttaatggatttctatgttgttggttatggtgaagaggtgaaaagaataaatattctgtgcagaaaaattattcagtcttcatgtgaaaacactttgtccatagcaattactttatgaaaaagatgtggtattactttctttgctcttaactgagacctttaatttaaagaacctatactttacaagtttttattttcaatgcatgaaaaatgtagcagctatttcacaacctttacttttaaaatccatttttctttttaatctcaaatagttttttcttaaaaccttttgactttttatctaaattgtaatagccagagcaccttcccacaactagaatatctcatcctttttgtcttttctttttcctctcaaaatgcctactgggaacttaatttggagtcagattcttcatgataaatctggacttaatcaaaattcctcatatggtatattgtatatatcacagtactggatagtcctctgattaaatagatatttgatagtactttaaggtctatacttttggatgaacttaactgctttctccatttgtagtctcttgaaaatacagaaatttcagaaataatttataagaatatcaaggattcaaatcatatcagcacaaacacctaaatacttgtttgctttgttaaacacatatcccattttctatcttgataaacattggtgtaaagtagttgaatcattcagtgggtataagcagcatattctcaatactatgtttcattaataattaatagagatatatgaacacataaaagattcaattataatcaccttgtggatctaaatttcagttgacttgtcatcttgatttctggagaccacaaggtaatgaaaaataattacaagagtcttccatctgttgcagtattaaaatggcgagtaagacaccctgaaaggaaatgttctattcatggtacaatgcaattacagctagcaccaaattcaacactgtttaactttcaacatattattttgatttatcttgatccaacattctcagggaggaggtgcattgaagttattagaaaacactgacttagatttagggtatgtcttaaaagcttatttgcgggaagtactctagccttattcaacagatcactgagaagcctggaaaaacaaatcccggaaactaattattatgtgccagttatataaacaagaagactttgttgggtacaaaccagtgattccttgcctttgaaaaatgtgtcagatatcatgcattaccagcagttcaatgatataaggaaaccagagtaatagctaaaacctttaaagctaaaccaaagatttacaaattgcctcttcatccagtctttcccaacctaaaaactgagttctctaaaaattttagtatttttttctgaagaaaagggaacatggacatttatctaatcctcattagaaatctgactaatgataacaaggatttagacctcaagcacttcttaccaaaattcttgatatgaccttatagcaaattactttcacctgttgaactttcctttcttttattcccctgtacctcacctgcactgggcatattcaagttgcttatacaacactttactattgtgttagaaaaatcatgacacatgatgaatgtgtttgtgcaacatgagctgattcataaatgaaaatgtgcattgaaattccacaatattttaaaattaggagtttatctagcaattgaacaaaattgattaaatccattatttgttagatcagctaaattacataagttcattcatctgctcataaatccatccattcttccatctggctatcccttagtcaattcaaataaatatttatggggcactttgggtaagccaggtgctaagaattcaatgcaaaacaagatagactcccctgtccttgttgaacttatatttttggtacaaacaaaagcaataatcaagaaaaaataaaaaaagtactgattgtgattaataatatgaagaaattcaacagagtattgtacttaacatttgattgatctgattttctcagttgtctgagaacaaacatttgtgaaaatctcattgtagagttcttacgatggatagggggtcaactgtgtcattattgcttatcagcttatcccaaagacctagtttattaccagattgcaaatagtgttcaataaattattcttattaagggttgttatgtactctaaaacatttattgtggtcccttcactggttctggtttacaaacttacttttctatgatgacatagtatagaaattgagagtgaatatttagaagttcatttttattatatatttttgaagtattgatatgtagtgaattagaaatttaaaaagaaaacaaaactgtccttcactacagattgaaaagcattatactaaaagaccatttgctcagttatagtatataaaggccaaatgacttaaaaacaaattatgtaaggagaaggaaacaaccatttattcagtgccactaactgtcagccagttttttcagtggtcagttaatgactgcagtagtgttctaccttgctcaaagcaccctcctcaagttctggcatctaagctgacatcagaacacagagttggggctctctgtgggtcacctctagcacttgatctcctcatgcagtgcatggtgctctcacgtctatgctatgttcttatggtctttaggtaacaagaataattttctttcttttccttactatacattttgctttctgaaattcccttctcgccaatccaggtgaatgtcagaatgtgatttgacaactgtccaaagtactcattcactgaggagtggtaaggccttcgcccaacctgccttctctgggaatatactgctgcctgaacatatcattgtttattgccaggcttgaacttcaccaaattaatttattagggtcaacatctaaatattagaactatttcagattaatttttaagtcgtatccactttgggtactagatcaaattgcaggtctctgcttctggcttgagcctatgtttagagatgatgtgcatgaagacactctttgcttttcctttatgcaaaatgggcattttcaatctttttgtcattagtaaaggtcagtgataaaggaagtctgcatcaggggtccaattccttatggccagtttctctattctgttccaaggttgtttgtctccatatatcaacattggtcaggattgaaagtgtgcaacaaggtttgaatgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacaggtgagcaaaaggacttagccagaaaaaaggcaactaaattatattttttactgctatttgatacttgtactcaagaaattcatattactctgcaaaatatatttgttatgcattgctgtcttttttctccagtgcagttttctcataggcagaaaagatgtctctaaaagtttggaattctcaaattctggttattgaaatgttcatagctttgatagtgtttttcagaagaccaaatttacagtgggagccttgggcttttgttttttaacagctcttttttgttcctgcttcagtggcctgacctccaagttagcaatcgccaggttgagaaatgctttgcgagacataacagatgctcctgaaataacaaacacttggaatcatgaggtagtggaattgaaaatagaaagtgtagtgattgttttttgttatttggatgggatgaacaatgtcagattagtctgtaactatttttttttaatgtcactctgatttggtcacaaaggatctctagtctcattgccttagtatcattctacgaattagaatgtgttactgtgtaagagcacttcttgtatatgagagaaatagcaacagttccagtttaaagtgatataaatggaaaccaagaaatgtctttactgggaccaaatctggacagcatttactgtatttttgctggtattttctctagtctttccgggtatattcacatttaatgatcacttttctccctttgtgctaatggacactgaatccattccactaccatagttcttgctaatactactctactttttacacaaaattaaaatgccaggagcacctccaggtagactgactataaatctagactgaaaaaaaagcttgtatttcttaacagattaccttgtggaacatttgctcctttcaactaatgaggcactaaatattgtaactgctcaactggtgcttttaatttatttgtctagactttgtcatgttgccagaagctttatcctggttggagttttgaaaacagtattgtttcttcagaaagaaaaaagggattgtcagatgatctaaaaataaagaaacactggaaatacaagtatcccaaggtgatagcattaggcaagataaaaatgttgaaaagcgaaaaagaactggttgatagagaagtgttgttattcagtagaacctaagtcttgtggtcccatttttaatgaaaaatggtgaattttttggtttttattgttcttgttcacacaaatctgcccattagaataagccaagccctaaaaattaatttcagtttcactgggaatcctttagtttatctactatgtagtagagaggttttgttttattgcatgtttgacgtaggaacgtatatatgcaagacatggaggaaaaccaagtgggccagagttttgaaaattctttatcttttctttctgccaaagtgagtctcccaagtttgtcttttttttttcatttccactcttctatggtttctagcattatataaaccaaacaaaaaaaatacgttcagagattccttcagaaatgctggatgatcttgatatcgatgcttttcatatatgtgtttatgatgctggtttctggggctggctctcagtatcacaaagatgtctgtaaacagaatatgctatttcttctttgtgacaaattttgaacattatgtgaatgtccaagaaagagcaaaagagggcaaacttctcatacatttttgatgtcgaaaccaagagacgcttttattttcctaacttttctttgaaagttcaaattaagtaattttatcctgtcctaaagtttaaaaagaaaaaaaaaaggaagaaggaattaaaaatccaaagaaaattatgtttgtttgcttttctgtttttttcttccttccaactccgagactttgcaagggcatagttctgaagatctctgacactgagacattagagatctctgtatcaatggatcatttgttttcagacatatgaaacaggaactttgaacaagaaatttcccctctttttctcatagtgatcctgagacatcagctgtggaatcacaacacgtcattagttttggcaggtccttgcaggtgttttgttttgttttattaatgttcttccctcctgtagctagacagcaatcttggagaatctgccagcttggaagactattgtgtaaatttcaaggtggagcctcctttaatttgttctgtgttacctgtgagctgtgaggtcatgaagaggagacaatgaggctaatcatgagagccccattggtttaggcaattagaacaacaagatctaaaatggtttattagccttgaattgtgttaagcacataattcataaaaaacagaaaaaatatttttaaatgtatgtctaaatcttcagttacaagtttgaaaggtgacaaactattctgaggaaatgattaggcctattcttgcaacgagtctttatgatctgaaaagaatctatgtccacacataactcccacctcaaagatggggcatcttttgctctgggagatatcaaatgcgaccaaaacaagtgtttgtagatttgaatgatgattcagcagtgtagcagttctcactcattttataataattaacaacttaataattaattattaaactcctacatgcttaacattataagtatgataacttctgtggttacataaaagatatacatagcacttgtccttgatctgtcacagtgaggtcccaatccaacctatgagcttcaaatgaaaagttcaaaattacactcattgtcataagtcagagatcaaaggaagaaaggatttaaccaaaatgataaattaaatataggtgattaaatatagtcatggttcaaggcatgggccagttagggagtgtgatgtgggtaattatgaaaggccagctcccaagccctgttgttgctactcccccacatcagtcatccttcctttttttctacttctactgcagtgccttcctcatcttttcccttgcatccctccattatatgagtcatacaaattagacttttcaaagcaacattaacattgtgtgaatttggggtttttgactaatcccaacattccacccccacattccagtcccacatgggatttggagccttgtttataaacctggcacttctaatatatcttatcttagagtaatccttgtatttgtttaatttccacttagcattgtaaatacttgcaggtatcctagttaagaaagcaaggtttaaacacaaaatcatcaccaattaaagcaggctagataaagaatgtaatagaaatgctagataaaacagattttttcttactaagttttctgtcccttatagagtgcataacacaataacttgcttgataagaattcaatgtacattgttttgtgctgaatcactaaatgcttgatttctgtaacaagagattgtggttccatcagtatctggattttagtctgtgtaatcttaggcaagttatttgatttctctgtgcctctgttttcttgtctgtaaaatgagtataatggtagtaactaattcattgtgtttttgtgaggattaaatgagttaataactagtactcctccctggcacatagtaagtacaatatgctgtgctgtggtggttgttattattttttatagttccttgagcaaaagaaataatgtccccatcttagtataatattggaggtatataccatagaagtgaacaaaagaatatagtttcacaaagaaagtgataattaaggcggttcataaagggtcataaagcttgtagattttagaaatgtgggggcatgaggatgtggagagggtattccaggatgccagacagggagattatggataagtactaagatgagaactagaaaaagctgaggggcaaaaggtcagaggaggccacaagttagggagtattaggaaaaagaagttaatacttgacaagtgccaacatggcttcacgaggaatgggttgggcctttttgagtgaggaagaggctggtgaaagggtggtggaggacactgctgctgctgatggcatggggtgtaggtggcaggagaggcagggacatgagctaggaaactctccagctatgaagtgatgagtctggagtaatataaggacagtaggggtggagtgctgaacttaagggaggagagaaaaataattggtatggaagtaggtacaatgcaattttattatttctgagcctaaaaatgtgaaatttttgattatttggtcagaccagggaagtattttcttttatgctatctctgaaaatgtatacactaaaaagttgtagtataaaaaggttgtaaagcattaagtaattttagaggaaacaataatttggatattttacatgcaatcatttatatgcaaatatatgtaaatattacaaaattattctctatttgttacaaaccttaaatatttttgactgaggaatattttattcatctaattatagctactttgttctaactaatagatattcttgaaaacaaagcaacacttttttggagacagagtcttgcactgtcacctagacttgagtgtgttaccttgaactccagggctccagtgatcctcccacctcagtctcttgggtaggtggattacaggcccacactaccatgcccagctgtattagtccatcctttcattgctataaagaaataccggaaactgggtaatttataaagaaaataaatgtaactggctcacggttcttcaggctgtacgggaagcatagcagcatctgcttctgaggaggcctcaggaagttttcaatcatggcggaaggcaaataagaagcaggcatgttacacgacgaatcaggagcaagacaaagtgagggaggaggtgccacacactttgaaatgagcagatctcatgagaacagcgccaagaggatggtgctataccgttcatgagaaatccacccccatgatccagttacctcccaccaggccccgcctccaacactgggaattacaattcaacatgagatttgggcagagacacagatccaaaccataccaccagctaataccaaaaaaaaaaaaaattttttttttaagacatggtcttactatgttctacaggctggtcttaaactcctggcctcaagtgatcctcccaccttggcctcccaaagcactgggaattcagacatgagtaacagtgcctggccaatacttatttttaaacattctctaccataaacttaggatcttgatttgttcacattgaacagatttttattatacagattgaatttataagaaaatgttgcagacattgtcaaaaagggacgtccaaaccactgtgatatttataagcatttgggccacattttgatagaactatacacggagtgtgtgtgtgtgtgtgtgtgtatatatatatacacacacacattatttatatatatgtatatatgtatatatatatatgtatttatatatatatgtgtatatgtatgtacacattatttacctacctactgtgtgagtgtgtgcatatatacacgcacacacacacacacaaatatatatatttcccttctgagacaaagccaaacagcactgtatgcttaaagaaaaacagtcacacttcccacttatgtaatttatattacatccagtcaccacaccagccaaactgctttattgttttttgtttgacatccaatgctaaagcataatgcctgttgcagtgaaatatacatgagcaaccctgagaactcaatatagcctcacgtgttgccactgagttgagttgaggagtcaagctgtagcaaaaaggtttgtcaccgggtgagtaatggtgctcttatttttctctgggtctcaagaagtgctctttatgacatatatggcattaaataaatatcagatatttgcacatcctaactttcctattggtgaagtttcttaaaagagagataaagggccattgtgtgattgatagtttcaggtatatttttgctgcacagtcagtccgagtgtaccacgtagggcaaaccacgtaacttctcagggccttgactgtttcatttgtaaaccagagaaaaggacttgggtgacctccaaagacctttcaaatttggagatgagtttgtggaaagttcaaacagtttagaaaacagaactaagacacccactggcacccctggaagcaagagagtgccaggtactatttgtaatacaggaatgaaatacctaattgtatgaaattgaattctaactgaaccagtttgttcagttaaattttttttttcaattagagtgcttacttcagtatctaacactagacagtaaactgtagacaaaagacctacagaatttctgaatggtatcaaattcaccacacttaaaactttgggatgtctaatttcaaccaacagctttctttcttcataatgttgaatatatgtgtatctattttagctaaatttaatatatatcaatatactttgatagatattttatataaactattagactatagtattatgagtaaaagacccaccatttcccaagcaattataaagaacgatcaaaattttaatgggttgttagtattatttctttaaagattgtgatactgataaatatttggccacattttaatagaattatacatggggtgtgtgtgtgtgtgtgtgtgtgtgtatatgtgtgtgtgtatatatatatggcagtagagatatatatatctacacacatctagatatatatatacatgtatatctatatatacacacatatatctgtgtgtatatatacatatgtatatatacctacatacatatgtacatatacatacatgcatatatctgtacatatatatatagtgtgtgtgtgtgtatatatatatatatatatttattttttttttcctgagccaaaacaaaatactaggttgtaatagctgttctttcagaaggaagaaaaacaacatgtgctgaactctgagtttgatgtttttgtattttacttcctattttcatatcagtccatttatttattcaggaagaatttattgagcatatattatgaacacagcttttgctaaggacagggtatgcagcagttatggcctagtaggagatatggatgttaaaaacaaaatgctcacaaatgcacatataatcttaatactcattgtaagctatgaaagcagagtgtgagtattatgagaccatatgttgggagattttatttggtattgaggatcaggaaagatacccctgaggaagtgatatttaatttgaaacctaaagaaagcagttggccatgggaagaaggtagggaatgagattcccaagcaataggaatccaatgtgtgaagaagctgagggagtgaaagaaagctagtgtggtggcaggaagaaagagaagagaatggagaagggcactaaatgagtcagagaagtaggaggggctaaaccatgtagggtcgtgtaggccatcttaaaggcctgagtgtagtggaaaacctttgaaggtttgttaaaaggtcaatgaaatgttctaatttctgttgtagtgaattgctttgattgctgaatgcgaatggatgggtagagatgcaagagtgaaagggaagaaatcaattaggaggctcttgccctgctccagataggactgataattaattttatttgggaagatcagggagaaagataagtcatgaatgactcccaagtttctggattgaagaaatgaaggtaccatacactgagatgggaaagcctaggggtagagtagctttgagaagaaaggtagcatttccccatttcataaaacatggaagaacaaagaggctggattcctgtttgtagacataccttccaggccagaactgcattactacaacatctttgcaagccacattgcctttcataactctgtgtcagtgttgatgccgtaacatctttggccttccccctaccatcctcccgcagtcctccatgataatgccattattccgtttcaaattgtgtgcttccattggatgtgtgagtctccttgaaagttataatgaggctgtagcccatatgaaatgcttcaactcaggtcctgcataggaagaggaagctaatctctccaggaactgagcctgtggctagagggatggataattgtttaaataaagaatatgctgctgagtactgatgggctctttatgtacccatttggctgctgctgcccaacctttaatctttcctgagctttaaataggaaggaaaaaatggtccacaaaggatttgagccattttgctgtggtgatgaggagcacgggtttagagacaaacactcctgtgtttgaattccagctcctactatctcctagctaagtgaccttggacaagtcacttaccttctccaacctgctgtttcttcatgtacgtaataggatttacctcatgaggttgacatgaagattgaaagaggtaacatatagaatgagcctgtcccaggacatggttcatgataagtctgccataaatgggagctatgtgtcccacccttttggaggagataactgttctgtagcaggtaatatattgtttgatacttggttaacccttacaattatcatttcctgttcttctcaataatgctagaaaccttttatttaaagaaccacaatataaaatgaaaaatatataaaaaaagcaaatggaaaaattctattggcaaggctttttaactttatatactaaataaatccaattgcttaaataatgaactgactcaagttctcagcactgcttcttgtttaattctctttagtttttcagaattctccaataatgacctttgtctactctcttcagtttattcagaaattacttttatttacatagaagtttggaagtggatacacaaacatatccctcacatatcttatgatcctatgagtcatatactcatctcttatattccctctgtaaagcaatgtaggtacctttcaggaaggtgatttttatgtaggttgagaaatatcagcatggaggtcctagctgacctctctagagagtttctgagacatttgacaacaactttttctttaagtcatcagttatgccccggggtatgaaatttctaacatgatcctcagtaaacttggctgccttgctgaggatactctccatctgcctgagagacacagacaccattaattgggaattgacttgacttgtgtggttccttgtggaccagatggccactaaatattctcatttcaaggcaattggtaaaaactacacttcaagaaatttcattcttaattccccttagtggatgttattaaccaaaggcaaaagaaaaaaagggtaaaaaaaatattctaaatgttaatatcaaaaatattattttcaattcaccccaggcacagagaactaagtattattattgctattgcaccggcattccccaatgagacagtgattttcttttaagacatttttaaataatataggcagaattaagtagacggtgatctggtaagtagatgtttcagggtaacagctgtgcaatgctccatgcagggaattagattgtcattttattccttaccaggaacatacattcagttaaacaattatttgacttctgctcttccactgatttctaagttgaggctctctcttgtgcctgtctgatcagataagtagagttgtgccttggtttatagatgagataaatgtgtatttgaataagcataagttaaagaaattttaaaatcccttaggaagctaggcttatcagagaaatccaaggaaatacattaacaaactaggaatttgttctaacaggttaattataactcataaacttattgggtttttttaccttttaattttatattacatttgcttataataaggaatattgctaggaataaaattttttaatattctacaattaacaattatctcaatttctttattctaaagacattgggattagaaaaatgttcacaagggactccaaatattgctgtagtatttgtttcttaaaagaatgatacaaagcagacatgataaaatattaaaatttgagagaacttgatggtaagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaacttggatccctatgaacagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtgtgcacaactttaaaatggagtaccctaacatacctggagcaacaggtacttttgactggacctacccctaactgaaatgattttgaaagaggtaactcataccaacacaaatggttgatatggctaagatcattctacacactttgtgtgcatgtatttctgtgcacaacttcaaaatggagtaccctaaaatacctggcgcgacaagtacttttgactgagcctacttctctcctcactggtatggctccaaccatcaggccctatcttggtccatttaggctgctaaaataaaataccaaagactgagctgcttataagcaatctttggaggctgagaagtcaaagatcaaggtgccagcaggtttgctgtctcgtgagagcatacttcctggttcattgatggtgctttcttgctgtgtcctcacataatggaaagggcaagacctctctggtgtctcttttacaatggcactaatcccatcatgagggctttgttctcatgacctaatcacctcccacatgtcctacattctaatactatcaccttgggggttaggattttaacatatgaatttgaggaggtggcgggggggacacaaatatttagaccatagcatttcactcctgacctccaaagttcatgtcttcttcacatgcaaaatacattcattccatcccaatagcccccaaagtcttaacttgttccagcatcaacttacaaggctaaagtccaaggtttcatctaaatatcagctaaatcagcacaaacagctaaatcaggtagagtgggacttaaggtgtgattcctctttaggcagattgctctccaactatgaaattgtgaaatcaaacctattatgtactttcaaaataaaatggtgaaacaggcacaggctagacagtcccatttcaaaaaagagaaatagaaaagaaaaaaggagtgacaggtctctataagtctaaaactttaaggcttgagaataatttgctttgctttgcctccaggctcactggggtggtgtcttacctctggacacactggggtggaggctctatcctcatggatttgagtgtctcattctttgtggcaggtctgtgctccaatcccacacctatggctccctgagtgtgcaattgcatgcctggtggttctactggtctgggattgcataggtggcccagccttcatagctccactgggcattgccctaatgtgggctctatgtggtgacctcacccctgggcctctacctgggccctgtgactccctgggttcttgaaatctaggtggaggcagccatccccctacagttgtgctgagtgtagtgcatgagtgctggggtctgctagagctatacctagggtggtggagatgtatggcaatggagtatggggagctgatatggtttgggtgtgtccccacccaaatcttgtcttgaattataatttccataatctccatgtgttgagggagggacctggtgagaggtgactggatcatgggcatggttttcccatgctgttcatgtgatagtgagtgagttctcacgagatccaatggtttcataaggcagttttccctgctcttgcaccctctttcttgcctgtcaccatgtaagacataactctttcccttccgccatgattgtaagtttcctgaggccttcccagccatgtggaactgtgagtcaattaaacctcttttctttataaattacccagtctctttacagcaatgtgaaaatgtgctaatacaggagcaaagactgcagtgtgaggtggcaatgtgaagtctgcaatgtgaggtggcacggggcagttgtagcccctcctttgaaatctttcttccctaccccaggcctctgcactctgaactatgatgggaaaggcagcttggaagatctccaaatggctttggagtcattcttccattgtcttggactataaattctggcttctgtttaggtggctgactaatatccccactgtctgaatgcatagcacctagtttctgttgagatggctagtccatagtaatttacttatcaaatttggccacaccctttgtattctctcctgagcaggctttctcatctttcacaatatggataggctgagaattttccaaattttgaagttctgcttcccttttgatcaataattccattttaaagtcatttctcatcttgaattttactatgagcagtcaagagtaactaagctgctccttcaactttgcttggatatttcctcagtcaaacattcaatttcattgctttcaagttctgccttccacaaaacactaggacacaaacagctcagccaagttctttgacattttataagaaggatagcttttcctccattgtccaataacatgttcctcatttccatctgaaaacccatcagattggcctttaccgtccatatttctgggaacattctgctcatgaccacttaggtattcggtaagaagatagtagctttctctatagctctcctcctctctggagccctcaccagaatggcctttaattgtccattcacagcaatgtaggctttttctagcatgtacctgaaaactcttccagcctctactcattaccttgttccaaagctgcttccacattgagtatttgttacagcagtacccagatcccagtaccaatattctgtcttagtccattggggctactacacgatgtcttataaacaacagtaaaatttatttttcacagttgtggaggctgggaagttcaaaatctggtgccagcagattttgtgtctggtgaaggccttcttcctcacagatggctgtgttctcactgtgttgttacatggcagaagagtgggcaggctagctctctgggatgtcttttataagggcagtaatccaaatcatgggtttagggtagagccctcatgacctaaatcacctcccaaaggccccacctcctaataccagcatctttgaagttaggatttcaacatatgactttggcagggggacagaagctttcagtttatagcaaaccctataggtagcactactttgtcctttcctaatcaatttgcgtcaatgaaacatgaattagaagagacctaggcgactccactatactgggattattcccagtataaattatcatctctccacaccttctcatctactccctatctgagttctgaagctctccactacaagaaggaggctttggtttgacttgatatacttctctgggaaacaggtttagcataaaacagtgatgctcattctagaacacctgcaaatgacaatagttttctttcgaagtcgccaggaatcgtctgcctttgggtatgtggctgtgagcactgccgggcaaaatgccatatgacctagatgaggcatatgccatcctttgaagccattaggacattatataggaaatatattaactaaaatggaataaaattttctaaataacaccttatgtttatccaacaggtggttcattatacttgagagcattatacagaggaatttgatggggaggagagctggagaaattctcgaaattctgggtttctttaacagaatactctagctataaacttataattttaaaaaataagcattatattaaagaaaagggaacataaattattttgttttattaaacttaagtccaaaggtctggattgtggcagaataggatcaggggacctaaaatgttgagcctcaaaggtcttcttagagaacaactgtattccactattagcgcttttggtccttttagcccaatttctgtttatcccaaatgttcttcccttttctgccttccttcacagtggaccctgccaggagctttgaaatgcctgtgagtgttaaacacttacccattgagtgcccaaccttaacatgcccctaataaaatgtacttagattaaccgttttcattatcaaagtttccttattacccaacaaacacaggcgctttaaagaaaacattaactaaattgcaagtgacacattttaagatctttgatatgacttcagagaatgcactataggaacacaatgcaatgggagggaaacttgggagggaagacattagcctttataaaatctgcaagtattgccaaatcaaaataaaatttacaggaaagcaggatcataaatataatctaaaatcttagaacctgtggttatgattttaaatactaatacaatgcaaaatttttacctgtttaggtttttatttcatcagttcatatttaggtatatacttttactgttctccttttttataatttaccattcacaaagatgatgatgttagtctaactttaatgtcatgagtgctttgagtagtagtgctaagtttttgttgagtagtagtgtgcttttttgattagtagtgataggtttttgatgagtaagcctgctagcagcatacaaacaaacaagcaagtatcagcctagagaagcagaaaaggcatttgggtttcaaagtcacaaggcctaggctttagtctaatacagctgataatacaatttgtccaaacaggacatttttgggtgtgtcaaacactaaactggacaggacattatgacaaaagtgcaaagcaggactttccggggcaaaccaggatgtatgtcatctcactgagtcctctctttgtccttgccatgactagtatctctagaggtaaatgaacagagtaatgacaaatagccagacacctgaatcttatcccaacagcacctcctacataattccccattatcccaaatggaaattaaaaatatatacagtgataattccaggccaagaaatgctttatttctagcttggacttggcttccatgtccagtgtagaatcttatccttgctgatctggactgtatctcatgaagccatgacttgtacctagttactagctggaaggcttagaacaaaagctggtccagagagcctcctttttccttatttcctgggtccacacctttaccatggcagtctgcctatcatttgatggaggaatttaaagcaagtccaagggaagggaagagagtttctaaaatctagaacttggatagtttaatttacctatcccaaaacagcttaggcccagacagcttctctccaagattggtgccaaactgaaattaccagctgtgtagaccaaagagaatttcaaaagaaactgaatcccaagagaaaaaaaaaagacttctggcattgtggcccaataaattggtaggattgttgtgacttttcaagtttacatgtaaaatgggcccagcgcagtgcctggcaaatatgggtactaagtaaaagtaactataatcatgtttttttaatctggacttcacttggtcatcctttaaatggtgtctgacagaatcctagttcttgtctcactttacttagtttccctgggaaatttcatgtgtccttttggctttaattaatatctctattttgatgacctccattatctgcctattcccagagctttccacctgatatctcagcacatgaaaagcaccttatgtcaataagtgagttccttccctgccccaccacatacctgtcctgtgttcctaattccactgaatggcatcccatcctccagtttcccaaggccaagacctgggactcatctttcactctcaagttcctccacgggtacccacatgtcacatcctgtcaatgctgtccctggggagtatctgaaatatattcacttttcttcatttccacctgacaccactattaacacttgcacaaatttctgaggttcctggctcatttccctcattgacccccaatagttcattctgctctttgcagctctggtgatctttccaaaccccacatctgatcacttgtttcttcccttcatatggctccttaatgccttctggactaagtccacactgcttaaggtggcttaccaggtccttcatgattttgtctttgtttggctttctacactcactgcccaacttccccttacttcccatgattcagttatactgaatttctttggttctctaaagcacatgtgctttctgttctgcagaggcttttttgttcacttgctattctctacctgggaaactcccccagcccttcactgcctccttctaccatctttcaggcctctccttacacatcacttctttccaaaaatctgccttgacactccaggtctcggtttcctaggtgtaccctataactccacccctttcatagcatttctcactctggctggagatttaccttttaacttgtccatgtcccccactggagtggaagttcctggaggtcagggattatatcctattaattgttgtatttccagtgcctagagtagtcttgcatacatggatggtattcaataaatattggttgaatgaataaggagttctttcatttcatatgtaatagatcatggaaatagccttgtgattgatacacagcaggtattaccatcctcactttagaatgaggactcagagccttgagatgtctgagggccttgactgggacagctggcagatgcaggagcagagctgcatcacccctgtgggctatctcagggttgtctgtaatctaagtacaatgtctgttgattttggactgaaggctttttgggtaattgtttgctttttcaatacttataaaatagtttccatccttactcattgatagtaaggttagttattttagaaaacaagctaaatagcagaaatagtggccttttaagttgaaaatttaccctgaaaaatctacagagtagcaaacagagtatcaaaaggagttgactgtatctatttttataactgccacttatggattattcagtaaaaccacaattcacttttatgattttttttcatgtttctctgtcacaagagcaaactcttgctccataataacattccagaatacagcaatagcaaaagtcaacattttgaatcctttacaaactcttagacatttttttttttttagtttaacatgttacaaaacaaaatttcttcttttttcacagcagtttgggaagtacatactatttattagctcatcagcatgaagctggaaaattctttttcctaaagttctttatatctacaaactgttgatgttttcatttatttatttttaatgctacgttgtaatgaaaatcattggaaaactttagattctagtaattttgaagtcttcttagtttggacaggactgagctaaagtttgtactttttttaatttattgaaaaatggtttctaatgatagtattaacaagattatattgggggcaggacgcagtggctcacacttgtaatcctagcactttgggaggccgaggcggttggatcacctgaggtcaggagttcaagaccagcctggccaacatgtagaaatcccctctccactaaaatacaaaaattagctgggcatggtggcaggcactgtaatcccagctacttgggaggctgaggcaggagaattgtttgaacctgggagtcggaggttgcagtgagcccagatcgcaccactgcactccagcctgggcaatagagcaagattctgtctcaaaaaggaagaaagaaagattatattggggatatatatgtgtgtgtgtgtgtgtgtgtgtatatacacacacatatatatatacatatatacatatatatacatatttaaaggataaaggattctgctgccacagatcactaaatcagatgatctctagcaatttcctgtttgtttgttttttgcccatagtgcttatctctttgaacagtaattttccacttactatttttctccccttttggaccataatttcctttaaggcagagcctcctgttactcatctttgaatctggggtctgtcagagtacctagaatttaataaactctcattaagagccagttgaaagaatatatgactaagcagtcatttacatccaaaagatccgtaggagaattcttatcagcacatgtgattggtaacaataactttgtacttttcaaaaacaattactaatctatcttgctttccattatctcaccaaaacctattagcatgtctggcagaaaatagatacttaataaatttcttaaatgtttactgacttcaattttaagttttattaactatgttgacttttctctaatgaagatgattctaaaaagctttttactatacttcacagtgaataaaacagtgagataggaatattgcaaaatgtcccctgtgttggtcagtcttagtgtcattcattttaaaaattctgttctctaaatattgacagttatatataaatttatgtaattgtttacttctaataaagaatttcatctggggaaaaacatactttgctcagctctttgccacaagtgcaaagtctaagacagtcaaatagctttcctagtacggccttaggaacttagtatatgactggtgtgaatctagagggagcatactgcattctgaccaaaatctccaccctgttactatggccatcactaacttcgcagtattgcagtacttcctgctagcttagttcccaaggcaacttgtgaaggaaaatttttacaaagctgttgtcacacaaaggtagtgtttcagttcctgagcccatgtccttggagttgcccaggctccaataatactaataattactgtacattaggtacttaccatgtgccatattctgtgggagccgctttccacaaattatctctggtaatccttgtaacaaccctttgacatcaatattattattttctccatttttttacatatgagataaatgagacttaaaataatgtgcctgatatcatcagcaaatgagctgaggagggcagattcaaagctgattgtgtttgactctagagctgcagtcttaagccagaccttttcttgctggttaattttactgaaaaaaaaaaaaaaaaaaaaaccctcaaatactgctgattgatctaaagtactaacatttctatcagtgttagggaaattttaattttataatttgattttgtgagaaatttatagcatcttgaatactcacatgcaaagtgatatgtcttagataacattttacaatggcagagcttaagccagtgctcagtcattcattcatcctcaagttttgattcatttatcattcatcaaaactctgttttgtttggccacccacattctaggagctcagtacatatttgataaatgaatgaattgttgaggttgacagttacccaggactggcattaggaacacagagctgaagagcacgtttttaccctcaagaagcttacagtctaacgagggaacttgcacaaatactactatcactaggtgcctggttgaatggcttaagagatgatcagggatattcagaaggatatgtcaggctcagcaatggcatcacttgagagcatcaaggtgtttagggaactacaagatgtttggttctgctgggaataagagtgaagggggctccatttggatgcctcatacaccaggtgagagatcttagattttattccaccaggaggagaactaccataggatttaaaacagaaatgatatggtcaaacctacatcttaggaagatccctggggtgtttgtatggtggacttgcaatttgactaattgagatttgtaggatgattcttaagagatgatgatgacccagactgggatcactataatagagttggtaaggaggagaatgatttaaaaagtagttggaagaattctagggatggagataaacatttgaaaattattaacttataggtggtcatcaataccctgaaaatgactgggatctcagaggagagtctggagagttggaaatgacaaagactaatattcaagggggcaggaagagggagagttgttcacacatgacaataggaagaaatggccatagagtgtgtggtttctctcaagccaaggaatagatgttttaagaaaggaaaattcttgtggtgggaagcagtagagatgacagatacacattaatttcttgagatttctagatgactaaatgggcagatgttgaatgatagctaaaggagaacccagaaacaagggagggattttgtttttgttttttaaaaaagatagaccatagcagcttcatagactgaaacaataaaaaagttgaaggcacaaagaaagacacaggtcctctaactccctgcccagtgccctttattcatattctcagcacttgtatttctaagttttatgtttgagtcttcggggatacatcagagtagtcccccttgtctaataaatgtgtttacatttcctgccataccagaaacccttctcaaactttaatgaatttctacaaggtgagattactttaatgagaaaccaaccaaggaaaggagtatcatctgcaatatactttcaaatgttttttgcttgtttgtttcttgtccagctaaaaaaaaaaaaaaaaaacaagccattggtcctaacacaactttcatattctaccccaatatcaaagaggcttaaaatctcctggtcgtgtgatgggcacacagttaattttttgtgaacaaacacagtgttatgggccatttctgaatttatctctgaaatcataagattctttctgagccattatctcattctatattacagtcaggtggagcccatcttacctcctcatactaaattctagacttctcaagggcaggagacaatcatctgtatatctctttggccttcatacactcaggagtacttgccaaaaataaacatttaatgcacatttatttgaataattgataagatccaatacttcaataactttgtcatatttttatagaatgggtttctatatctcatttgcattttcaaactttacttttactgtctagctttaaaaaaaaagcctttgactctaatacagccctcatattctaccccaatatctaagaggctttatatctcctagtgttgtaccactattttaactccagtattttttacttcatagttttacctatttgttacagttagtttttatgaattcaagagatgaatagcaattttccatatgtaatttaaaaaaccccacagttgactattttatgctatcttttgtcctcagtcatgacagagtagaagatgggaggtagcaccaaggatgatgtcatacctccatcctttatgctacattctatcttctgtctacataagatgtcatactagagggcatatctgcaatgtatacatattatcttttccagcatgcattcagttgtgttggaataatttatgtacacctttataaacgctgagcctcacaagagccatgtgccacgtattgttttcttactactttttgggatacctggcacgtaatagacactcattgaaagtttcctaatgaatgaagtacaaagataaaacaagttatagactgattcttttgagctgtcaaggttgtaaatagacttttgctcaatcaattcaaatggtggcaggtagtgggggtagagggattggtatgaaaaacataagctttcagaactcctgtgtttatttttagaatgtcaactgcttgagtgtttttaactctgtggtatctgaactatcttctctaactgcaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtgtgagtttcagatgttctgttacttaatagcacagtgggaacagaatcattatgcctgcttcatggtgacacatatttctattaggctgtcatgtctgcgtgtgggggtctcccccaagatatgaaataattgcccagtggaaatgagcataaatgcatatttccttgctaagagtcttgtgttttcttccgaagatagtttttagtttcatacaaactcttcccccttgtcaacacatgatgaagcttttaaatacatgggcctaatctgatccttatgatttgcctttgtatcccatttataccataagcatgtttatagccccaaataaagaagtactggtgattctacataatgaaaaatgtactcatttattaaagtttctttgaaatatttgtcctgtttatttatggatacttagagtctaccccatggttgaaaagctgattgtggctaacgctatatcaacattatgtgaaaagaacttaaagaaataagtaatttaaagagataatagaacaatagacatattatcaaggtaaatacagatcattactgttctgtgatattatgtgtggtattttctttcttttctagaacataccaaataattagaagaactctaaaacaagcatttgctgattgcacagtaattctctgtgaacacaggatagaagcaatgctggaatgccaacaatttttggtgagtctttataactttacttaagatctcattgcccttgtaattcttgataacaatctcacatgtgatagttcctgcaaattgcaacaatgtacaagttcttttcaaaaatatgtatcatacagccatccagctttactcaaaatagctgcacaagtttttcactttgatctgagccatgtggtgaggttgaaatatagtaaatctaaaatggcagcatattactaagttatgtttataaataggatatatatactttttgagccctttatttggggaccaagtcatacaaaatactctactgtttaagattttaaaaaaggtccctgtgattctttcaataactaaatgtcccatggatgtggtctgggacaggcctagttgtcttacagtctgatttatggtattaatgacaaagttgagaggcacatttcatttttctagccatgatttgggttcaggtagtacctttctcaaccaccttctcactgttcttaaaaaaactgtcacatggccaggcacagtggcttacatctgtaatcccaatactttgggaggctgaggtggggggattacttgaggccaggaattcaagaccagcccaggcaacatagtgaggccccatctgtctttattaaaacaaaacaaaactgtcacagcttctttcaagtgatgtttacaaattccctatggtttagtcacaaggaagttctgaggatgatgtatcacgtcatttctgttcaggcttttgagcctcctggaggtaaatggtttccttactgaaggcttgttattaccatgattatcactaagcttgaagtaacaaattaggggggcagactcacaacctcttgccctgccatggacaagttcaagaatctaagtaaagtcctctattgtctgatcttggatttgctcaacctgaacaagccaaggaggtgtattaaactcaggcacatcctgaccaatttggaattcttaagcttcagatcactgtggaagaggctcaactctttatggtgctgtagacttacgctcattttctaggtaatttataagggacctaatattttgttttcaaagcaacttcagttctactaaacctccctgaagaatcttccagctgctgagtagaaaatcacaactaatttcacagatggtagaacctccttagagcaaaaggacacagcagttaaatgtgacatacctgattgttcaaaatgcaaggctctggacattgcattctttgacttttattttcctttgagcctgtgccagtttctgtccctgctctggtctgacctgccttctgtcccagatctcactaacagccatttccctaggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttaaaactgggacaggggagaacctagggtgatattaaccaggggccatgaatcaccttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaaactttgttgttttcagatgcgttcacttgtcatgtttcatcagtctctcactccaatttctaagcttcatggaacatgaaacacgaatctgtcttttagatatagcctcttttgagaattcacatgaattagaacacacatttttagttatctgtttaaactatggtaaaatatacataacataaaattttccattttaaccattttaaagttcagttcagtgtcattaggtacattcacatggttgtgcaaatatcaccatcatccttccacagaatttttttcttgcaaaactgaaactctttttacccgttagtcaataatcccgcatttatctttcctctaatgcctggcaaccaccattttactttctgtctctgattttgactactcgaaggacctaggagtgggatcatacagtatttgtatttttgtgcttatttcatctagcataatgtcttcaagcctcatccatgttgcaacatgggtcaattttcttccttcttaaggttgaataatattcattatagagtagtccccccttatccttggggaatatgttccaagacccccaatggatgcctgaaatcactgatagcactgaacctgattactgtgtttattcctatacatacacacatacatatgataacatttaatttataaattaagcacagtaatagattaacaacaataatcataaaatagaacaattataacaatatattatgacacgagcgatacaaatgtggtctctctctttctcaaaatatctcattatactgtgccacaggtaactgaaaccacagagagcaaaaccttggatagggggaccactctataaatatgtaccacatttttcctcacccattcatccatcactggctacttggtttgcttccactttttggatatagtgaataatgcttctataaatatgggtgtacaaatgtttcttcatgtccctgctttcattacttaggatatgtttgaagttatttttatttttaaatggaggcttatagaacacaaaagatttatattctgcaagtgtccatctatttcttttaaagcttattcaaaaagtggtagctatctcatagctcttggtaagttaaaaatcttcatcaacgaaaatactatttctgcgttggcacctgcatggattttctttgtccaaatccctctttttaattgatgaggcttctttagttcctttttttcttccttgttgagcttcttcatgaaatgtgcagttgctagcatgtggtggacggactgcagatccctactgaatgccaggccctccggccctgtgttctctttcttggagaggtttgttttcacacgtaaccccaagagggcagtctcagagcgtgttctagtctagttctttttttaaaattactaaactttattttttttagggcagttttaggttcccatcaaaattgaacaaaaagtatggagagttcacatataacttctccatacatgatagcctcccccattcaacatcccacactaaagtagtacatttgttacaactgtgaaagcaaatagaatttcaagaccccaagctcactatgccaaagggcaagttaagcttcagagctgaattactcaatattgccttccttttgttccctaacagccgtaacttcacaatcttgtgtgatagcctcatccataaaccaggttcccacaatgatagaaggccacatatctccccaaatgacctccctcacaattgtgcccaaggaaaatccttgtgagaccctatcttttaggatacatatccctcctataaaatagccctaaaactgagttatgttgaatttcaccctgatgatgtcaattaccagcttgtcttcataggcacaggacgcgggcaagaccagaaatcatcgtgctgtctaccctgcaatgaacacataattgacttttcctttactccctctttttacctataaaatttggatttactgaacactaaccaaa

SEQ ID NO: 17183 - DNA, 18572 bp, Human
gggattacaggcgcccaccatcacacccagctaatttttgtgtttttagaagagatagggtttcaccatgttggccaggctggtctcgaactcctgacctcaggtgatccgcctgcctcggcctcccaaagtgctaggattacaggggaccgcaaccagccatcccctatattgtagcacagtgaacaactgtcctgaacatcacaagctctttgagacactacagtgtataagcaggtctctgtctaaaccgctctcctcttcctcctctgcccaaacaatgtctgctcaaagaatgtatcccgtgtgttcattaacttagcaatttccagcaaacagtttaattgataacttgttaagagaaggcaggaaacctccatgaaagagaaatcactgggtatttcctacagcatttaacacatcgtaggcctttaataaacccttctgaaataaacaaacctctttactcttcattccaccttgctaagaatctcacctaagtctgtctaccatgtgaaactgcagatgacctcacagaaaatggaaagaagtatctctaaaaataagtttatttggcagcacactataggctacaggtccacttctgatttttttttttttttttttgagaccgagtcttgctgcgttgcccaggccggactgcagtggcacgatctcagctcactgcaacctccgcctcctgggttccagcgattctcctgcctcagcctccaaagtagctaggattacaggctcccgccatcatgcccagttaatttttgtatttttagtagaaacggatttcaccatgttggccaggctggtcatgaactcctgacttcatgatccacccgccttggcctcccaaagtgctgggattataggcgtgagtcaccgctctcggcccacttcagatatttattttgaggagggagcgcatttagacacagaccccaaatttatttaaatgtctcaatacatttaaatgtagttacctaaatatatctaatatatttaaatgcagagagcaaatttgcgtttacaaatctgacatggaatgcaaatgtgctagccaagattcggtgtagcttaccagccagaaatcacacatcctaacaggtagaaacgtattgcatttttaaaaactgcgcagctatgcaaataaggatgtgtctggacgctctaccgtccccaaaataaccttaattttttaaaaaggccaggcacggtgcatcatgcctttaattccagcactttgaggggccaaggcgggcggattgcttgagctcaggcgttcgagaccaccctgggcaacgcagcgaaatccccgtctctacaaaaaaaaattaaaaataaaatactataaaaataaaaataaaaggggagagagaacaggtagaaaggaaatgcattcagtctatggggatttcacgctcccgcttcaagtccacggccctgtgatgggatgtgggcaaggtctgtctgggacaggccgaacccaactcctcacagggccgaatcctttgcccgcagcccaggaccccgaaggagcttgcctcggcctcaaggcgcacccaaggggcacgagatcgctgcaacactgaggtcgccactccggggcctccagggggctgcctcgccacgcgcctcggccatgttccccccatttccaggaaggttggaatgccgtgggtctcaaagagggcgcgcgagaggggacaccggaagactgcgagccccgctcacctcgagctctcagctcgctccatggatgcaacacccgatccgcctcggggactgggaaagttccctccagggctcccacaggcgctccgcctcctgaactcccattggctgctttcgacgttgtgctccaccctttccgggcggggcggcaaaaatacttcccgtctctccttttcccctattggctctgtcaaaggtcgacttcgtgacgtcaaagagcctgggccaatcagagcacaccggactgcgttttcccgaacgcccgcagcagggtcagaagggaggtggccggtctccgtcgtgacctctgacggtttctgagcgttggcctttggcacgcgctacccccttttgctttggttctgccatgccgatgtaccaggtaaagccctatcacgggggcggcgcgcctctccgtgtggagcttcccacctgcatgtaccggctccccaacgtgcacggcaggagctacggcccagcgccgggcgctggccacgtgcaggtaggagcgcggggccccccgcccagtgcgcacgcgcggcgaccggctgctggcccgggtccccccaggccggagcgagcgcgtcccaaccggttcacggccccaccccggcatctgtgccggccggccagggactcactcagacttttatgttttaaaagatttatccaggccgggcgccgtggctcacgcctgtaatcccagcactttgggaggccgaggcgggcggatcacctgaggtcaggagttcgagactagcctggccaacatggtaaaacctcgtctctactaaaaatacagaaattggccgggtgtggtgaggcgcctgtaatcccagctactcgggaggctgaggcaggagaatcgtttgaaccctggaggcggagtttgcagtgagctgagatcgagccattgcactcgagcctgggcaacaagagctaaactctatctcaaaaaaaaaaaaaaaaaaaaaaaaaatatatatatatatatatgtatgtatctttccaggtcgggcgcggtggttcacgcctggagtctcagcgctttgggagactgaggcgggaggatcaattgaatcccaagagtttgagaccactctcagcaacatagcgagacccttgtctctattttttaaatgttttaattaaaatacaaatctgtccatattttttctttttttaatatatggttgcttaaacattttggttcagagattctaccctctgaaaagtgaatagcacataaatgctcattttgaggaattacaaagcgaaccccagggtcaccatggcccaggttgacacacattgtcaccactccattctttccacttaaaccttccctctccacccccaaccccaggtcctgatttttatggtaattatgtcttgcttgtctctattattttgtcaactatttatccctaaacaatatagtctggttttttgtttttttttgtttttttcagatggagtctcactctatcacccaggctggagtgcagtggtgtgattttagctcactgcaacctctgcctcccaggttgaagcaattctctgcctcagcctcctgagtagctgagattacaggcgctgtccactggacccggctaatttttctatttttggtagagacggggtttcaccatgttggccaggctgatctcgaactcctgacctcaagagatccacccgcctcgacctcccaaagtgttgggattacaggtgtgagccaccgtgcccggcccctaaacaatggtcttcatataggtaagcatacagcgtatagtctgatgtgtctgggtgttttttttttttttaatgtagagatgaggtcttaccacatctctacataaaaggtggttatggagacccaaggtggtctcaatctcctggccacaggcgatcctctaaccccagcctcccaaagtgctgggattacaaacatgagccactgggtcccagccctggcttctttttcgtagatattattttaggagtcattttattgtaatatcagaagtattcatcatctctgtactataccgttctattgcatgactctccaccatatacttatccatcctgcttgctcagggacactggattgttttccattttaacttgctatgaacagtcctgcagtgaatactcttatacagaggagcaggcatggggtatgtactaatgaatgggactgctggctcagcggcccgcctggctttccactctattaaattgttttccaaagttatactggtttatgcgctcgctcaccgctcaccagcagggtagaagaattcctgatgtttgcaccctgcccaaagctggtgggtgtagcgtggtatcctaaggtagttttagtttggatttctccagacttctctaacttgaggaccttttcatattcactggccgctgtgattgtgcttttgtaatgtacctgctcaagtctttcactcttttctcattgcaaacgtacatcctaggtttccagcaggagaaacaggcctgtccatttctgacacaagatgggtgaatcggtaacttttctggtctgttttcccactgcttgttatccttctgttttctttaatggctttctgcctagatcaggagggacagactttcttttgaaacccaataacacaactgttatttcagtacagagctaagacagaaatagcagacatagttcaatggtccctgcacctagagagtgccgtggaaacagggcccagtcaccctccaactgcacagtcccatgaagccaaaaagacaatccaggttggagaatgtcacctttcatttaaggccaagttttgcagagtctgttttatttgtttttaagtctgctgcctaacttcttttgggtttttgtgaacttagaggacacataatctcactcttctagcagtttctctaggaggtgataacaatgcggacaaataattagccataaaacatcttggccaggcgcagtggcccacgtctgtaatcccagcactttgggagaccaaggcaggaggatcacttgaacctaggagttcaaaaccaatctgggcaacatggtgaaaccccattgttacaaaaagtacaaaacttagccaggtgtggtagcatgtgcctgtagttccagctactcaggaggctgaggtgggaggatcacttgagcccaggaggtcagggctgcattgagctgtgatcctgccactggactccagcatgggcaacagagtaaaaccctgtctcaaaaaaaaaaaaaagaaaaaaagcaatcaagtatctccagggtaaatgaaagcaacatgaagaataagctgtttataaatacatataaattaaaactaatggagaaaaacagtataccacatcacagtctagtctcagcaaggaaaacaacaggccaacattagaagacacgaatgacataaaacagatcttgaacattttgttattactcagatcacgaaggactagatcacgctgcactcagggcttaaaaatcacaagccacgttacacatacagtacttcagacattcttcattcctgaccgaggttttttttgtttttgagacagagtctcactctgtcacccagtctggagtgcaatgtcgcaatctcagctcactgcagccactgtctcccgggttcaagcaattttctcctgccttagcctctccagtagctgggattacaggtgccccccaccaagcccagctaatttttgtgtttcagtagaaatggagtttcatcatgttgtcctctcgaactcctgacctcaagtgatccactcgcctcgcccttccaaagtgctgagattacaggtatcagccactgtgcctagccagcactcaataatttaattggcatactgaactctgttccacccggaagtcagtggacttcacatttctctgacgtttgatcttaaataagagcagcagactaggagaggtgagaaagtgctgattaagcccgaaggtaaataggagttaagcaaacaagagaagaaggaagagtgatgcagatggagggaacagcacatgtgaagatctgtggtcagagccagggtggtggtttaggaactcctcggacagtgtggctagagcacaggcaaaggacgaaattgggtgaggtaaggtagccagaggccaaatgatacaaaatgtctgtgaagccatgttaaatgtttgacattttatcctaagcacctagcaggttagcaagggggagacattgacaatatctgattttttttttttttttggaagcagtctcactctgccgcctaggctggagtgcagtggtgtgatctctgctcactgcaacctccgcctcccgggttcaagcgattctcctgcctcagcctcctgaatagctggtattacaggcacccacaccacacctggctaatttttgtacttttagtagagacggggtttcaccatgttggccaggctggtctcgaactcctgacctcaggtgatctgcccctctcggcctcccaaagtgctaggattataggcatcagtcagcgcgcccagccttgagtttctttttaagtctttccagctgccatcttaaaggatggtttgcaggggtggactagaatgggtgcaaggtggaataggctaggtgaaaaatggtggcctggccacgtgtggtggctcacggctgtcttcccagcactttgggacctgaggtgggaggatggcttgaggacaggagtttgagaccagcctgagcaacatagcgcagttctttgtctctacaaaaaaatttaaaaattagccaggcttggtggcacacacttgtagtcccaggcactcaggagactaaggcaggaggatcacttgagcccaggaagtcaaggctgcagtgggccatgatcacacccctgcactccagcctgggcaatagagtgagaccctgtctccaggacaaaaaaaaaaaagacaagaaaatgatttgtggaattgattacttggccccatggacgtgcttccaagctaaaataaagtgtttcaacctgtgttcccttttccctatttgtataaattactcagttacattctcattgctacttatttaagcaaagtattcttagtttgttaagaacaaagaactacaaattgtgttcattttctatccttccctgttgttaagactaaattacctgaaataggaaccatacaatttcagagtggcttttagccacaacttttatttgttgaagctttttttttttttttttttttttttgagacggtgtcttgctctgtcgcccaggctggagttcagtggtgcgatcttggctcactgcaacccccgcctcccgggttcaagcgattctcctgcctcagcctcctgagtagctgggactacaggcatgcactaccacacctggcttatttttgtatttttagtagaaacagggtttcaccatgttggccaggctggtctcaaactcttgaaatcaggtgatccacctgccctcagcctcccaaagtgctgggattacaggtatgagccaccgcacctggccttgttttaagcatttggggatcaatttgcagggacctattggactatggggaaaatgagatgtttctgctcctgtattttaatgtctttttcctttttgtttctttactttgtaattaaggctttgcagacttgcatcccataatgtcttcttttatttttttttatttttattttttgagatggagtctcactctgtcacccaggctggagtgcagtggtgccatctcggctcactgcaacctccacctcctgggttcaagtggttctcctgcctcaccctcccgagtagctgggattacagttgcgtgccaccatgccaggctaatttttgtatttctagtagagacggggtttcaccatgttggccaggctggtcttgaactcctgacatcagatgatctgcctacctggacctcccgaagtgctgggattacaggcgtgagccaccacacccagcccataatgtcttcttttaaagggtgggaggtttggtgagtgcatggcaaagtaagacaagtgatcaaatttaaacaacactggtctgatgggagaggaaatgaacatttggctgttggtttgtttaggaagagtctaacctgtctctgcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggtaggttcgttttgaaagctgaaacgttagtaggtactgagtggttagtgcagggaaattgtgctgctgtgattaaagccttagctttcaggccgggcgtggtggctcacgcctgtaattccagcactttgggaagccaaggcgggcagatcatgaggtcaggagatcgagaccatcctggccaacgtggtgaaaccccatttctactaaaaatacaaaaaattcgccgggcgtggtggcgggcacctgtagtcccagctactcgggaggctgaggcaggagaatggcatgaacccgggcagcagagcttgtggtgagcggagatcgcgccactacactccagcctgggcgacagagcgagactccgtctcaaaacaaaaacaaaactagctttctagttttcaaaggcagagccaagagcatgttcatatttttttcttctctaaatgagtgtgcctttgcacagaacagagtcccagggcaggagtgaagtcaaaacaagctctaaagcctcctcttgacttctcagagcacgtagaggacagggaggatctgtaggtagagaaggagtggaagagagttacagcctctgccagtccgggcatgggtccagcagcttctgagccctggaagaacagatctcagcttgcttgctcagtgttccccagaggttcagcagaggcagcccggactctctctgatcacaggccaactttcagaaccgtgactgcccaagtacaaaaatcctacccatccttttgaaatgtactgcttaggccagtcagtctcatatttcaaatgcgttttgcttgaactcagtttgctgtattacaagtaagttgcatcagccagctctcatgattgaagtttacaggcttcagctaatttaggggagaatctgatatgcaaagaaagaccacctcgtttgttaaccacaatgtgatacttatttgaggatgcaaaagggtttgtcccaagaatccctatcaatagcctcctctagaatgggtgatagaatagcactacttaaagccctaaaaaatgcaagcattgtggtgtctcacccagggctgggatatttggtaacctcagtacctctgcattcatgtattccttcctctgctccctcattcattcagtacttgttggcatgcactgaggactcagatgaggcgcaaccaggccctcagggagccggagcctagcagatgagttttcgagcatgcgcggctgaaatgactgagaaaagaccctgagtcatttctcagggtgctggggaggtatctcagagcatgtggtgctcaagatgaattttgatacctcagaagacccagcgtcaagtaatacaatatgttcagggaactgcaaggcattctgcctaggccgacgtgtgggatattggtcaggagtggcaggcggggtacagaaagccaaggagtttggccgtgagtgttcacatcagtgcattcattattacgagtgaaagcgtagaataagaaactctttatctaaaaaggctgtcatgcatgggtttggattatgacaggcccatccccctggacctctcatagtgccccatgccagagcaaactgtggccccgaaccattgcctggcttctgtacccgtgggccactggcactgaagagggttacacagtgggaataaacaaggctgtcagtctgagcacttcagttaacgcctagtattttagcatctccccatccctcatcatcaatgatatcttgggccaacaccccttcttaaggggttcttcatggaaacatcttaatgaacacaaattggccgtggtcagctgttggaaagattgagtagctggaataactgcaggttaaaagggacaaataaaagtgtcattcctaggccaggcaccatggctcccatctgtaatcccagcattttgggaggccaagacggacaggtcatttgaggtcaggagttcgagaacagcctgggcaacatggcaaaaccccatctctactaaaaattaaaaaaaaaaaaattagctgggcatggtgacaggcacctgtagtcccagccacttaggaagctgaggcaggagaatcgcttgaacctgtggaggcagaggttgcagtgagcagagatcatccactgtactccagcctgtgtgacagagtgagactctgtctcaaaaaaaaaaaaaagtgtcattcctcatatgttgttttatttgacagtagagtcaactttttatttgttgggggtaagggggtggagtccgctcatatcccagctccactctgtcctgagcgagtgaccttggataagttactggctgcaacgtggagatgacgctagtgccgtcttcatggaagtggcggagtcggttagataaccctggttaggttcttagactcgcgcccggcacagtggcactctccgatgactgttattcgtacattgtcttggtctttccccaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatggtaagtagacgggactgagttcaacttacacacagctgccccttgaacaccatgagtttcacctgcatgagtccatttacatgtggatttttttctttttcttttttttttttttttttgagacagagtctcgctctgtcacccaggctggagtgcagtggcacaatcttggcccactgcaacctccacctcctgggttcaagcgattctcctgcctcattctcctgagtagctgggattacaggcgcgcaccaccaggcccagctaattttttttatatttttagtagagacggggtttcactatattggtcaggctggtctcaaactcctgacctcatgatccacctgcctcagcctcccaaagtgctgggattacaggcgtgagccaccaggcccgggcctcatgtggatttttttcaataactatcttggaaaattttttggagatttgcagcaatctgaaaaaactggcagacaaaccgcatagcctagaaatatcaaaacaaggccacgcgcaggggctcacgcctgtaatcccagcactttgtgaggccaaggcaggcagatcacaaagtcaggagttcaagaccagcctgaccaacatggtgaaaccccatctctactaaaaatacaaaacttagccgggtgtggtagcaggcgcctgtaatcccagctactcgggaggcggaggcaggagaatcacttgaacccaggaggtggaggttgcagtgagccaagatcacgccattgtattccagcctgggcgacagaacgagactccatctcaaaaaagaaagaaaaaagaaaaatatcaaaacaagaaaaagatatgaggcataaaatatttacatactagtctattatttacatacacaaaatatacacaaatctattttaaaaagttaaaatgtatcaaaccttacacacacacacacacacacacaatacatggcaccacttgcagttgagagaaatgtaaacaaacgtgaagatgagcatgaaatcccaactgcgtaacattaattgtggaacaaacagactgtactgctggaataatttcacagccgcctccagcgtggggagtgtctgcttcaatctgcttcagacaccctgtgacgctaatcatctcggtgtgagcagctaattcatctctccaggaaattgcatgttgcagtcaaaagtgacctcttgggaggccgaggcgggcagatcacgaggtcaggatatcgagaccatcctggctaacacggtgaaaccccatctctactaaaaaatacaaaaaaaaaaattagccaggcatggtggcaggcgcctgtagtcccagctacttgggaggctgaggcaggagaatggtgtgaacccgggaggcagaggatgcagtgagccgagatcacgccagcgcactccagcctgggcgacacagcaagactccgtctcaaaaaaaaaaaaaaaaagagatctcttgaggttcttggctatttttccatcgtgcattgccataaaccttgactaacactgtgggacacttacaaagtgtctcttgtgatactgaaaatgttcccaagaagcagagaaaagtcatgagattacatgagaaaggtgaattgcttgatatgtaccagaagtctgcagctgccacttcaagataaatgaattcagtgtaagaaccattgtttaaaaaaagggaaatttggtcgggcacagtggctcacgcctgtaatcccagaactttgggagaacgaggagggcagatcacgaggtcaagagatcaagattatcctggccaacatggtgaaaccccatctctactaaaaatacaaaaattagctgggcgtggtggtgcgtgcctgtagtcccagctacttggaagcctgaggcaggaaaatcgcttcaacctgggaggtggaggttgcagtcagctgaagtcgcaccactgcattccagcctggcgacagagcgagactccatctcaaaaaaaaaaaaaaaaagggaaattcatgaaggcgtcactatagctgcaccaggaggtgcaaaaaccttgcactttttgcagaatacctattcatctcacattgaaaatgtagattttggccggttgtggtggttcatgcctgtaatcccagcactttgggaggctgaggtgggtggatcacctgagatcaggagttcaagaccagcctgaccaatatggcgaaaccccatctctattaaaggcacaaaaatgagctcagcatggtgaccttcacctgtaatcccagctactcaggagactgagacaggagaatcgcttgaacccaggaagtggaggttgccgtgagccgagatcacaccactatactccagcctgggctacagagccagactccgtctcaaaaaaaaagaaaagaaaatgcagcttttatgtggggtgcaggattactgttaggcatacctatagactctcataagattttagaaaaagcaaagtcattatatgacaacttgaagccaaaggatggtgaaagatctaaagctggagagtttaatgccagcaaatgatggtttgataattttaggaagaggtttggcttttaaaaatgtcaagataacaggagaagcagcttccgccaaccaagaggcagcagacaagttcccagatgccataaagaaaatcatggaggagatgggatacctgtgtcaacaggtttttaatgcagacaaaactgccctaatctgggggcatgggagggaaccacaaaggacatctattaagtaaagaagggaagtgagccccaggattgaaggcacgcagggctaagctaactgtcctgttttgtgcaggtgcagctgtgtttatgatcaggcgagctcttacctataaaactgctaacacctgagacttaacgggaaaagataaacacagctgctgatcttttggttgtacaacgtctggacaagaacgctttttctggattaattccattgatgccttgtccttgaagtcaggatgtaccttgccagtaaggtacacctttttaaagttcttcaatgctgcaggcactcagagccccacgagttaacaccaagggcgtcaaagtcgtctacttgcccccaggctcattacacacagtactctatgaaattgtcagtgctatgaaagagaaccctggctgggcatggtggcgcatgcctgtaattccagctactttggaggctgaggcaggagaattgcttgaacccaggaggtggaggttgtagtgagatcgcgccactgcactccagcctgggtgacagagcaagactccatctcaaaaaaaaaaaaaaaaaaaaagagaaccctgattagaacatcttgaagagtctggaaggattacatcattgaagaggccatcatcgtataaaaagctgtgaaagccatcatggtgaaacagtacattcctcctggagaaacctgtgtccagatgtgcgtgacttcataggatttacgacaatcaaggaaaccatgaaatagatcatagatggggcaaaagtgggtggtgaagagtttcagggtatagatcttggagaaattcaagggctgacagacactgcacagaagaattaacataagacagcttaatggagagaagtgcttccaaaccagtgccagacgttgaggaagaagacctaggagaagccgggctggaaaacagatttccattagacagtctgggagaaggcttctgattattcaaggctgcttttgacttcttttacgacctggagtcttctatgatataagcactgaaactaaagcaagcagtggaagggttgatgctgcacacaactatttttagagaaatcaaaaggcaaaaagtcagacaaattatgatgtatttccctaaagttacaccgtgcttgcctctcgtcctttcctgcctccctttctacctcctccacctcttccacccaagacagcaagaccaacccctcttcctcagcgacatgaggacagtgggatgaagacctttatgatgatccacttcaacttaatgaatagtaaattcattatcattttcttttaaagaggcagggtcttgctttgtctcccaggctggagtgcagtggtgcgatcatagctcaccacagcctcaaccttctgggctcaagtgatcctcccacctcagcctcccaagcagcagggactacaggtgtgagccaccatgcccagcatccttattattttcttaacattttctcaagtttattgtaagaatatagcatataatatacagaccatacaaaacgtgttaatcaactgtgatgggtaaggcttcccatgaatagtaggctattagtgcttaagttttgaaggagtcagaagttttatgtggattttcgactgcacagcagtcgggggtcagtgtccctaacccccccactgttcaagggttagctgtactatatgatgagatgtgcaacatggttttgataagaggcagcaagggtttaggacattctgtggcatactggccacatagcgatttgcatcaggtcagatattctaagtctagaaagcctgtgggatagttctagaggaggagcagagatgaagcaacgcaaagatgcccttgttcgtctgcaaaatttagggtctctgagtgagacacagctcaagggggggactgtgagcatttggggaagggggttctgtccaaccaggcaaagcggggagtcatggctatcacagccatcttgccctcacattcaagaacttaccatcatagggacactgaagttatcttctcatatggccatataaagataggatgttatgtattgactatcccacagatgtatgcctcttctggtttatgttgatatggagagaagcgagttcatgtcattcatatcttaattgccctcagtctcacagaaggcgattatgaggccaagagcctgggagatgcagctcctgggtttccagccctcagcccccaaaaccttaggcagcagggattggagcaggtggtctgaggtcccttctagcttcagaagtgtcataatcaaataccaggaatgactctttggttacttttttaacatagtttgcacttaaacccttttcagtagtaagcatcttagagacagactgaaaatgtgatgttcttcttgaaaacaccctttcccatgtcatcagtctgtggtgtttggtgactgtccccttccccactgtgcgagtacttccctcagggctgctctggtgatgctacctggcgtgttttttcttttcagtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattgccgtaactgattttaaagggtttagattttaagaatggtgctctttcatgcctattatcagtaaggggacttgtattagagtcagagtctttttatttaggccagttgtcaagtgtcaataaaagcatcatgtaatttatggttttcattttatttaaaattcagcaaaatcatacgccatctaccgtgatgactgccaactccatggcagaccctttctgggattcaaaaaccaattcatcagatcgctgcctctgagggatgtacagattggctggggagctgagtgctacaataaaggaggaagtaccggggaacagtgcagggcaaaggcaggaaagagatctgagctgcctggagatcatctggggtgcggagtacaaagctttgcaagggtgtggttttggaatgacgctaaactgaaggtggagagaacagataaaaaggttggaagttgcacactgtacactgttaagaagttgagcttttatcttagaggcagcagaaggtttggagccaaggaatgaaatgatgaggcgtccttcaggtaatgaacttcagctgcagtgtgaaaggggcaggaagactggcagctgtcaaaactggaacagtccagtgagtatgtgcaggcccgggcttgggcagtgacgagggcagggagcacacatcaatttctgcggtagaaccttctagaggaagaccagacagagggtcaacagagttgaaaggagaaaataattgaggatgaggtccaagtttttagtttcagagactaggcatatggttaatatttaggtaggaaattcaggaaaaggagcttgtggggcaggaagggaaggaacggcagcttggggcactctgacatctttaacaagtcttgtaaaggcttactaaatacaacgaagcattgtaccaactataccctaataaagattaaaaatttacattccagttaactaccttaaaagttaagtccactttcatcccacgcccccatcctttccgtcatccctcacccctttgtcttgagaaaggaggtttagctgcttctttagttctgcaatttctttttcttgctctattatcttcatctgtagggtgaggttaacctgtaaggagaaaatattttaaactccattaaaataactttttttttttttttttgagacagagtctcgctctgtcgcccaggctggagtacagtggcatgatcttggctcactgcaacctgtgcctccccagttcaagctattctcgtgcctcagccacccaagtagctgggattacaggcgctctcatacaagcccagctagtttctgtatttttagtagagatgaggtttcgccatgttggccaggccggtctcaaactccttacctcaagtgacccacccgcctcgacctcccaaagtgctggaattacaggtgtgagccaccacacccagccaaggtttcattttatacaaaaaacttttgcaagatagtagaaatccttaccataaatactaaataactatggtctctaatagctatcttaactgagcatcagaaaatccccttcatatatgaagataaatgtttatacttggtttcaagaaccacatctgtggctgggcatggtagctcacaccggctaatttttgtatttttagtagagatggggttttaccatgttggtcaggctggtcttgaactcctgacctcatgatccgcctgcctcagcctcccaaagtgctgggattacaggcgtgagccaccacgcccaatgcttgtaactcttagagtagacaggcggtggggagtcaacctgcttacgtggacaatgaatataagcatgctactggtattcaacctagtgcttgatacagtcagggaactctgagaatgggtttaaatattttgtttgcacaaatatgagtctaagctcgactattcactgaaacagggttcactatttatattgagacggagtctcgctctttcgccgaggctggagtacagtggtgtgatctcagctcactgcaacctccgcctcccagttcaagtgactgtcctgcctcagcctcccaaggaggtgggattacaggtgtgcaccaccacgcccggctaatttttgtacttttagtagatggggtttcacc

SEQ ID NO: 17184 - DNA, 7456 bp, Human
gcccagtggcaacacaggtcctgcctggggatcaggtctgctctgcaccccaccttgctgcctggagccgcccacctgacaacctctcatccctgctctgcagatccggtcccatccccactgcccaccccacccccccagcactccacccagttcaacgttccacgaacccccagaaccagccctcatcaacaggcagcaagaagggccccccgcccatcgccccacaacgccagccgggtgaactgtagcgttggcaggtcctgaggcagctggcaagacgcctgcagctgaaagatacaaggccagggacaggacagtcccatccccaggaggcagggagtatacaggctggggaagtttgcccttgcgtggggtggtgatggaggaggctcagcaagtcttctggactgtgaacctgtgtctgccactgtgtgctgggtggtggtcatctttcccaccaggctgtggcctctgcaaccttcaagggaggagcaggtcccattggctgagcacagccttgtaccgtgaactggaacaagcagcctccttcctggccacaggttccatgtccttatatggactcatctttgcctattgcgacacacactcagtgaacacctactacgcgctgcaaagagccccgcaggcctgaggtgcccccacctcaccactcttcctatttttgtgtaaaaatccagcttcttgtcaccacctccaaggagggggaggaggaggaaggcaggttcctctaggctgagccgaatgcccctctgtggtcccacgccactgatcgctgcatgcccaccacctgggtacacacagtctgtgattcccggagcagaacggaccctgcccacccggtcttgtgtgctactcagtggacagacccaaggcaagaaagggtgacaaggacagggtcttcccaggctggctttgagttcctagcaccgccccgcccccaatcctctgtggcacatggagtcttggtccccagagtcccccagcggcctccagatggtctgggagggcagttcagctgtggctgcgcatagcagacatacaacggacggtgggcccagacccaggctgtgtagacccagcccccccgccccgcagtgcctaggtcacccactaacgccccaggccttgtcttggctgggcgtgactgttaccctcaaaagcaggcagctccagggtaaaaggtgccctgccctgtagagcccaccttccttcccagggctgcggctgggtaggtttgtagccttcatcacgggccacctccagccactggaccgctggcccctgccctgtcctggggagtgtggtcctgcgacttctaagtggccgcaagccacctgactcccccaacaccacactctacctctcaagcccaggtctctccctagtgacccacccagcacatttagctagctgagccccacagccagaggtcctcaggccctgctttcagggcagttgctctgaagtcggcaagggggagtgactgcctggccactccatgccctccaagagctccttctgcaggagcgtacagaacccagggccctggcacccgtgcagaccctggcccaccccacctgggcgctcagtgcccaagagatgtccacacctaggatgtcccgcggtgggtggggggcccgagagacgggcaggccgggggcaggcctggccatgcggggccgaaccgggcactgcccagcgtggggcgcgggggccacgcgcgcgcccccagcccccgggcccagcaccccaaggcggccaacgccaaaactctccctcctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccgcggcggcgccctataaaacccagcggcgcgacgcgccaccaccgccgagaccgcgtccgccccgcgagcacagagcctcgcctttgccgatccgccgcccgtccacacccgccgccaggtaagcccggccagccgaccggggcaggcggctcacggcccggccgcaggcggccgcggccccttcgcccgtgcagagccgccgtctgggccgcagcggggggcgcatggggggggaaccggaccgccgtggggggcgcgggagaagcccctgggcctccggagatgggggacaccccacgccagttcggaggcgcgaggccgcgctcgggaggcgcgctccgggggtgccgctctcggggcgggggcaaccggcggggtctttgtctgagccgggctcttgccaatggggatcgcagggtgggcgcggcggagcccccgccaggcccggtgggggctggggcgccattgcgcgtgcgcgctggtcctttgggcgctaactgcgtgcgcgctgggaattggcgctaattgcgcgtgcgcgctgggactcaaggcgctaattgcgcgtgcgttctggggcccggggtgccgcggcctgggctggggcgaaggcgggctcggccggaaggggtggggtcgccgcggctcccgggcgcttgcgcgcacttcctgcccgagccgctggccgcccgagggtgtggccgctgcgtgcgcgcgcgccgacccggcgctgtttgaaccgggcggaggcggggctggcgcccggttgggagggggttggggcctggcttcctgccgcgcgccgcggggacgcctccgaccagtgtttgccttttatggtaataacgcggccggcccggcttcctttgtccccaatctgggcgcgcgccggcgccccctggcggcctaaggactcggcgcgccggaagtggccagggcgggggcgacctcggctcacagcgcgcccggctattctcgcagctcaccatggatgatgatatcgccgcgctcgtcgtcgacaacggctccggcatgtgcaaggccggcttcgcgggcgacgatgccccccgggccgtcttcccctccatcgtggggcgccccaggcaccaggtaggggagctggctgggtggggcagccccgggagcgggcgggaggcaagggcgctttctctgcacaggagcctcccggtttccggggtgggggctgcgcccgtgctcagggcttcttgtcctttccttcccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggtgagtggcccgctacctcttctggtggccgcctccctccttcctggcctcccggagctgcgccctttctcactggttctctcttctgccgttttccgtaggactctcttctctgacctgagtctcctttggaactctgcaggttctatttgctttttcccagatgagctctttttctggtgtttgtctctctgactaggtgtctaagacagtgttgtgggtgtaggtactaacactggctcgtgtgacaaggccatgaggctggtgtaaagcggccttggagtgtgtattaagtaggcgcacagtaggtctgaacagactccccatcccaagaccccagcacacttagccgtgttctttgcactttctgcatgtcccccgtctggcctggctgtccccagtggcttccccagtgtgacatggtgtatctctgccttacagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggtgagtggagactgtctcccggctctgcctgacatgagggttacccctcggggctgtgctgtggaagctaagtcctgccctcatttccctctcaggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaaggtgggtgtctttcctgcctgagctgacctgggcaggtcggctgtggggtcctgtggtgtgtggggagctgtcacatccagggtcctcactgcctgtccccttccctcctcagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggtctctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagacggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgtttaccccaaacaccacctggtgcatagcagttgttctggaaatgatccggtccccccaggaggcctggactctcaactgtgcacagtggcctactggcagagaggaaggtggtacccttcctcctgtgttatcttggaggtcccctgaagggctctctggggtggttctagctcttttggtctgatttctgcagtggtgagccctgggccaccttgggccacttaatcattcaacccccattcattgagtgaccactctacggtgggggaggctactgagatgacctggacaaggaccctgccctggaggagctgtcagtctggaagtgaggatttaattcatttgcccattcattcattcattcattcattcattgaggacttaattcatttgctcattcattcattcatttgctcattcatccattcattcatccatccatccatccatccaatcactatttgtgccagatagtgcgggtatagaggagaaccaaccagatgtgttccgtgtcctcaccaggcacccagtttaatggggaagacatcacaagcacgaaggcaaacaaatgagtgtacagtgacatgctgtgatcataggaagagagagcagagactttgatgaacacgagcatcgggtgatgttcattatgtcgattgtggtggtggtcttgcaggtgtagacatacttcaaaccttatctaattgggcctgctgtggtgacgcatgcttgtaatcccagcattttgggaagctgaggtgggaggatcacttgagcccaggagctcaaggctgcagtgagctatgattgcaccactgcactccagcctgggtgacagaacaagaccctgactcttaaaaattaaaataggccaggcaggcgtggtggctcgcgcc

SEQ ID NO: 17185 - DNA, 8888 bp, Human
ttgtacccgttgaccaacctctccccatcctcctttccccacttactcccccagtctctggtaaaccactgttatattctctgcttctatatcaactttattattatcattattattttttagattccacatatcagtgagatcatgcagtatttgtttttccgcatctgatttatttcacttaacatggtgtccttcaggttcattcacgttattgcaaatgacaggattacatttcttttatggctgaatagtgttccattgtgtatatataccacattttctttatccattcatccatccatctgtggatacttaggttgatttcatatatgttttgatatacgcatgcattgtggaatggctaaattgagtgaattaacatatatgcattacctcacatacttgaaatttttttttgtaatgagaacatttacaatctatgctctttgtgatttttaagcatacgatatattgttcttaactatcatcaccatgatggacaatagagctcttcaacttattcctcttctttaactgaaatgttgtatcctttgggtaacatctccccatctcgctgccccttgcccacccagcccctggcaaccaccattctactctttccttctatgagttcaagtgttttagattccacatgcaagtgtgatcatgtggtgttttttactctcactaatcttcatttttgcttctttctcctctggccaccttcacaaatgctcagtgtcctcatgtggttccgaccctttgcagtggcaccttgcttaggtctgtgccatctcaaaaagtggtctaggttttacaattatttacatccctacttccagttcttcaacactcctgatcttaactagttgtgaggagaaaaatctgattatacaaatttgcactaattcacattccttccctcagcaataggtatttgcattttgatacttgcatttgcttccttgctctgcgggagaatttccagtctagttttaggtgtatttttaaataatttgaaggtaacgcggaacctctatattcctatattcccttcttcagacatccgtgtgtgtgtgtatatatgtatatatataaaatgttgcatatatatgtatatatatagtatacacacatatataatatatatacacacacatatatagttgttataggattatttggaaatattatgttgagacttgtgagaagtgtagaattaggtaaaattttaagatgaactatatccatggtattcttttattttaaaaaaagtttacatgttaagaaaaaaggagatcagattttcagcattagtatttacaaacttaagttgatattgattataattcaattaatacaattttaagatatatttacttctgccttaattgttatgatcacttaaaaatagttccaaaaagggaagaaaacaataattagattagccaagacagttatttttgaaacataagtctggtttagaattcagcatgtttaaaaatgagataaaattattttaataatggaatgatctgttagctgtcattaccatttactttaaagcagaggatataggacatgggtcctttttttctgatcacctccaatgagataagaatctataaagctggtaggaaaatgagtccgtgaccaaaatgcttactcagtcactataggagatcaaaacattttatactaaatctgaactctactaagacaaaacaattgtgttctttgaaaaatatgtagggtttagaaaatttctgggatttgtctgtaaaataccctccgggctctaatagtgacgttttagggaaacacttgcatctcaaggtggaaaggatagaggtggtgttttgtgggctcctgtggtggttaggtcgttctcagaagacagtactggaaattagataattgctgatgtcatatttttcacaattaaaaaaaagtcagtatcctgggggctataaaagcagcagcttctaccttccccgtcacaagcagaatcttcagaacaggtaagcgtttcggcaaacttggtacaattggttagtttgatgaaatacttcttgactaattttgttccttcacgttgtcttcgaccaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggtatacatctcaatcctgctctttctcgttggatctacttggaatccaaatagttcttaaacttttcttcagagcatctctaagagctttaggaacccactgtttatccctgagggtagataaattttctgttttttcagagactctttgggaatctggcttttttttttttcttgaacttcttccttccattttggcctttatgatacatatgatgaatttttcccaaagagcggccattcagtaatccatctgatgattttttttttcctttatgcctctgtgcattgttctaaactcatgcacacatctgaattctgcttttagtctttatgatgttgctctggggagacgggatggggcacatgtctatgtataaattttttttctatttgctcaatgtccagacccttagtcttttcttctcttccaggctagcttggctgataacaacacagacgttcgtctcattggggagaaactgttccacggagtcagtgtaagctacagttgtgacgaacggggccgtgtgccgtccatgggtacttggggtggtggtgatgatggtttaggtcttatcccttatgaccctttctgtttcccttccacctgcagatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtgtaagttcagctctcagcctatgcccacctacccctccttccctccttccacagagacccccttaccccaactctctctccttccccctacccctaagctagcaggaagaagtgtcttggcagcagtgttatcaggagtcatttgggatcatagagtatttgcttttgctttgactgagtcacatcttgagtttatagtggtgaatggggtctggaacttaagtgtacagaagccgcattggtttgtcttcggaaaaaaggcaactcaggttgcgtaagatgagaaaggtgttgggaaaaacatctagatgtggaaatggatccattgagtctaagttgttgaggggaggggatggcatggagagaaattagaagagaaagtgggaaatgggaaggcttaaagtcggtggtgggtcggcagactgttgccctgttgatgtcatgggaagccacaaaatcggaggcgtgtgaacttgatgccgctgaacatttgaaactatgaaaaaaagtttgagtggagtgggcccagtaaaaggccctaggacttactgaagagggcttaattttcacatgagatgttttatgtacatttcttgttctaagcatgcaattttctggagatacgattgaggttttattccttacagaatttgcataaactactccgctctttccacaaatgcaaacctcagtaggatttcccaaagatgaagagaggtctcttgtaagggaagtgactggattctggcgtccaagggaattcaagagctcaggaaatctaggtcactgttgaaatctaggtcattgtgggcaaaattactaagagctttaattccaggtgaattgtactgtacctccatgggtgtggaggttcataaagtttcagcacaacattaagatagttatgcttgttattgttttatagcatattgaaggtgatgacctgcatatccagaggaatgtgcaaaagctgaaggacacagtgaaaaaggtaggactgataactgtcaatgctaagtcatgcaataggagagacaaatgttgtttttctttcctttctttcttcccatcactttgtgatttttcacttgattctcctaccaccagggcgattactttggtgtctgtgtatgtagatatatctatatatctagatgtcagtttccaaatcttgcaaattgtagaattctagaactggttgggatcttagcttgtctagtcacataacctcagattctggggatggtcagtggcagagatagggctagaatgcaggtctcctgaatcccaagccagcacttttcccggtggtgatacagattagttttggtaccattaattcttagggaaatttcagattcctattgactcatgtaatctgaagaagtacttgtttaaaaacagaaaaatgcctatgggcaaatttatttgaagtcatttttgaagtcattaatgcattgctttgaaacttggaagaataaactcagaacaatgagaaaagagctggacttgcatatagggctaatttctggagtaataaacacttattttgaattatcataatatctatcagatattgattatagtttaaaagcaagagcagacaaccccgatctcttttatacaggttcaaatagagtaaaaatattagtaagagatttattaaagttaaatggaagtctgaattggtaagcttttttttcttcctctctcccatcaagaccttccattctagtttcttccttcactccctcaacaaatccctagggagcatttatccatggtgggctggtgtacatttctatagtgaatgataccatcatgtggcctatttggtgaaaagaacaacaatggaaggcttagactaacaatagtgactcaccccaaaaccggaggaatgattaggagcagtgaaagtgacgctcttgcaagcaggtacaactaaatactcagaaacatgaaggctccagttgatggaattttcagtaacaagcttaaccttaattccccctttttccctcttgactttttaaaaaagcgtttcttcctgagcatcatttaatgagtgtgactgtttcttcctttgataattgaaggctttgtagttttaaattgtgaagcccagttctcttgttatagaactattatctagacatggagggctgaatgttagcatgccacagacaaggcatgctttacacatcttgcttaaaaaattactgatttcatcttgcttgttgtctttagaaaagtgaagtgtgagagaggagaatctcatggtgatctgtgtgattttcaagacctttaatccattttgaaagaatcaatttcatatttgcaatgggttgccatgtggaagagtgattatgcttttttgctggtagcttcagaaagcacaggagggagagcaatgttgttcagagaaagatcaacaggaggagaaactgtcagagctgtctgaaatagggtggttttgggaggcattaattccctctcgttgggggtaaaagcagaacgcaggttggtagtaaaatgcatgacagacagtaggggacgataaactttaaaattctttatagtcttggagtctttgagatagaaaagaatatctttttggccttatgtcaaaagaagtatggaaaggtgaaagggcggaagaaagcaggaaaaggaagaaccatgtattatatagaggacaatggtgacaaggtttttcttgaaataatgcaaatatgatagattagaggaatttcagtagggaatgcttttcacttgaatttgggtttcctcttcgattaagtttgggatcctcatctgcatttgacttggagagagaaagaatgaatgttaggacctatatctggttttctattaactaaagcaagtggaaaagacttatttggtatttttcccacaaaagtgaaaacttttcttttactgtttgtcaaaaaggtggaaatagaaaaagccttaatgtattggtgaatacatggttcaaagtcatttgagtagagatgttttaaatcaggagtgtccaatcatttggcttccctggaccaccttgaaagaattgtcttggtacacacataaaatacaagaacaatagctgatgagctaaaaaagtccatgcataaatctcatactgttttaagaaagtttatgaatttctgttagggtgcattcaaagctgtcctgggccatgtgcggcctgtgggctgcaggttggacaagctccttataagtaatctgtcatagatagttttggagctgcaaaacaggccaaggcataatgggtggcactcgggatcccccagatcccagcctcacttcagtctccttgctctggttaagaaggggtggtcaactctctgcccagcttttaaacagcttcattagtgtgaggtgcacctgaaattgatgcctgctggtggcctctcagtccagagagccgtcattttaagctctttggcaaatcatacaatactaaagggatattactatgaatgttttacaaatgcttaaaactcggtttctgtctccatcaacctaatcttgcaatttctaatttgttcactttagaaaacatggcataaatgctcaaatacttttgcattcttattttcacagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatcctaagtcttgtcgttttgtgatttttctcctttaatgtcatcatcatcatcatcattgtcatgttaccattcccataactttattcttgactctaagaaaatgaggtagctattagtattattctaattttacaaatgagaaagctgcattagaaacatgttaagaaacattttataactataaatagttgacccttattgagccaggtctatctgatttcaaggctctctgctatagtgcctatactgatttattatgttgactcagcatgtacctttgaaaagaaaaaagttgagaaattgaaaataacttatcattagtcatttatggataaaagaaaggaatgatgttgctggagagaagtacatgtagcctctattgctatagataaactgttttagttctagttcaggcctactgaaaggtgcactctccagtatccctgaaagtaagacactaaaggaaaaggaaagctgtgttttggggagtcatacctactagtaagtttggcactgatagggaagtctcataggtggaagatgggcaagatattatgaaacacacatagaaaggaaaaggggttcatcttcaaaatgtgtacaatgctacagagaagagagagaaagaggtagagataaaggttggatttgttctaccaagaagaatggacaaaggatgccagcaatgaagagccattcctgggggaagggatttgaaagattgtgtaggtcttttcatatgaggtcaaagtcaatgatcagaagtcagtcatgaactgctaaggtattttcttctccaaaaaatcaggaccaactttgcaggtcacttgtcagttgttggccaagttcctgcaggattaggtccagcctggtggtgagaggggagcacatagaaaaaattcccagcaagcctttgtcttttcctggcagtcagcccctcttttgctaccttgcccgttgcactcttgcaacatattttcatactttctctagtaaatctgcctttctttacccacaactgtcttggtaaattcttttaccacctgtgccaccagcctcagatagttgtcactcacccacaacattttggtggcccatatggggagctctctctccttatggggaactctctctgcatgggggctgtctctcctcatagggaactctcttgcctctctctctttcccaacttggaaccctcagtggatagcatctaagcacggagacaattgtaggtctctggccagagctacactctggtgggctgaaaggtgtccccgtggaagcatctgacttccatgcccattcaggtgaggcacctaagtttattttctcttttcagtctttcagcagccagcttctagtatctctctggcaattgatggtaactggccagggctgttctccggtgctgcctaaaggtcagagggtgaacagagttatctgcctctcccattaggcaggaaggctttttcctctcttctctggtcagaagtccctaatccctaagtgtggcatgactggtag

SEQ ID NO: 17186 - DNA, 8956 bp, Human
ggtggctcacgcctgtaatcccagcactttgggaggccaaggcgggcggatcacgaggtcaggagatcgagaccatcctgattaacacagtgaaaccccgtctgtactaaaaatagcacaaaaaaaaaaaaaaaaaaaaaattagccgggcgtggcgagtgcctgtagtcccagctactcgggaggctgaggcgggagaatggcgtgaatccgggaggcagagcttgcagtgagccgagattgcgccactgcactccagcctgggtgacagagcaagactccgtctcaaaaaaaaaaaaaaaaaagaaatgactagtcatccaatgtgccaaaataataataaacttttattagtgattactatatgccaggaaaaattcctagcactttatgaggattacctgatttaattttcaactgaagcatggaagaagatactattatcaagccagttttacaggtaaggagactgagtcatagaagatttaagaagttaactcacaatcatatagctagatagtagaggagtcaggaatcaagtttgccccataactgcaatactgttatgtacacagtacaggtagaaatgcaaagtgggtttgaaccaaagagtggagggctttttgtgccatcccaaagtgttgtacttcataaataaattacaaaggaggagaaagaatcctatttttttttgtatctgaaagacaaagaaataaaaagttaaaaagattctctgttagtactgattatttggaacaataaattgtttagagctatgctgttcaatatagtagcacctagcagtatgtgcccattaagcgtttgaaatacgactagaccaaattgagatgcaccgtaggcttaaaatatacactgtatttctttccttttttctttttttcttttttttttttgagacggaatcttactctgtcacctaggctggagtgtagtggcgcgatctcggctcactgcaacctccaccttctgggttcaagccattctcctgcctcagcctccctagtagctgagattacaggcatacaccaccatgcctggctaatttttttgtatttttagtagagatggggtttcaccatattggctaggctggtctcaaactcctgaccttgtgatccacccgcctcaacctcccaaagtgctgggattacaggtgtgagccactgcgtctggaactccccctgggaatattctctacactgtatttcaaggatttaatatgacaaaaagaatgtcaaataccttattaacaatgtagtatattgatgcatactgaagtactatttgggatatattggtttaaatacaatatattttaaaattatatttaccttttaaaaaaacttttattaatgaggctactagatcatttaaatttacctgtgtggcttgtattgtatttctactgggcagtgctgatctagagcaatttgaaacttgtggtagatattttactaaccaactctgatgaaggacttcctcaccaaattgttcttttaaccgcattctttccttgctttctggtcatttgcaagaaaaattttaaaaggctgcccctttgtaaaggtttgagaggccctagaatttcgtttttcacttgttcccaaccacaagcaaatgatcaatgtgctttgtgaatgaagagtcaacattttaccagggcgaagtggggaggtacaaaaaaatttccagtccttgaatggtgtgaagtaaaagtgccttcaaagaatcccaccagaatggcacaggtgggcataatgggtctgtctcatcgtcaaaggacccaaggagtctaaaggaaactctaactacaacacccaaatgccacaaaaccttagttattaatacaaactatcatccctgcctatctgtcaccatctcatcttaaaaaacttgtgaaaatacgtaatcctcaggagacttcaattaggtataaataccagcagccagaggaggtgcagcacattgttctgatcatctgaagatcagctattagaagagaaagatcagttaagtcctttggacctgatcagcttgatacaagaactactgatttcaacttctttggcttaattctctcggaaacgatgaaatatacaagttatatcttggcttttcagctctgcatcgttttgggttctcttggctgttactgccaggacccatatgtaaaagaagcagaaaaccttaagaaatattttgtaagtatgactttttaatagtacttgtttgtggttgaaaatgactgaatatcgacttgctgtagcatctctgataggctgtcatctcttgtaggcagtcattttgagatttggtgttattttgttaattattgactagatgagttccttgactaaataatctagatattgttttaaccttctgctcagtttgtatagagacttaaaagggatttatgaattttccaaaagatgggcataatatgggtatgaagcataatgatgttaataattttgtggtgggaactcattcagttgtgatagtcaaggagtatgcagattgaaaaaaatgattggttattagtttttgacttctcagactctaaggtcaagattagcattaaaaaggtaataggaaatgtttacaaattaaagtcaaaaaggtccttaaagctttggcttaaaaaaataactgataggtgattttctccaaaaagtgatttcaacattctgcttctctatctatattacttgtgaagtattccggaacttcgttgctcactgggattttggaagaattatgattctggctaaggaatgtttaaaaattttaagtgaattttttgagtttcttttaaaattttattgatggttaatgaaaagtttttacattttaaatatttcattatttgtttaaaacttagctgttataattatagctgtcataataatattcagacattcacaattgattttattcttacaacacaaaatcaaatctcacacacacacacacacacacacacactcgcacatgtttggaactatcttttaaagctcgtataataataccctacaggaaggcacagtagatgtaatagaaacctgtaccattggggggcagtattttatagtggggtggctttgctgttttttgtttttgtattttttagcctagcttgaaaatactttctttagcttactatagtttttgggacctttggagtatcagctttgttgagctcatttgtgacattgcaatttaatggttatattgggaaataaaaaagctaaaagaacataatagtctttgtctatatctcacataagccttttgggaatacttattgttagaactaagcagaagagttgaaaaggaaatcagtgaatattgtcacatctgagttcaatgaaacttgaaatatatttttaaggcaatttatgggctaattgtaaaccaattttttcttttttttttttagaatgcaggtcattcagatgtagcggataatggaactcttttcttaggcattttgaagaattggaaagaggtaagctgaatattcccatttggctaattttcctgttgcttgctttctgatggataaattcacatcatcctctgtttgtgctctttccttccaaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtgaggctatttaaattctttctttggtttcattgccgagggtcttgcaaagcatttattctccagaaagtagacattagctatttaacagttgctaaagctatgaactcaactcatggctgaaactctaccttactatttccattcgtgtttgggtgactttgcaaagccagtaagagaatcgctgaagtatgtaatgtagagaaatgctggcattgtaactattgcgtaaagacaggtgagttgacaaatccagtgaagaggaagtaggtgaggaagaagcagggagtactgagaagcagttctctcattgtcccttgctcatatgatggaaattctcttactttgaatgagaggctgtctgtcttaatggaaagagcagtgggaggagctgagaagatgtgtgttctcctcccaactcagccaccaaggaactgtgatgaatcacatggctggctggggctcagtttcctcatcttaaaaggaaactgttaggttcactgtataagtttgatgaccttctttgctccaaaactctacaatgcaaagaatagaaaatgagaatgagatagaagaaagctacagtctttgaataggtaccagggacaccccactgcaagtctctagccaacctatcagattgtactgcccaattagaagcaagaatggttgctgtttgtttgtttttagggaaaaatagatagaatttataccttatgaaaagattgttctatcaactctctatcaactttcagaatatctcagctggagaactccttagactcctaagtcttacctcatgaacttgtatctttaagttatggcttctataaacagaaagataacgttgaggcataaagacaaatcatgtttttcaaaatgttttctagaagacaaaggcctctagattcctttggggttgactttgatataaatgggctcaaatgagagggaccagggtcttcaagctagcatttgtgttcttaggatatgtgctcagctttcactattgctgggcctgcctctcactcctctcatgtaagcccccagaaacagaaaggagagacatggcaacaggtctcctttggttataaactagacactcagcacttgtttctaatccagtggtgcccctggcttactgttcagtcctggataagtctcttagtttcttggtgatgatttgaacattggaaagtaaaatctgtcacttgcaaacacacagcttgtcgaaaattttttctactctgcaggaactgggccttaaaaaaatgaaaaaaaatctgtggtttcttccttctggaagctacaaacctcctgtttcttgatgggcaatcttgagtgagctctattaattattattctctttggctcagttgctaagctattttatgcatgttatgccctttgacaattagtctttagctgtaatcccccagccatcctcagaaatgtggtgaggtagccatagtgttcccaagattagaaaaaatgtaatggcagagccaagaggaaggtaaatggtccacatcttatgaagcatcatctaaatggccctattggttagagtgaggagatgcaagtagttcaatttgcttgcctagaaggcagggtactggaaaagttgttgcaattcttaattttaaactttatatatcagtaagccatatataaatatgattgggggtgtttattttaaaatctattatggaaattgagagactgacctaatctgggagaaattaaaaattacagttttcactcgttttggatttggtgttttctagggtacctaacctagatcagtggttctcaaacttaggtggatgtcagaatcacctggggagcttagtgaatgcacagggcacagtccttccacttcatgcacctggatctctgaggtctttgacaggtttccggattaatctgctatgcacaacagtgagaatcattgacctatagttactcatttgatgcatacaggaaagactgaagtataaagtgatataattggtagattgatgatagagaggtcatagaaacagtctcatcctcctttagatgagaaaatagaagttcagagaggttaagtagctggctcaaggtcagaattattgcatgcatgagattcaaacccacctttttatgctgactccacaaccaggagtcttttcactatataatttcaagaattctatagaagtagatttaaagatatgtgatggactccaccacattatagcacaactagaaatgtaattgtaatttttagcttcaactgctgaagaagtaaatattgtatattaaggtaatacggtccattttttaaaggaatacttttattttcactgaccatcatgacattagcagaatatcctgatggcttatatgcctgaaattaattttgctcttttctttcccgataggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaatggttgtcctgcctgcaatatttgaattttaaatctaaatctatttattaatatttaacattatttatatggggaatatatttttagactcatcaatcaaataagtatttataatagcaacttttgtgtaatgaaaatgaatatctattaatatatgtattatttataattcctatatcctgtgactgtctcacttaatcctttgttttctgactaattaggcaaggctatgtgattacaaggctttatctcaggggccaactaggcagccaacctaagcaagatcccatgggttgtgtgtttatttcacttgatgatacaatgaacacttataagtgaagtgatactatccagttactgccggtttgaaaatatgcctgcaatctgagccagtgctttaatggcatgtcagacagaacttgaatgtgtcaggtgaccctgatgaaaacatagcatctcaggagatttcatgcctggtgcttccaaatattgttgacaactgtgactgtacccaaatggaaagtaactcatttgttaaaattatcaatatctaatatatatgaataaagtgtaagttcacaactacttatgctgtgttggactttttctaagtgagacctggagtgaaagaactacctattaatgaattagtagggaggggagtcttcttagctgtggaaattttagagttgcatttggttccattaaatgtggtatttctttccactagcattttgttggctttcgcttttccagttagcagctctttgaattatctttctaagatacagatttaattatgtcactattcaattcagaggttctgctatggaatgtagtttaaactgcttagcttggcacacagagatttatttctagccccttctccaccttcctatttcctccttcgtttcagaatcttcctctccctcatccaatgctggcaaacaccagtgggggtggagtagtgggtgtaagctctagggagaaggcttggattggaatccaagttattccattacaagtagtgtgacctttaatacattatgtatattgtctaagtttcagctttattgtctgaaaaagaaaaataattgtgtgttcctcataatattgtggtacgaattgattctttcactcaagaaatatttactggagtacctactacatgcctggtgctgttgtagaccttgagataccttactcaagcaaaacagccaaggatccctgcccctggggaatttgaaattaagcaagggacagataaacaatgaacaaaatacataatatgtaagtctattgcatggcattctctaaggtgattggtgtcatggaaaaatagttaaaggagagcaggacagggaaattaggagtcctatgtatggtggagtgggagggctagaggtttaaaagggtaattatatgtggccttattgaggagatgccatttgaggaagcgctttaagaagtaagagaggtagctatttgaattccaggcaaaaggtatatccttgcaaaggctctgaagagattttcctggagtggtagaagaaccagcagaccagtgtgctgggcccagaagacggaagagaaaatcagccacacttgagaggaattcaggggaagcaatgtccttaggggagggccagtttatcttttgagaaggaggaagttgaggatatgatggatttggttagttctgggctgtaaattccagaagacccagtgagacaaagtaagagaggttgtcataaaagggaacgtgcatagggatgtgttgtgagtctgagacttcttatgattaccgacataaacaagataatggatatagtgagattagttctaccagctgtggaacgtgtagtggtggcaagatcatgaatgtcaaggatagagagggttagacatctggggcttccttctcaacaatttcacataaccctccaacagcaacagtaggattatgtgaaatagatcacacaaaggatcatttgagtcattgacaataatcaggggtcattattttgattattgggtaactaagtgacagtgggtgagatctgatgctaaaacttttgaatctttgatgaagcaagattggaagtaaatttggttaattttggcacaactacagctaatatgatctgctactggtgtctccactcttgtttgaattaagattcattgatgcagactttgatgtataaacacatgaagggctactgtgaagctgtcttgcctggaccacagttctagaccatacttctggggaagggattggaaattcccaccatcgatcatcttgagcagtgattaatcataccatgtgtaatgaagccccaggagataaattttaatctagggctggataaaacattccctctctctgaggttggtctcagtttggccagactgtgagacatgaagagatataaactgtattaggtgctgtgattatagcagggaatgagacagggagaagatcctttaagagaacttgagttgagactggcctatgcagtggttgtcaattattctctatgttgtatgtttcttctcttatgaacacacctagtttcagaagt

SEQ ID NO: 17187 - DNA, 10106 bp, Human
  misc_feature (1)...(10106): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccccccccccgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacaggtaagggcggcggggaggcggcgaggcagcgaggaaggaaggggagaggaagaggaggaggggacgacctggtgatggatggatggatggatggatggatggatggatggatgggtggatgggtggatagataaatggatggagagatgggggcgcgctgggaattttgcggggggcgagttgcttttcccacccactcctcccgccctcctcgatcgagaaggctaggttggcgacgccacggtagaggcttcggttctcccgggtgggggcagccgccgaccggagggaggtaggtgcgagcggctctggggttctccctcaccacgcagggggcccgatcgccgggctacgcgcaaggcgtggtgctgtcgccctcttcccgggaggagcccggcgtctttttcacccgcgctctccccccttactccctcagcctcccacccgggatggagccatgtgcggcgtggagtccccgcggtgggagaggtactgcgacgctgcctttccggggcgttcagcaaagccgtgggggtgtggggacggcggggagaaggagggggttcacccgcggggcgagggcctgccacggggaacgatcccggggccggggagctggggaagggcggcctctcccgccatggagacaccggccggttttccgccgctctccaccctccctagctggggctaggattttcccctccagcaagagcctaaagctccttcatgcccgaggaggctggggccggggtaggtgaagggagagctccctttgagggcgacacccttctacgctccgaggacaaagcgtcggagcgctctgggtcggcgacccgggagcagcgcgcgtggggggcatcgccggggagggaaaggcgcggcgtcctggagcggacagggccaagggaagaggccgagttgtgtgcggtggagagcgagagcccagcgcgctccgggtctgaaactacctgtagctgcagctacctgcccgccccacctcgggaagaacaacaatgcttctcgcgcgcgcgcgcgtgtgtgtgtggtacgtgagtgtgtgcgcggcttgtgcgctgtgtgtgcagcagccactccacaccccgatccgtagtattttgctatatccaggttgcgcccgggagcgcggcaccgcccgctttgcgcggggctcagcgttcctcttaccccatgcgctacgcactccacccggccgcaccctccgcacctgggcaaggacctgggcgccgcggcccggagccggatcggcttcactcacccctcccctctctcccccgctctccgcagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgccctctgccctcccactccttccccttctcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtatgtatgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacgtgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaaggagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatcagccggcctataaatctccttattttatttcttgtttttatagcataaagctttagtttggcctgttttttgtcttggtttgtttttggctggtggtttgtttgataggttgttatgcctaattttgctgttcttcctctgaaaactctcaaagtggaaatgtggaacttggtgttattcgaagtaggtcagaattttgtgcaaggttctggtgtttcaaatagttttgagtgtttactgtggtaccaggagaatagaattcccctccacccttctgtaagcctcacactgccagagggattaggcgaacaggttaggtaaattcatgggagtcagggctggtgactgggaatcttctagaaccttctttccagcttccaatgggtatttgggggtagaagggaggagatctcccggtttatgaacaatttctctagagacagtcttagggaatgccagaacaggaccctggagggcctgtcagccacactgagtagttctcttgccaaagcttttgaagcctgaaaaacaggtggagacttgaccgaggttcttcagggttggcaagatgaccagagagattggcagctcttctgtggtcagataactggaaaaaaatcaggttttaaacttctataattttaatcccgcttggatgggattcctctaggcctcactatttggagctgcctggtaaaggtgaacctcgctgaaaaccagctcctatgaatgacccagggatccaatgccttgaaaggaagaaaggacatttgggatttggagaacacacagggaatatttgcatagcctcaaactgccataccttatgatttctacctcccataaaagcaatgcttctcctatcctccaagctgtcttccctagaacattcctcctccttaacttaatttgccagccctagagctgtctccatttctcttgaggaaaatgtaacctccacttctttcctgtgtctgcatctgcattttgcacccctcaccttgttccccatagtccttggaaggctttatcccttgaggcttgttgtagagctgtctttgcacaagtcagtctttgctctctccccttcttcccgcctgccctctaaaaaaaactcacctgggttcctctgcagtgcatttcacatatgatctgcttcacccaggtttaggggcttggtgtataatgctgcgctataccccaccagattgtataaatggcccaccagcttgtgactggaatctgtatctcagaccctgaggtgccgaccaggtcagccacaaagcaacagaaatgtcgtgtccctgctcagaaactgctcttcggcatccccaaggcagccccatcacagagaaaaatatgggtggtatttctggttggctatagttaccaagaagttgaggccagacctgggcgtaggaggtaggctgtggccctagaaaagaatgtttttgaagtgagagatgaagaaggagaatgcagtatggaatcttaaattttcccacccacacaattttaggtcaccggctgccatcttgaattcccttctcttacctcatgaaacttctaaaatttcagactgtggcttcaatagcctcatagaagtgtccttcctttttaacaaagggaatccaagatggcggaaaggtcctaacattgagcatataatccatctctttgctaaactagatgtttccttccagatttctatgtatttctcaagtgagtagtatgggaggaagatactgtccctgactgtcttcatagtcagcatccagccccacctgcaccttctccaatcaaaccaggccttcggtgttacactttcatcaacagtgtactatgctgcatgattaacaaactcactatccattggtggatattactcaacccaacctggttcaaccactgggttacttggcaatatggcagtccgccaggctggcaccaaccctgtgtgatgtaatcactgattcacactttgtagctagataagactgtcccagatagcatcacaccagctacccaacccacctgggttttgtaaatatggggagaggagactcaaccctgaaactcagggatgaagtagggagaaggtggagggaaggcctagatggggctatcatgggagggaatcagtagaggctttgcaatgaacaggccctgtgccctagggcaaaatcaggcatcaaagtagggaaggggtagaggcatagctccttccaagaacccctggggtgtttggggatgaatgaaaggatgcccccctcccccccccgcgcgcgcgcgcgcgcacacacacacacacacacacacacacacacacacaccacttgggagtagtgtactgaaagtgatgactctttgcaaaattgtacttggtgaactggagttgagtataaatgagctacttagagagaacatggggcaaggcatggcatacgtttttgtgtggtgtgtggtggaactggtagtggcgagtgtgtaagtgtgtctttattcacaagcatgtcaaaaagaatagcaaggtggattctggtgaatgaaggtaatagctcgtggccagttgtcattgatctccttttgctaatccataatttgcttgtcataaatgagggggttgtgagc

SEQ ID NO: 17188 - DNA, 31797 bp, Human
gggcttcattctcaggcagccagcaagacagaggcatgcttctgggcagcacagccagacctaactggggcctatcgagggcctgcactctcccccttggcttctccctccagctggattttcttgcttttcttcaaacatgccagataggctcctgccctagcctctgcacttgcgttccctctgcctacagtgcttttgcatacatgtccacttggctctgcctccttcaggtcctcacccaaatattacctcccgagagaggcctgccctgaccacaccttttaagattaaccacctcccaactccccatttctttttctggcttaatttttctccctggcatgtaacttcatccaatatagcacacattcccttggcctcactgagtgtccgggccccacttgcctagaaggtgtgctccaggaaggcagagatgtttaagattgttcaccctcattcccccagggcctggcacaggtgtttcacaattatctgcagaaggaaggaaagacagacaagggacagacaacagccagaggaagaagtgcagtaagacaggatctttccagagatggcaccacgcccatcaacccacaggctttgctcaccatgcagaactggcacatgcccactctcaaccacccactggcaaaaagagatttcctttagccccacaatggcactggggtccacgtttggtgcaggggtagacccctgaacaaaatgcaggatggagaaatggatgttgggagtgcctagcagtaccagttctcctctctcagccctggttctccaggactttttctcttgcctacggtttaaaaacaatggctatcttagcccttcactgccacctgtctaaaaagagttgccgccgggtaccgtggctcacgcctgtaatcccagcactttgggaggcccaggcgggcggctcacgaggtcaggagtttgagaccagcctgaccaacatggtgaaaccccgtctttactaaaaatacaaaaattagccgggcatggtggctgtagtcccagctactcgggaggctgaggtagaattgcttgaacctgggaggcggaggttgcagtgagccaagatcgtgccactgcactccagcctgggagacagagcaagacatggtctcaaaaaaaaaaaaaaaaaaaagagttgccaacacttgctgcctccattccctgaagccccatccatgcctcaccccgctggaatccgacttccatccccggcctttaaatctgcctcgcacagtggttatcaatgtatcaatgacctacttgcttctgagacaaatgggactctcaggccttatcttaccctgccttgctgcccactcctccctcctcggcgcctcttctgggcaggaccggcaggtgttcaggcccgtccccagcccctggctccggcgtcccgggctccctgccggcatccaccttcacctcctccccagccccagccctctggcgacttctcccacctccacagtggctgtgccacgaggagccccatcaatgcccgctgcggcctgcccctttctccgccgtcccctttcacctgctgggaaatcacagccctaatgcttggagaatccaagcagtttccctctaaaaccccagggttgcgaaaccgcaggggaaacgccaagtccctgagctgggctagggacgcggtacgaggtagcacgggcgggccgcgattcctcggggaggcgtccccattgtccccccaaccccgaccctctcccgccgcggcctgggccagaagcacccggccctgcgctgcggaggcgatgccgcatcctagcactaagcccgggcagcggggaggggcagagagaacccaggggctgcgggaaacgtggaaaaggagtggccccatggggacccgggctcgctacagaccttcgccctgggggcggaggggaggggcccaccacggccttatttccgcgagcgccggcactgcccgctccgagcccgtgtctgtcgggtgccgagccaactttcctgcgtccatgcagccccgccggcaacggctgcctgctccctggtccgggcccaggggcccgcgccccaccgccccgctgctcgcgctgctgctgttgctcgccccggtggcggcgcccgcggggtccggggaccccgacgaccctgggcagcctcaggatgctggggtcccgcgcaggctcctgcagcaggcggcgcgcgcggcgcttcacttcttcaacttccggtccggctcgcccagcgcgctacgagtgctggccgaggtgcaggagggccgcgcgtgggtgagtgcggagcgacgcgccggggcacgcgcctgcctgtccgcgcacggcgctgggaggtgacacctgggtacgcgcgcctgccggcccaacggatggtccgccagggaaggtgcagtgcgcacgacgcccggggagatcccagctgggcctggcgcccctgaagtatcccagggcgtggaaggggccccttcggtgcacagcgtctgcagaaatctggctcgttccttccagcatttatgaggtcataggtttttcacagggcagcgctcttgactgctcccacacctgggaaagagatgctttgggaaattgaggaacaggctgaaagggcaacatttaattttgtccggaggtacccagagttggttgctatgggggtgcttactgtgcctgcgccctactagtggctgcagccaaagttttgggcgggatttccaaaatctaagccagtagccataccataccgcggacgactgtctcttgttaattgcagtccaccacgctagggcttcggggtaatgtggttggaatttacacgtaggcctgggcagaaacctgctaatgctggcgtctgatttgatctaattagaagtgagtgaatccgagcccagtgttctatatgaaccgaatgaatgagaactttgcaacccgttgtttggttgctgatttcaaggcattgactgtaggaattgtctcgtatgtgtgaagctactttgcgttcttcatcctatagattacaaaagttacagaactacactaagtctgtcccaaaagcaaagttgctccttctacaacctccagatattccacaaagcctgcagacacacggcctcaaagaatctggaattgagtatcgcatgtatttaataaataggtcgagttttaaagtgtagcagcaggattttcatttaacagtgccaaacgcctggaagcaaacaccattggaaagtccttcaagaagctcagcctcggttcttcaaaacttattcctgtacccggcacggctgtatttattgaatgattaaatcaaattgttcctagaaaaaggcaacctggccaggcacggtggctcacgcctgtaatcccagcactttgggaggccgagacaggtggatcacctgaggtcgggagttcgagaccagcctgaccaacatggagaaaccctgtctctactaaaaatacaaaattagctgggtgtggtggcgcatgcctgtaatcccagctacttgggaggctgaggcaggagaatcgcttgaacttgggaggcggaggttgcggtgagccgagattgcgccactgcactccagcctgggtaacaagagcaaaactccctctcaaaataaaataaataaaataaaataaaataataaagaaaaaggcaacctgctggggcatggtggctcacgcctgtaatctcagcactttgggaggccgaggtgggcaaatcgcttgagctcaggagttgtagaccagtctgggtaacatggcaaagtaccatctctgccaaaaataaaaaaaattaaaaattaaaaaaaaattagccgatgtggtggcgtgggcctgtggtcccagctactcaggaggctgagatgggaggattgcttgagcccaggaccccaggacctggaggttgcagtgagcagagaatgtgccactgccctccagcctaggcaacagagtgagaccctatggggaaaaaaaagagagagaaagagagagaggaaggaaggaaggaaggaaggaaggaaggaaggaaggaaggaaggaaggaaggagcaacctattcttgtcacctgtctttgtttttttttttttttttttgagacagagtcttgctctgttgcccaggctggagtgcagcgctgcgatctcggcttactgcaacctccgcctaccaggttcaagcgattctcctgcctcagcctcctgagtagctgggattacaggcacgtgccaccacgcctggctaagttttctatttctagtagagacagggtttcaccatgttgggcaggctgttctcgaactcctgacctcgtgatctggccgcctgggtctcccaaagtgctgggattacaggcatgagccaccgtgccgggccatcttgtcacctgtcttaacaatccttgctgtctgagatacaaaaaagttcagttttcctagtccaacagagcagtgagataacggaccttgagaactttctatcaaggtagaagagtagtagccaatgcccagagcctaaagaaggggcgtctaaggatttgctccctggttaccaggggcaggattccctgcagaaaaccaagctcactcagatttctaaggtacaccagttttcaatcccagagattttttttccccttccaaaccattttaaaaaggaataataggctgggcgcggtggctcacgcctgtaatctcagcactttgggaggccgaggtgggcagattacaaggtcaggagttcaagaccagcctggccaagatagtgaaaccccttctctactaaaaatacaaaaagaaattagccgggcatggtggcaggcacctgtaatcccagctactcgggaggctgagatagagaattgcttgaacccgggaggcagaggttgcagtgagccaagatggtgccactgcactccagcctgggcaacagagcgagactccgtctcaaataaataaataaataaataaaggaataataaaataacttgcattatcatgcacttagtcacccccttgaaaataaaataagatatttgacatccttcataaaataatcaaactagctctcaaaacccgagtgaataaagtaaaaattcccagcccctgcattgctccagtgaggatgcaggggctgggaattttatataagttacataaatcttaaagaggtcttaaacatcatttagtccaatggctttgggaaaggttatttaagtcttttctggctatttccctgtttggaatggaaataattcatgttctgccaacaatgtcaggtggtctaaggagtcatataagatatgagtgccaattagaaagtataaaaatgtgagttcaggggtagtctgttcatccattagctatgtattgaatgcttactctgtgccaggaactgggctagaagtgtggcctaattcatatttagcatagggtcattagggaaggcctctttgagattccctcagttttgaagcactccactgcctgagtgaagagtgtagacacacctacatggagctttcagtgtagtcataagaaattcctgcctccattataagagcagtcatagcactggggagaagtaaaacatgggccaggcgcagtggctctcgcctgtaatcccagcactttgggaggttgaggcaagcagatcacttgaggtcaggagttcaagaccagcctggccaacatggtgaaaccccatctctactaaaagtacaaaaattagccaggcatggtggtgcgtgtctataatcccagctacacaggaggctgaggcatgagaatcacttgaacccgggaggcagaggttgcagtgagcaaagatcatgccactgcactccagcctgggtgacagagcgagaatctgtctcaaaaaacaaaaaaaaaaaaaaaaaagaaagaaaaagaaaccacgattgatccctccaaactcaggtttgcactctacccaaccagtgcattgttggactgagtgctcagctgctgcacaatgtctatcatccatccagaactgaccctgaggggcgagcaggtagccaggtaaggaagagaagtgtagttcatgggtatccctcccaattctaggggtcactgcattcctttgtaagatgagaggctgagatgaagtcagggtttttcaaactaagggctcactagggttataaagccaatttagtgtgggatccggttttttttttttttaaacgaaatagtatagactacaaacgattagagtgtattgcgaaagcaagggtaagtagtgtctccaaatgtgtttcagatatatatgtatgacctaggtcataatgagaaattcagttcttgctgtgggctgcagctttaaaaagttttgaaagcctttagactaaatgatgtttaagacctcttctcgcgctgaaattctttgattctgtgagctgttggcgcgtcaagttatctttcattttaaaaatactgttgccctctggtggtgaaatgcagcaatagctgtggtagtaaattcaaggaagaactaagtgctagctggaggtgggtggagtggagtggaggaagtgttgttttgttttgttgctaattgtaggcgaaatcacagaccacgatttgtgttccctcactgcccccacctgatgcctttcttacctggccttacactacctttccataaccaatgaggcttttacttttctagtattacatggcataggctcaggacccacagttggagtggtgggagattttggatggtgctgagcgatcttatgcttcccagggtttcctggatcatccccacaatgtttgccccgctcctgactattcaaggctgtcccttacttgaagacaagtctcctcttgccactcagcaagttctgggaccactggctctgcgtggagcatttggtgagaggccggccttttactaacattttgagagactagctgaaatcttcaagtgcacacactctgtaagaaagtcaacccattctggaatccactattgtttaggaattggccacttaaacaaaacaccctctgaccaggccaagaccagtggttggaaacatactttaaacacttgatcaaagcatatggggagaggggagctatgcccatatcttaattgcttctatttaaaataaaatctgtaagtgtacatttatcatctatcttttgatatagggccaaggccatttaactggagctccttccagtctgcactggtcatttcttacattgttataaaggaatatctgagactgggtaatttataaagaaaagagctttgattggctcatggttttgcaggctccccaggaagtgtggtgctggcatccgcttctggagaggcctcaaggagcttacaatcatggcagagggcaacagggagccagcatgtcacatggcaagaacgggagcaagagagcaagtggggagctgccacaccctcaaacaaccagatctcagagcaagaattcacgtatcaccaaggggatggtgccaaaccattcatgaaggacccacctccataatccagtcacctcccaccagggccccctcatctccaaattggaaagcacatttcaacatgagatttgaagaggacaaacatccaaatcatatcacagtctttctagcaagaaaacacacccatggggaatcgtttgtggtttccatttttgtttacttatggtggaatgagctctcaaagaatatgctgaacaaccctctgcttttacttttccttgcctaatctcagcttattaacaccaattcaacagctaaatttctaaagcatttaacttgacttcatggacatgacatctttgtttgtacccgctcttcaccagtttacagaatatttacttatgtaatgaggtactaagtacatctgatatatgcaagtttgggagcaaagcagctggctttgggtaagcatcaggccaggcccatataggccactaggcaggagcccgtgctcgggggttcagtccaccgtgggtctgacagcaagcatggagccctgtccactaggccacaaggcagttaggagagcacttactctactatgaaaacctttattcctttgtgatttctcaatctataaagcacattaatacaacataatttaattactgctcttgaggtcttctctccattaatgtcaataattttgaggtgattcaggagactaggaaagcaaaacattaaattgtccattgaaacaaaaactggagaattaaaaaggctgcaatgaacatagagggagaagataagtaataaaatactcaagtgaactaagggagaagataagtaataaaatactcaagtgaactagtcttaattttcatgtaaggaaagctcctaagggcttttataggcattaggaaagaacagcagggagggggatatttgcaagataaactaggatctcttcagtgccctcacactgccctaaggatgaaacataacaattctgaaagcacagaagagacaggcaggaatctctccttccaggcaatgtttgtgctgaaatagcacagatgtgcctacggtctccaccccatcacccaccacagcagccatccggtctgcagactctgatcgcagagtctgggtctagcatggggtgagaaaggccactaggtcccggggttaaagctttgactttgacctccttggcactttgcctcaatctcctaagctaactacacccggatgagctagccagtaggaatgttttttttaccattttataataaattgtttttaaaccacaattttttttttaccagcccacgacattttccacttggctttccacatgtggagtcatagccaaggatgcatgtaatcacagagcattagtaatgtcccacatcaagaccggcagtggtgggtcatgactgttaactgccagaagtctggcttggctgcagactcatcctttaaggacctaggttgttctgctggagactgcatgtaaataatcagcccacaacgactgacattgtgaggcatggaaggttatacatacacacacactcgcccaaatccaacctgaaacttgatctcacttgctgttaagcagtgtatcgccccagagatgtatgacacttatgtgacctcggcatttatttgcctttttggatggtgcctcagttgaagaatgtttcacagagatagtcccacagtggctggagacagtagccataacaaatccactctggctgacttgctatggttgttcaggatgtccctagccagaaaaatcaaattacaaaaggaaatcttcgccgggcatgttggctcacacctgtaatcccagcactttgggaggccgaggttggaggactgcttgagcccaggagttcaagaccagcctgggcaacgtgatgagaccccatctctacaaaaaataagttagccacatgtggtggcacgtacttgtagtcccagctacttggaaggctgaggtgggaggatcacctgaccctgggaaagttgaggctgcagtgagccctgattgcaccactgccttccagactgggctaacatagtgagaccctgtctggaaaaaaaaaaaaaagaaagggagtcttgtaccatggctgtgtataggatgtatgtgatccgtggtcatcccaagggcacatgcccacacagaacatgacattaaggatcacagtaattctgtattggtattgtgtcctattgctgctataacaaatgacctcagatttagtgagttaaaacaacacaaacttactcacttatggttctggagggtagaagcctgaaatgggtctccctgggccaaaattaaggtgtctgcagggctttgttccttctggaggctctagaggagaatccatttccggcttctagagaccacctgtgctccttggctcatgactccatcctccatcaaagcaaacagcatagcatcttctgattatgacactactgtctgcttctcataggacccttgtgattacattgtgcccacaggaataatccaggataatcccatctcaagatccttaatcacattggcaaaatcctttttgccatgtaaaataacatagtcacagatgccagggattaggcagtggacatcttcgggcaagggctgtgggggggcattattcagcctaccacaccccgtgtccaggctggctgtgagctcctgcaaatatttaccattctgcccgacatatgccggtacccagaaaatgcagctcttgctcccacctcctgtcttgctgacctctgcagccttgctaacctcacatgtgaacccacctgccctctcctctctagctcagtactcgaccataggctgctttgtcaaagctcctgaacagccaattttctttccactctgcccatgtgcttgcctatcccaaacgagacggtcagcttctacagggcgcaaggtattatatcatgtctctatctccttcattgcactagcacatggcctgctagagacaaatattagatatttgttaaattaaatgaaggtagctggaagggtgctgaaatcactgaggcacctggaacagggagacaggccaggacccagcccattcccattgctcccagcaggagaaaaggagacctgaagcctcatgtcctgctctcaaccagccttttctgattatccccacctgaggccagaggggacctggagggggcagctgcctctggccacttccactcgcttcctaccccaaatcaagaacgtgggacccagggttggctgagagagaggacacacagtattctggctttcctctccattgctacttagcctgagaaagcaaagcattcgcacgcaaagagctccttgggccccactgcctgggcctgatcagaaggtaactgacttctgttccataaactgtatttgctttatctggccttgcccgagagaaggaaaatgcaataaaatgattccagggtataatataatatactgatgctgtctccatctggaacataaggatagcacagcaatttctatgcacaaatgagttgtttacttatctccaaccaagcctgactcataaaagtaaccttataaaatgacgaagtttgcttttactggaatagcctgacatttatgttttcttatcaaatgtgaatgctggaggcgacatttaggagctgagtctgttagaccagtgagtcccaagatgcgtggagggagactggaattacctgtgagctcgtccccacccacccactgccagcctgagaacaggaaattaacgttgtcacaaccggcactaacacaacaggaaggaccagcgcttagcaaccaatgacagacactgcagagagggggaaaaatgggaagtgttttctgtagagaagctttgggcagaatcatgtctttggagactcctccatggggtggtgcacagcgaggtttctccaggacaccatccctgctcttttatttgctccacgtttttgtggtgttttgagagagtttaaaggggatgttagattttttttttttttttttgagatggagtctcactctgtcgcccaggctggagtgcagtggcgcgatcttggctcactgcaagctccacctcccgggttcaggccattctcctgcctcagcctcccaagtagctgggactacaggcgcccgccaccacgcccagctaattttttgtatttttagtagagatggggtttcaccatgttagccaggatgatctcaatctcctgacctcgtgatccgcccacttcggcctcccaaagtgctgggattacaggcatgagccacagcgcccggccaggattgtttgatgttttaaatgtgctcttagaatacataaatacccattctctgtccctcatcaagttccttgggttcatttctaacacacccaatatttcaatgactttacccaatctttcaaatattggaaaatatttaaatattttaatatttcaaattgactttatgcaattttggtgattttatgcaatatttcaaaaaaagtgggtagtgcctaatgtaaagatagtgcagacacctactggaagaaaaatctttgatccattaacatgaaaacaaagctttgtggtttagtataaacagctttcactgaaaacaggacatgacattgtagaggtgctattagaatgaacagttttaacttcttggtgcatatacaaatgtcattataaaacaaagtagttatccatctaacaggaagcaaggagggaattttctttaaaaattattttagtccaaactgccttcttcgtgttccttctggatactcttttttttttttttttttttgagtttcattcttgttgcccaggctggagtgcaattatgccatctcggctcacccgcaaactccacctcctggattcaagtgattcttctgcctcagcctcccgagtagctggaattacaggtgtgcgccaccacgcccagctaatttcgtatttttagtagagatggggtttctccatgttggtcaggctggtctcgaacactcgacctcaggtgatctgccccacctcggcctcccaaagtgctgggattacaggcatgagccaccatgcccagcccaagtgttccttctcaaagaatagcacatactgtgtcaccatggagtttatcagttgcacctgcagaagcagagggtagacctgccacatgcactttctaaggtatcataacctgattcaccagaaactccagggtcctgaagtcaccacactttgaaagaacactcctccatttcatttggtcctgatgatactctcaggcatttgaagagaatagtctcggcgtcaatctcctatttagtggtcagctgtatcctagtgattgtcatctgatctacatgtcacttcctacctgcaacccttagaccttcagtggttccactcagtagctagagagttctccaagtgtggtccctggaccaacaggatcagcatcatgtggaacttgttaaaatgcaagttcccaggccccaccccagacctcctgaatcaaaagtcggtgtagatccagcatgctgggtcttagcaagccctgtaggggattacatggcacactcagatttgagactcactgctctagaatgaagtccctgtaagagaccatctctaatcagatcccccacccaccattgtaacctcaaccccaagtctaccctgacttaatctgctaactgccccaggctggtctgctcgcttccatgccctggcacacacactacctttccagagcaccctctccctctctcggcttgtctaatcctagtccttcctggagatgtccccacctgcactgggttatactttcatttataccttgtctgaaagggtctgcatccaggggctccttctaaagtcttggatcacctttacttccatctgttacgggttgaggtgtgtcttctaaaaagaaatgttatatccaaaaagttctaaccctcagtgactaagaatgtgaccttaagtgtaaacagagtctttgaagatgtaatcaagttaagatgaggtcatactggattagaatgggccctaaatccaatggctggtgtccttatataatattaaggccatgtggatatgcaaacagactcagaggaagaccaccatttaaagataaaggcggcccggagaatcccttgagcccaggagtttgaggctgcagtgagctatgattgcaccactgcactccagcctgggtgaaaagagcaagacccatctcaaaaacaaacaaacaataatagaggcacagattggagtgattcagttgtaaactaaagaatgccaagatcgacagccaccacctaaaactaggaagaggcaaggagggattctacccagagtctcagaggaagcatggccctgctgacacctttagattggccttctggcctccagaactgtatgagaataaatatctgttgttgtaagccacctagtttgtggtactttgttacgggagccctagcacactaatacatacatcatgcctggcagtctcccttccagaggaaggtttgcagtggttcttgtccacagggaccttggttacaagcagtccaagagcatcccagcgctctctctctctctctctctctctcacacacatacacacacacacacacacacacacacacacaccagcagccagcttttattcttccttttcttagagaggttgctgggctctatttttctgtgcagtcctgtgcggtatttgggaaaaacggggctctgcaggccagttttcctgcttcctgtgttgtgactttggccaattccttaagtttggtcaagtgcctccatttcttcatccttaaaatggtgataacaatcatacctactaaagggctttagtgatataataggttagtacatgggtactatgttgggtcgggtgaggcacacagtaagagtacaacacgtaatcacttttatcatgattccctccaatgatgcttcatatgtaagcactgaatgaatgcttaatattgatttgctaaggatttgaggatcatttaccaaaacataaataaataaaatctagtgtgatgagttcaggtctttgaaagcattccattgtacattctctcgaacaggtctttgaaagtggcctgtttccctccaaactgattgcaaatcaaaccaaaatcaaagtgctgatcagtcactaaagagtacatgatggtatggcatatgaggaaggggaggtggaaggtatatggggaaggggatgggactgcctcttttcactgtccagtggggccaaaaatcatctataaaataaacacacaaaaagtaagggccgggtgcagtggctcaagcctgtaatcccaacactttgggaggccaagacaggtggatcacctgaggtcaggagtttgagaccagcctggccaacatggtaaaatcccatctctgataaaaatacaaaaattagccgggtgtggtggcaaaagcctgtaatcccagctactcgggaggctgaggcaggacaatcgcttgaacccgggaggtggagggtgcagtgagctgagattgcaccattgcactccagcctgggtgacagagtgagactctgtctcaaaaaaaaaaaaaaaaaaaattagagcataaaccatgttattagtggcccatgattatgaagaatttagttccaggctgtagtacacaagtcttttatacataattttttaaaaatctacagtgaagagctactaatttattccttcaggttatacagtcatatggtcatttgcttgctttttcttattaaatagcccttttcggaaaaatattggaacaatgtgctctgcctttgactgtgtttaaagaaagggatgtcaagtttcctgatctgtttcacagatgggcagttctggcagtgtgttggggaaaggaatgaaatcactgtaatctatattacaggaatccttctttcctcaggaaagctagaattgttggtcacctttcctcgtgtcagatttggctgtttcaaaaaagtctacttacttttttcacggctttgaatttaatggattagctttacaccatgtggctgtagcaacctgctgtgtaagtcccagagggagcatccctgggcaagaccagaggtctttataaggtgagtgcctctaaagccccacctccccacagggtgcctcagggaacatccttatatgagtcagtttcttcacagacctccatcactatttctctgggatgcatgcccagagtggtatttctaggtcatagggcattcacacataagcttgatttgaccacatacgccagattgcatatgccagactgcagtcgtaaagccccaaaccccacccagcaatgggccctgtccactttcttgattgccagtctactagtggtactgtattaactcattgcttatttaatttgcatttttgtatttctgtaattactaatgagtttgagtaggccttcagagctttgttagcatacttaatacatgtagggtgcttagaacagtaccaggcaattggcccaattattgggctacttgcattattctgtacacacaagcatcttttaaatgacacaatgttaaaaatgttgttttaaggccaggcacagtggctcacacctgtaatcccagcactttgggaggccgaggcgggtggatcatgaggtcaggagatcaagaccatcctggctaacatggtgaaactccatctctactaaaaatacaaaaaattagctgggcctggtggcatgtgcctgtagtcccagctactcgggagactgaggcaggagaatttcttgaacccaggaggcggaggttgcagtgagctgagatcatgcaactgtgctccagcctgggcgacagagcaagactctgtctcaaaaaaaaaaaaaaattgtcttaatataaaatgtattctagtgatgatttctgatcttgaattacctgcttattttttactttctgataggacttggggtttggtggtttatgactgctctcacatggctggtgggagggtggcctgccgcagcctggctggggggcaacctggcatacttggtccaccatatgcttctctccatttccactgtcctcaccttggctccaagccctgctccctctccccgccccctcagccagcctcctgctctgtctacattaactctgcacaactcctcactccagcatcattctccacactccagctagagggatcttttcaaaatccctccttctggtccctggctttccatttctctcaggacaaaatcctctttgtagcctgcaggtgtggcccttgccacccagtcagcctcttaccgggtcccagctccagctccagtctttctgccctggggccccatggctgctcctcaggcccttgccagctctcctccccacaccaagaccaattccttcttcatcttcagagttcagctcaaatgtcgcttccctgatccctagactagaccaattctctagccatcctctcatagctcttaagtcagccacaatcaaataatcaatcctacaatgctctatttaaggccctctcccgctagactgcccggagagtggctgctgctgttttgctctgtctttcctgcacccagcacagtacttggaataaggtaggagctgaaatcatggagtgatgttgttgaacatcaacgacccctttatcacagaacattttaaatcaaggacagccaaagttcaacacagtcctaaaaccactggagagcaagtgcagacactgcatccagaggaaggtggcctggctcccgcccactccacacacaggcctgtggctgtgcggctcatctcaccagagcaaaacagcacggggctcttgtgactcagaggaagggagaagggagaggcctttgtgagagataaaagcactgtgtcttgatacatgataaagtacaaccaaaaatataaacattttattttggatgaaatgtggacacttttaagagtgcttgttaaccaggcgcagtgagtcacgcctataatcctagcactttgggaggccgaggcaggcggattgcctgagctgaggagttcgaaaccagcctgggcaacacggtgaaaacctgtctctactaaaatacaaaaaattagccaggtgtggcagcgtgcacctgtagtctcagctatgcagcaggctgaggcaggagaattgcttgaacccaggaggcggaggttgcagtgagccgagatcgtgccactgcactccagcctgggtgacagaacaagactctgcctccaaaaaaaaaaaaaagagtgcttccttaaaacaaaataaatcaaatcagcaaagaaaataactctttaaaaggacagactccacaccagctcagagcccttctcactttgcctccatgtgtttccagagcactgttgcgtcaaatcatatcttaagtcctgtatttaaaatatgcacaattatatcaagaataaggaagactttagtgaatctttttgcatagcatataaccatgcccgaatgtatcactggcgtgaaggctgatgttcctcaggattcttattctacacatcttccctgggggactacatcaaattctatggctttcaccactacctctgctgatcctacttctataaccctcagcattttccgagacatctcaaatttccccatgtgccagagaatgaaccctcccaactcagcttcttcctcatctcatgaatggcctccgcacccacccctgcccacctcacagctagaaacctgagggtgtcgctgactcctctgcaggaggctgtacccaggaagcccctactcaacaggacaggcagactcccaggtgctgcggtgcacatagcaggtgcggggtgcagcgacccattcaaggcttagaacccactggcaagctgaagtgtcgccttctgagtgttagttgtttgcgggtgcccatgtggctgggagtgtgagaggcagcaagccacagccctgtgttcctcccacattggcaggtactaaggatgctgaacttcaggaatctttgagataagaggtcatgggagccttgtccagccactgtcaggcatgtctcatttatatccttccactactcattgggtgtttcaggagtaaccctgatgggagaccatgttatataacatcccctatccttgaacttgggtcagtctcttgtgtttagcccagttcttctgctttctcatgcctatagattttagtaataataaaaatagtaaacagacattgaattttatgctgacccaggcactgtcctaaaccctgtttatgccttatcctactgttcacaacgccctgtgtattgtggatatgtttaatgttactcttccagactttgggatcaagttccaagtcatctcaaaaaagtgaggctttccatgcccttgcacccacctccccagacaccttttctccagcttcactgtcccctggaattccaacccctacatcccactcccacacctttgtctaacactggctcctcaaagagttagtttaggcctcacccactctagaaagcctcccgcaggctgcgatctgccacactgatcagctacactacaaaactgtttccaagatagaagcaggtttctggaaaggccgggctggacatcatatttctttatatctccccaaggcctggcatagtaggtgattaacagcgaatgagtgaatagacagacttgtgtgtgtgcgttgtgtaaaccaaaattagtgcctcagcttacaacagaactcgtttgaagactgacgatgagccctcagcaaactgctctgtgtgcagtgctctcgggaattctctctccttccccagcaacatctgtacatgtacaagcttaaatattccctacataaataaccaccaaggaatcctttccttcccttctccagtttcccagcattttttaagaatctataataggaatggatgctatctggtctatttaaaataaaataatgctgtttgtttattgaattgctacgctaagatgcaaaggaaactggtgtttccagagtccaaccttaatcaatgctatgtgaaataacttcagctctatacaacagcaagttccctttcctctctaggaaatatttcttttactgatttatcattttgctctcttaaaaaaaagatggcaaacaataagaacttcttctaaacagtttaaattgcaatgacatagatatgtatattctaaaatatgcattgaaatcaattcaacagttttaaaggctaaacattaacatttctgaagtttaaaagtatgcttgcctataaaaactgcaaacgaaagaaagagcatagcattggaagacttcttcagtgttggtgattcatcctgttgcagactgaagttccacctcacgcctgtgcttgtgggtcccctctgcctgtaccgggtgtcccccacctagatctgggatggctgcttccttcctgtcctgctggtctcatctttgagatcgcctcgtgccaagcaagcaccttcctacaccaccactgtctttcttcattcatcagcccctgaaagcataattattacttgttgtgcgtttgttgccagcatcccccattgggctatgggtggcaggagggcaagtcctcgtcagtcctgctcgctgatgtggccccaggacagggcgtggagcaggcactgaggagttggggatgaaggaattccctccagctccctgcacactcctgttcttttctcctttagctgctctcacaaagtcactccagtcagaacgcaaccatttccctttctcagtctccctctttgtgagtaggtgtcaaactagcaagcagaatggcacaatcagaacaaaatttgagatctttcttctaagccatcaccaattttattcaggtataaatgctacagccaccatttgcatgccatgttatcctaagagtgtgattcctggatatgaggatgtttaagggagcttctactatactaagattcagtttctgtgttccagattaatccaaaagagggatgtaaagttcacgtggtcttcagcacagagcgctacaacccagaggtaagctgccacaattggcaaagtatcctattagcaactgctataaatatggctttgtaaaaaagtgagaatcttaatatatagtgatctggaggtttgcttttgttttttcctgatctgtttcctatttgttatcaagaactaaagaacagaactaggcaagagctcaatatttaactacttcaacttcatggtcttaacgcagggttgcatttaaaacaatccatataagcgatcacctccctcttccttgggacccctgggagagaatttcacagctccctctggtatccctcctagctcctcagagtcctcagaatgactcactttcaaatgccaacttactctcttcctgtcagagggtgacatttctggttagcaggccagcacagcgtgagaccaaccccatgagctaacgtacacagaggcactctgtaaaacacgagcacgtgctccagccgttatcagcctcactacagctttgaccaagcggaccatgttttgccaagtttcctgttccctgttttcaagaagagagtaaagagaaaactcgtatagaaattagagccagatgaacttccttgtgctaggccaagctgaaaggcggcaatcagagcatgggcggagaggagaccagctcaaatgctctttgtcttgtgctgagaagcagcctggagcaggcagcatccaggattaaagtgttccagggtggcagagtttcgggagttgaaggcatgactcccccaaccccatgcttctggaagaatgctcaccagtactcaagttccaacaagtatccaacatgacagcagtatgctctttgcttattaacctatgaattaaaatttccttaaagtgtacgaaagatgcctttgattgttagtgttgcaaactgaaagtgttaagctagagggaatacaattactagattattttcaccaacaatatgcttccctggatttgatcctgtagatgcattaagaacagagtgagctaattgaaaccttccatttcagggggtgaagagcagttcttttatcctcaggcaacggctttgattccatggagatgttttgagggggaaatgaaaaggaaaatgaaagggggcagtacctggttctttttctcttctctggaaatgactttgacaacagaggaggccatgtactaggttccttctgccctttcataagcctcttcctgaatgcttccttcaccttttttctatgttgcaccaataattaacatcttaaagcagtactgaaattccctctcactcaaaaccagcactcacaggaggaaaaattgcctactggaaagtgtttctcagttttttgaggtagttttagaaataggcttattaagcagatccaatttttttatttttaatttttatttatttattctttttgaggcagggtcttgctctcctggctggagggaagtgcgatgatcatggctcactgcaaccttgacttcctgggctcaagcgcagagagaattttgattacaatttgtttcctcatggacttttttcatttttggtagttgttttcactgggacttcacccagtttaaacaaccacaaaagtaaaaagaagattatcacctcaactatgcaaccagccaacgagagttggatttgggcagggccaagactagtggcccatgaacttcctcaaattctaggcccagtgctgatctgtgcatttttcagggaataagttccctggcttctcttatttggttaaggaatctggggaattccttaaaagggggaagaaccactatgctagaaatgagtcatacatctgatgtctagttgaagctccagatgtttctggattataaaataagtgagggagatcccagaatatccaaaacatctacatttaaacatgaatgctgggggtggtggctcatgcctgtaatcccagcactttgggaagccaaggcaggcagatcacgaggtcaggaggtcgagaccagtctggccaacatagtgaaaccccatctctactaaaaatacacacaattagccaggcatggtggtgggcacctgtaatcccagctactcagaggctgaggcaggagaatcgcgtgaacccaggaggcagaggttgcagtaagccgagatcgtgccattgcactcccacccaggcaggactccatctcaaaaaaaaaaaaaaaaaaaaagatgaatgcaaataaacatcactcaggtagttgaatgaatcccatgtggatgatcagtggatcagtgcccccatttcttctggattagatcttggcatagagagatgaagttagtacagagagcctgggcttcggtgttagaagtgaggtcaagccctggcttattagctgtgcgacatggagtaggtacctccttaaacctcagtatcttaatctttcaaactggaatcagaggacctaattcataaggcagcatgaagatgctgttgttatttttgtaaataggagccagctccatcttttagttcaagttagtaactttgaggtccacctaagtattatgttggtccacattcaagagtaaagtggccactactctaaaggtttgagccaagcagtgctcaatggatgtcaatgatatttctttggaaatatgcccaatgtcattttataaagtcacaatcagaagacaagagtttaaatgatagcaaagagagaaggactgttgtattcagctgtgagcacaacccacaataaaccaaaacccactacatctattgatgccagagcctgcctgccttgtacaatgaactcttctcaatcttgtgtgtgcttgtgtgcactggggtgagtgggaggtgataaagtatcctgtttaactccacagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctggtatgaatcagcatttggaatttctatattcaggaatgtatgtaataactaaatccttaaaagaaagatcatttaagtttttatccctaaagtggcactttcattcaactaaatattgtggtatccctcataatttaaacaaaactcagaggtatcatctttctgttcttcatctctaatccaacacagtaactccaccaacagcatgtatccctttcatctcattttccagctgggcgcggtggctcatgcctgtaatcccagcactttgggaggccgaggtgggcagatcacgaggtcaggagatcaagaccatcctggctaacacggtgaaaccccgtctctactaaaaaatagaaaaaattagccaggcgtggtggtgggcgcctgtagtcccagctactcaggaggctggggaaggagaatggcatgaacctgggaggcggaggttgcagtgagctgagactgtgccactgcactccagcctggacaacaagaatgaaactccatctccaaaaaaaaaaaaaaaaactcctcattttccatcccagaatgaggggcacagtaagaactgaacccccaggtaagaggtacaggattttgaaataggatatgcatataggggtgctgttttcagggttgagtccaggagctgaggtgacatctctatttttggcagtggctttggaaactttaggcgacagcctccagagccactactctgctcatcacagccttacactccaaggccagatgagccctctctgggatgctgcaggggagtcatgtttatctcatttcaagtcagtggttaatgggcagtggtgctgtctccaacaaaggagccctgccctctgaagtgactcagctgaagggaagcagagctcatgcgttcctgcactcaccagaatgtgtggagagcagttgagactcagcaaatttactggcaaatccaattttcaaaaccacgaaagtcatctcttgggtattaagcttgatgtctgaccgctacagcattcatggtcccaccctctcccacagttcactcatttgcccagattctgtggcaaacccatgtcaacactggaggctctgtagtctccattcctgaatgtctctgctccccatcgatttactgagactaaatgtccttaaaaacctcgaagtggaatactgcttcttccatttctaaaattctgaaccctgaatgattctcacatgatagttctctgacaactcagatcaaatcctgtgccaagcaatcaaggggagcaattaaaatctcatgttgtagcagaatttgtttatattgagtattgcttgaaataaatgacctgatgactgatacttataaatctacacttatttaggaattgttttcctttagttgggaaaatagggcttatctgtactccttaaaacacaaattttagaaattgtattggatcttttctttgaatatttgccacagggtcacgagactttagacactctttaatagtgcaggctaactgtatgtttagttaataagtcctgtatatccatagggaccattctataataatctaacttaatgtagctactgtgaaacttcaaaaaacttctttaatagagggcaacttttcatcgaaaaacttgtaagttttgctgtcatagtaaattcagcagagacatttaatggtgctatctatagcttgtctgtgtatgtaaaattatctacttaaaaccaaaaaggtttggttttagataaggtaaattttacccagttaaaatctcaggggggccaggcgcggtggctcatgcctgcaatcccagcactttgggaggccgaggcgggcggatcacgaggtcaggagatcgagaccatcctggctaacacggtgaaaccccatctctactgaaaaatagccaggcatggtggcatgcgcctgtagtcccagctacttgggaggctgaggcaaaagaatcgcgcttgaaccagggagtcagaggttgcagtgagccaagattgcgccactgcactccagcctgggcaacagagcgaaactccgtctcaaaaaaaaaaaatctcagcagattcctattcagtatttaatggatccaaggcattggactgttgtagtacaatgggtaagtgagaagatctaatccattttggaatatccttgctccacattgttttttccccttaagttgtctgttttttatgagtgaaagtttcacttctaatgaatttacaaacttcctagcaatgaatccaagtacactacatacagagggaaagattgaagacctgggaataaccagctaaagttgtgtctgcccaagtggttctatagcactgttgccagcacttaccctttcaaatgttcttactattcatggtatttagtataactggtttatcttctagggtgatgggttttgatctcacaaatctgaactcacagcagcaccataagatagaacacgtgatgatgagctggatcaaggaagttttcagtcaatgaagacaggaatgatgggaaacctcttaaaagcaaaataagcaaaaaagtttatatccaagatattgaattcagagtcttgtattacataatgttctgaagttcttatggttcagctgctcatagcaatgaggaaaaaaaaattcattcgtgaaatgctgatattcttgtcaggaagtagaagtccgaaacatactttctacaataacatctgtaaaaatagtcacagctccctattgattacttatcatatgatgacaggaaaaaatgacattaccaggttaaagaaattacacagaaaagccagtgaagagtactggaaatcctcagttccaaatatgaaggcacttcgatattaacaggaaagcattatggaaccaaaaaacttatacatgtcacataagggtgatatgatgacaatgaagggcaacaaataccttttgctttattctcaacaggtattttcttctaaaagatttctccaagtgctgagtcttcaatgctgctatttatttctaacatcttactgcactccacatgacagctgtgttgaagcttttccattttttcaaggcccacatcccagcctcatgcactttcaggagacggtcttgcctcctgctttactgagactgagacatttgattctgtcatttcttcccacctcacaaagtcgctacatcttccccaaccctctctttaattctaagactccttttatacccttggttctagtttatctggttctttcataattttgccccatcagtatccttcccaccttgagaatctccgtcaaccagttccttctcttgtcctataaagatcgtcaagatcagagttctgttgaccagtttcttcatagacccatcaccccctctttttccttattctgtctacttttcaaaagtagattctatacacattgcctcaacctccaactcttcctatttggcttctactctatgtacataaagggaccacccagatcaccaaaaaccctaaccagatcttgcttcttatccttcttgatttatctgtagtttttttgtttgtttgtttgtttttttgagacagagtctccctctgtccagtgtgtggtggtgcaatcttggttcactgcaacgtctgtctcctgggttcaagcgattctcctgcttcagcctccagagtatctgagattacaggcgtgtgccaccacacccagctaatttttatatttttaatagagatggggtttcaccatgttgtccaggctggtcttcaactcctgacctccggtgatccaccccccttggcctcccaaagtgctgggattacaggcgtgagccaccatgcccggcctatctgcagcactttacatcatccaccttcatgactttcttgacactgtatttaatacacctaataacaaactcaacttgttttcacccaaaacgttcccactttctgtcctacatttaatggtattactattctcctagagttggctagaaactttggtcattatcaactaatctactaacatttaataacttgccatttcctatcaagcctgcattcacaaagtattttggactaatcttttcatctccaaatccactgtcaccatccttcatgcctgggattcttctccctgagaccaccgcacccagcagtcaaagtcatcttccacacttactactcaattgcagttcatacccactctggcagcgctggaaacaaggcctttcaaaatctgctgccagtatactgtatattctatcaagaacagtcactgaggctgcccctgcctggtgccttcctaccttcacgtgctcactttctcactcagacccccacacaaatgacagcaattcaaggcgcagccaaaatctcatctctgtgaagtttcccctaaccctctccagcccaaagcccaaagaaacctgtcccttccctgctgtccctcagctttctgatcctccctctcttaaggaatgtatcaactataaccccaccatgtcaacatgtggagggtggggacccatcttggtatccttcacagatcccaagaaatcaatgaatgctgtttgaattacctctgagtataaactagccaagttctaccaatacagaatagaatttatgctaaggattactttacccagaaggattagtttcctaataagtttgttagtattcctcatgtactgtgctattatcaggccttaatatagtatccctacaaaactgcataaaatgatggttcatgaacagtcacctcataaaatttgagctcctaaaagtcacaaacaataatttattagtcattgtatccctaacctctcacagtgtctaatattgtttaagttttaagaaagatgtttgccaaatttaaaagattttaggtccgaaaacaatgccacagaaaaaaatctacctgatttcttcacgtgttaaacaagagtgacagagatgctgccaacacattgattagctttaaagccaatgattagagaagcacaaagatattctggcagactgggaagcaaagaccaccatcacattgactgtagacctaaaccagaaggtaaggtgaagaatatcagtgacagacttttgaacctaattaaaaatgcttcttggccagcacagtggccttcacctgtaatctcagcactttgggaggccatggcaggaggatcacttgagcccaggaattcaaggctactgtgaagagtaattgtggcactgcattctagcctgggcaataaagcaagaccctgtctcttaaaaaaaaaaagcttcttaactaacaagactaagttaaattgaatgtcatctttgagtattcagtaatgagtatggaaaagtcactttagctgctaggtgtgcgacagttggaagaaggagactgaaatctgagagatttggtagcagactgtggctgtggtctcagggagaagcagctcaggcctgaagggtggtggcagtgggttcggagaagacaagatgggtccaagatactttgtggacataggcttgatacaacgtaggcttcatagctcttactttgcgtgtatacagtacagcaaatggccattgatttataatagatttactcagtttggcaagttgaagaatataaatctacatactaacatagaaacagatacaaacaaatcacatatatggctcaaggtcttgctgtgagagagatgactggtatgactaagtttaaaccctatttcatttctgcaacttctgagattttgtctcaaaaatgcattaatacaaatgtgctttttttgtctctctcagataatcatggacatattgatccctctctgagactcatctgggatttggctttccttggaagctcttacgtgatgtgggaaatgacaacacaggtgtcacactactacttggcacagctcactagtgtgaggcagtgggtaagaaaaacctgaaaattaacttgtgccacaagagttacaatcaaagtggtctccttagactgaattcatgcgaacttctaatttcatatcaagagttgtaatcacatttatttcaataaatatgtgagttcctgcaatgggccaagtattgtttcaggggctggggatacagtcgtgaacaaagacacaatgttgctgccctcattgagattaattctagtgagagaagataaaaagagacagtgagctaataaataaatatgtatcatatgatggtaaatgctatgaaaaaaattaagtagccaaggtggaaggatcacttgaggtcaggagtttgagaccagcctgggtagcatagcaaggccctatctctacaaaaaaattaaaaattagccagatgtagtggcacatgcctatagtcccaggtactcgggacgcagagttgggaggattgcttgatccaggagttggaggttgtaataagctatgattgagctactgtactccatcctgggcaacagagtgagatgccatctctgtctcaaaaaaaaaaaaaaaaaaaaaaaaaaaaaaaaaagtattgcaatattctaggcaaggcctggtggtggcttggaccagggtggtggcaatggggctggagagatgtttggattctggcagattgacagtatttgctcatgggttggatatggatatcagagatgagaggagttaaggatgatttttaggattttggtatgattaactagaaggacacagttttcatttaccgattggggaagcttataggaggaacagaattgagggagaattatcttgatttggggcattctaaattctataaccaaacagagaatttgtataatcttctggacagaagagtctgaagttcaggggagaggtctcggctgtagttgtcaccatatagtatttaaagccacaagactggatgagatcacagataatgagtgtagacaaagaaggtaagttatgtaaggactggatcatggaacacttctgacttaagcagttagagatatgggaaaagaaagtatttcaaggatgaggactggctggtagtactaaatgctgctggaaagtcaagtaagatgaggactgagaactgcccatttcattgagcaactggaagtcaatgaagggagagcttatcaagagccctctcactggcacagtggggacaaaaggcagattggggtaggttcaggaaaggatgggaggagaggaagtggacattccatcctttcaagaaatttagctataataaaggagagtaaaaggaaggaagaggactacagctggatgatgggtgagcatagggctgaaagggtttttgcattttttttggttgggagacataacagcatgtttatatgtcgatgagaaaaagtccagcagagagaggcaaagtaggaattgcatgaaagagagggaaaagttgttagagttactatctttgagtaggccagagaggatgtgattaatccagatgatattagaaacacggagagttcacatagagggaaagcaggaaacagtggccccagtgctaggagggcagatatcaaagtaggagcttgtggaagctctattctaactgcttctgtcttctcagtgaaaaacgaggcaaagtaataagctgagagcaggatgagagcaaaggtgttgggattattagagaggcaagctgaactaatcataagcaccaatttaaaaaattcgttttgttcataggtttacccagggatggatcatcagtgagtatcttctgagtacaggatttacccagcattaagtcatcatttttaatgtcaataatacatagtttggtttgctttccaaagaccacatgtacaacacacatcaactaaaaacctagattttgtctttacttatcaaaatgaacatgtctttccccatatagaatgcttttaaatagaaattatcatctaattgattgttgccatataacaagtcaagatacagtactagttcttttgctaggtaagtttctacctgtttctgacacactctcatctaccaagataaccacatcctcaacaagaggcttttactgtacctgattttaaagttagggggaagaggttgtttta
